United States Patent 11,098,302 (IDENTIFICATION OF POLYNUCLEOTIDES ASSOCIATED WITH A SAMPLE) - sequence listing, part 7

SEQ ID NO: 19951 - DNA, 720 bp, Homo sapiens
  misc_feature: GYAE6OF02H7GR9.25.86.H09.1.454.CMB.1.raw
tcagactgtacagtcacgaccggtgctcgatttagtgctatagacttgggtttgggggggacacctggggacactgaactggtgctgagttactgagatgagccagccctgcagctgtgtccagcctgcccatcctctgctcatttgcatacttcccagaacacaacctcctgccctgaagcttcttagtaggctggtcactacttcttgcaggagtcagacccactcacggacacagcatggacagtggacgggtccccgctcagcctccgtggggtcttctgctcgctcgtcggcctcccgaggtcgacctaaagtcgtcgacctactccgtacggttcgaccctacgtccttccacttccctccctcgttcctcgtcccttcgttcgttaccgacgtactacgttacgtaccacctactacgtacgtttcggtccgggtacgttacgggttaccgggttctacggtttcggcgtaacggttcgttaccgttttcggtaccgtaggttacttaccgtaacggtaccgtaaaaccgggtaaaccgggtaacgggggtaaaccgtcccgttaaaccggttaaccgttcccgttacccgttacggttaccgtttttaccgttacgtaccgttaccggttcccctttacgggtttaacgggtttacgggtaaacggttccgggtaacccgtttaccgtaaccggtttacggttaaacccggg

SEQ ID NO: 19952 - DNA, 756 bp, Homo sapiens
  misc_feature: GYAE6OF02ILEF2.25.86.H09.1.454.CMB.1.raw
  modified_base (222)..(222): a, c, t, g, unknown or other
  misc_feature (222)..(222): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtcgtggggganccgtggtacaggccgggggggtccctggagactctccgtgtgtagcctcgtggattcatgtttgatgattatgccatgctacgtggtccgtacgaagggtccggggaaggtcgtagggaggtggggtcctcgtcgttagtggtacgttgggagtaggggtaagaaacgtaacccgttaatagtcgaccaggtacctcgttggtagggtaaacggggtcgtattacccgaacctacccgttacccgaaggaacgaaaccgtaacctaagtaacccgtaaaaccggtaacccttaccccgttaaggttaactttaccgtacggaaaccctaaaagtacgggtaacctaagtttaccgtacggtaaaccctaccgttacgaacgttaccgaaacccgttaccgtcccgtttaagtttaagtttacgtttacggtggtaaacgggtaaacgggttccggggttaggtttagggtaacgggttagttaaacggtcccgtaacccgggttacccgggtaaccccccggtggttaacccgg

SEQ ID NO: 19953 - DNA, 432 bp, Homo sapiens
  misc_feature: GYAE6OF02GDKIV.25.86.H09.1.454.CMB.1.raw
  modified_base (329)..(329): a, c, t, g, unknown or other
  misc_feature (329)..(329): n is a, c, g, or t
  modified_base (415)..(415): a, c, t, g, unknown or other
  misc_feature (415)..(415): n is a, c, g, or t
  modified_base (420)..(432): a, c, t, g, unknown or other
  misc_feature (420)..(432): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggctacgggtcatcgtctcctcagcctccaccaagggcccatcggtcttccccctggccgccctgcctccaggcnccacctccgagagcacagcggccctgggctgcctggtcaaggactacttcccactcgtacagtctgacgcgggctggcaaggccgnatagnnnnnnnnnnnnn

SEQ ID NO: 19954 - DNA, 668 bp, Homo sapiens
  misc_feature: GYAE6OF02HMPYC.25.86.H09.1.454.CMB.1.raw
  modified_base (247)..(247): a, c, t, g, unknown or other
  misc_feature (247)..(247): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (457)..(457): a, c, t, g, unknown or other
  misc_feature (457)..(457): n is a, c, g, or t
tcagactgtacagtcacgaccggtgctcgatttagtgctatagacttgggtttgggggagtcgagacccactcaggacacagcatggacatgagggtccccgctcagctcctgggcttctgctgctctggctcccaggtgccaaatcgtgccatccagttgacccagtcctccatccctcctgtctgcctctgttcgagacattagtcacagtcacgttgtcggctaggtcgggctagttggcagtnctttagccgtggtatcagcagaaacgagggganactaccgtaagctcctagacttntttgattcgccttaccgtaggtttaggaaagttcggtacgtacccagttaccgaaacggttccgaacggtacggacgtaacgggttagggacttaccggggtgggtaacctaggttaactttcgtaacttcccgttacaccctacgtacgaacncgaacgtccgtcgacgaccgtcctaggaacgttacttcgacgtactaacttattacttacgtaactaaacttaagtttaacggtacctttaacccctactttacccttccggttaccgggtaccgggaacgggtaccgaagggtcgggaaactacgttaaccgaacgttaaccggtggttacgcgttaacggacctacgtacgtaccttcg

SEQ ID NO: 19955 - DNA, 515 bp, Homo sapiens
  misc_feature: GYAE6OF02GL2IP.25.86.H09.1.454.CMB.1.raw
  modified_base (291)..(291): a, c, t, g, unknown or other
  misc_feature (291)..(291): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (470)..(474): a, c, t, g, unknown or other
  misc_feature (470)..(474): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
tcagactgtacagtcacgaccggtgctcgatttagtgctatagacttagggtttgggagaaagggaacctacgtatgcacgaacctctgtgaagggtcgattcaccacctccaggacgacaacatcaagaactcccgtgtatctgcaaatggacagtctgacacctgatgacaccgccttgtattattgtgtgaaaggcggtgttgacggtgaatgcctggaacccccgcggtcagcactacttctacatgggcgtcgtggggcgaaagggactacggcaatcgtctcctnagcctccaccaagggcccatcggtctccccctaggccgccctgcctccaggagccacctccgagagcacagccggcccgtaggggccgtcgccctggtacaagggactacttccgactcgtacaggtctgagtcggctgggacaaggcgcagtagnagnacntagctgcgtanangtannnnnanangagncncgctcgtcgngcgagagngaganagagagcg

SEQ ID NO: 19956 - DNA, 522 bp, Homo sapiens
  misc_feature: GYAE6OF02HLMOF.25.86.H09.1.454.CMB.1.raw
  modified_base (218)..(218): a, c, t, g, unknown or other
  misc_feature (218)..(218): n is a, c, g, or t
  modified_base (490)..(522): a, c, t, g, unknown or other
  misc_feature (490)..(522): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacagtgggcgtcgtgggggcaaaagggactacggtcatcgtctcctcacgcctccaccaacgggccccaagtcccggttcccttccccccgtggcccgccctgcctccgaggacgccacctccggagagccacgacgccggccctggggcctcggcccgttgggtacaaacgggaccttaccttcccgacgttacgtaaccaggttctcggacgggccggggtctacggggaccaaaggggccgaccaagttacgnnnnnnnnnnnnnnnnnnnnnnnnnnnnnnnnn

SEQ ID NO: 19957 - DNA, 541 bp, Homo sapiens
  misc_feature: GYAE6OF02GFQIY.25.86.H09.1.454.CMB.1.raw
  modified_base (275)..(275): a, c, t, g, unknown or other
  misc_feature (275)..(275): n is a, c, g, or t
  modified_base (343)..(343): a, c, t, g, unknown or other
  misc_feature (343)..(343): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcggtcattggcagtgctttagcctggtatcagcagaaaccaggggaanctctaagctcctgatctttgatgcctcagtttgaagtggagtccatcaagtcagcggcagtggatcgngggacagtatttcactcctcacctatcagcagccctgcagcctagaacgtattcagacctaaaccttatttattacgtacaaacttaagtttaacggactttaccctacttccttccgttcgggacgggtagggacccgtaagggtacggaagaataccgaaacggtacgttggacgcgtacgcctaccgatcgttcg

SEQ ID NO: 19958 - DNA, 418 bp, Homo sapiens
  misc_feature: GYAE6OF02HO8JN.25.86.H09.1.454.CMB.1.raw
  modified_base (410)..(410): a, c, t, g, unknown or other
  misc_feature (410)..(410): n is a, c, g, or t
  modified_base (414)..(418): a, c, t, g, unknown or other
  misc_feature (414)..(418): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtattgaggtgaatgcctggaacccccgcggtcagcactacttctacatgggcgtctggggcaaagggctacggtcatcgtctcctcagcctccaccaagggccccatccggtcttccccctggccgccctgcctccaggagcacctccgagagcacacgcggcctgggctgcctggcaaggctacttccactgtacagtctgagcgggctggcaaggcgnatgnnnnn

SEQ ID NO: 19959 - DNA, 494 bp, Homo sapiens
  misc_feature: GYAE6OF02HCNBV.25.86.H09.1.454.CMB.1.raw
  modified_base (223)..(223): a, c, t, g, unknown or other
  misc_feature (223)..(223): n is a, c, g, or t
  modified_base (435)..(435): a, c, t, g, unknown or other
  misc_feature (435)..(435): n is a, c, g, or t
  modified_base (461)..(463): a, c, t, g, unknown or other
  misc_feature (461)..(463): n is a, c, g, or t
  modified_base (466)..(494): a, c, t, g, unknown or other
  misc_feature (466)..(494): n is a, c, g, or t
tcagactgtacagtcacgaccggtgctcgatttagtgctatagactttggggttgggaagaagaacctactatgcagactctgtgaagggtcgattcaccacctccagagacaacatcaaagaactccctgtatctgcaagtggacagtctgacacctgatgacaccgccttgtattattgtgtagaaaaggcggtgttgaggtgaatgcctggaacccccgnggtcagcactacttctacagttcgggcttcgtgggggccaaaaaggggactacggtcatcgtactccgtcagccctccaaccaagggcccaattcggtccttccccctggccgcccctggcctccagggacgcctaacctccgagacgctacgaggtcggccctgggcctgcctggtcaaagctacttccatagtacagttctgagcgggtntgggaccaaagggtccgataatacgnnnctnnnnnnnnnnnnnnnnnnnnnnnnnnnnn

SEQ ID NO: 19960 - DNA, 555 bp, Homo sapiens
  misc_feature: GYAE6OF02HEVZ2.25.86.H09.1.454.CMB.1.raw
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (425)..(425): a, c, t, g, unknown or other
  misc_feature (425)..(425): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctagtcgggtcattggcagtgctttagcctggtatcagcagaaacnggggaanctactaagctcctgatctttgatcgctcagttggaaagtggatccatcaagtnagcgnagtggatcgtgggacagtatttgatcctcaacatcacggcaagtccctagaccgtagccgttagaaagtacttctgacctaaaaccgttnttacttagtaaccaaataagttttaacgacctttacctactcttaccgttacggacggtaagggacctaaagggtcggaaataccgtagtaaaaccgtacggttggtacgtccgtacggtaccacgtacg

SEQ ID NO: 19961 - DNA, 460 bp, Homo sapiens
  misc_feature: GYAE6OF02G0XEU.25.86.H09.1.454.CMB.1.raw
  modified_base (217)..(217): a, c, t, g, unknown or other
  misc_feature (217)..(217): n is a, c, g, or t
  modified_base (439)..(439): a, c, t, g, unknown or other
  misc_feature (439)..(439): n is a, c, g, or t
  modified_base (444)..(460): a, c, t, g, unknown or other
  misc_feature (444)..(460): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtggggacaaagggactacggtcatcgtctcctcacgccctccaccgaacgggccctatccggtccttcccccgtggccgccctcgctcccgaggacgccacctccgagacgcacacggcggccctgggcctgcctggtcaacggactacttccactcgtactagtctgacggcgggtcgtggacaagggccganatagnnnnnnnnnnnnnnnnn

SEQ ID NO: 19962 - DNA, 475 bp, Homo sapiens
  misc_feature: GYAE6OF02I5ZUR.25.86.H09.1.454.CMB.1.raw
  modified_base (453)..(475): a, c, t, g, unknown or other
  misc_feature (453)..(475): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaaatggacagtctgacacctgatgacaccgccttgtattattgtgtgaaaggcggtgttgaggtgaatgcctggaacccccgcggtcagcactacttctacatgggcgtcgtggggacaaaagggactaacggtcaagtccgtctcctcacgccctccaaccgaaggcccaatccggtccttcccccgtggccgccctgcctaccgaggacgccacctccgagacgcacgacgcggccctgggctgccgtggtacaaacggctaccttccaacgtcgtacagtctaggacgcgggctgggacaaaggcgacagtagcnnnnnnnnnnnnnnnnnnnnnnn

SEQ ID NO: 19963 - DNA, 503 bp, Homo sapiens
  misc_feature: GYAE6OF02H1KMK.25.86.H09.1.454.CMB.1.raw
  modified_base (245)..(245): a, c, t, g, unknown or other
  misc_feature (245)..(245): n is a, c, g, or t
  modified_base (474)..(503): a, c, t, g, unknown or other
  misc_feature (474)..(503): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtntggggcaaagggctacggtcatcgtctcctcacgcctccaccgaagggccccagtccggtccttcccccctgggcctcccctgcctccgaggcgccacccgtccgagacgccacacggcccggcccgtggggcctcggcccgttggtacgaaagggtacccttaccttcccacgttcgtaaccagttccgtggacggcgggcgtgggacgaagggtcgactagtagcannnnnnnnnnnnnnnnnnnnnnnnnnnnnn

SEQ ID NO: 19964 - DNA, 715 bp, Homo sapiens
  misc_feature: GYAE6OF02JFIHK.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtccacactctacttggtcgggctaggtcgggtcagttggcagtgtctttagccgttggtactcagacaaggaaaaccgaggggaacgtcctacctaacggtcctcccgtagtacttacgtttagacgttcgtcctaccgttaggtttagggaaacgttacgggacgttccctaacgttacgtaacggtttacgacggtacggtacgtaaggtggtaacgtcgtacggggaactaacggttacttttaccgaaccttccctaacctaacccgtagttaccaacgtacgaaccggtcctacgtaccgaccgtaccgtaggtaaacgttcttaccgtacgtaacctaaaccgtttaacttacgtttactaaccgtaaaacttaacggtttaacgtaaaccttcccgttattacccgttacccgttacgggacgggtaaccggtaacgtaagggtacgtaaggtaaccgtaacgtaacggtacgtcggtacggtactacgtacctacgtacg

SEQ ID NO: 19965 - DNA, 608 bp, Homo sapiens
  misc_feature: GYAE6OF02G2BSP.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctagtcgggtcattggcagtgtctttagcctggtatcagcaagaaaccgaggggaacgctacctaagcctccgtagtacttctttagatcgtcctacgtaggttaggaagtggacgtcctatacgtacggtcgacggcggacgtaggtggatcgtagggactagtactttactactccctacacctatacgacgtcacgtccgtacgaccacgtaccgtagaacgttcttcgactacctaactttattacgttacgtactaaacgttaagtttaacgtacctttaacccttcgttaccgttccgtacgggaccggtaacgggtacgtaagggtagaacgtaactaaccgaacgtacgtcggtacgtacgtacgtacctactacg

SEQ ID NO: 19966 - DNA, 631 bp, Homo sapiens
  misc_feature: GYAE6OF02FVW5J.25.86.H09.1.454.CMB.1.raw
  modified_base (279)..(279): a, c, t, g, unknown or other
  misc_feature (279)..(279): n is a, c, g, or t
  modified_base (353)..(353): a, c, t, g, unknown or other
  misc_feature (353)..(353): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgcttagcctggtatcagcagaaaccgaggggaanctacctaagctcctagatctttgatcgcctcaggtttaggaaagtggacgtcccatacgtaaggtcaggcgganaggtggatcgtagggacagtactttcgactccctacaccctagtcacgtccaacgccttgaccacgtcctaggaacgttacttcgaacgtacctaacccgtttatttaattacgtactaaaaccttaaagtttaaccgttactttaaccccttctttacccttacccggtttcgggtaaccggggaacggttaaccggtaaacggggttacgggaaactaacgtaaccgtaaaccggtaacgttcgggttacggccgttacggtacccacccgttacg

SEQ ID NO: 19967 - DNA, 428 bp, Homo sapiens
  misc_feature: GYAE6OF02HA6C0.25.86.H09.1.454.CMB.1.raw
  modified_base (390)..(390): a, c, t, g, unknown or other
  misc_feature (390)..(390): n is a, c, g, or t
  modified_base (415)..(428): a, c, t, g, unknown or other
  misc_feature (415)..(428): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccacaagggcccatccggtctccccctggccgccctgctccaggagcacctccgagagcacagccggccctgggctgcctggtcaaggctactccactcgtacagtcngagcgggctggcaaggcgcagtagnnnnnnnnnnnnnn

SEQ ID NO: 19968 - DNA, 494 bp, Homo sapiens
  misc_feature: GYAE6OF02GK1IH.25.86.H09.1.454.CMB.1.raw
  modified_base (218)..(218): a, c, t, g, unknown or other
  misc_feature (218)..(218): n is a, c, g, or t
  modified_base (465)..(465): a, c, t, g, unknown or other
  misc_feature (465)..(465): n is a, c, g, or t
  modified_base (469)..(494): a, c, t, g, unknown or other
  misc_feature (469)..(494): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtggggcaaagggactacggtcatcgtctcctcagccctccaccgaaggggcccattcggtccttccccccgtggccgccctcgcctccgaggacgccaccctccgacgaggccaacaggccggcccgtgggcctcggccctgggtacaacgggaccttaccgttcccacgttcgtaactcgtctggagccgggctcgggtacaaagggcgacacgtagngcannnnnnnnnnnnnnnnnnnnnnnnnn

SEQ ID NO: 19969 - DNA, 632 bp, Homo sapiens
  misc_feature: GYAE6OF02IBACO.25.86.H09.1.454.CMB.1.raw
  modified_base (280)..(280): a, c, t, g, unknown or other
  misc_feature (280)..(280): n is a, c, g, or t
  modified_base (377)..(377): a, c, t, g, unknown or other
  misc_feature (377)..(377): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccacttgacccagtctccatcctccctgtctgcctctgttcgagacatagtcacatcacttgtcgggctagtcggtcattggcagtgtctttagccttggtatcagcgaagaaacccgaggggaancctacctaagcctcctgtattctttgatcgcctcgtagtttaggaagtggacgtcccatcgtaaggttcagcggcgagtggatcgtagggactagtntttacactccctacacctactaccgagcacgtccctgccacgcctagtaagttacttccgtagaacctaaccgttatttacgttactactaaacttaacgttttaacgttactttacccttctttacccgttccggttaccgggaccgggtacgggtaaccgtaagggttacgggaactaaccgttaacggaaaccggtaacgtttcgggttacgtaccggttaccgaccgtaacccgttacgttacgtttaccg

SEQ ID NO: 19970 - DNA, 642 bp, Homo sapiens
  misc_feature: GYAE6OF02ISMB6.25.86.H09.1.454.CMB.1.raw
  modified_base (183)..(183): a, c, t, g, unknown or other
  misc_feature (183)..(183): n is a, c, g, or t
  modified_base (559)..(559): a, c, t, g, unknown or other
  misc_feature (559)..(559): n is a, c, g, or t
  modified_base (573)..(573): a, c, t, g, unknown or other
  misc_feature (573)..(573): n is a, c, g, or t
  modified_base (578)..(578): a, c, t, g, unknown or other
  misc_feature (578)..(578): n is a, c, g, or t
  modified_base (584)..(584): a, c, t, g, unknown or other
  misc_feature (584)..(584): n is a, c, g, or t
  modified_base (589)..(589): a, c, t, g, unknown or other
  misc_feature (589)..(589): n is a, c, g, or t
  modified_base (592)..(592): a, c, t, g, unknown or other
  misc_feature (592)..(592): n is a, c, g, or t
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
  modified_base (628)..(628): a, c, t, g, unknown or other
  misc_feature (628)..(628): n is a, c, g, or t
  modified_base (639)..(639): a, c, t, g, unknown or other
  misc_feature (639)..(639): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagttcttgacacctgattgacaccgccttgtattattgtntgaaaggcgtgttgaggtgaatgtcctcggaaccccgcggtcagtcactacttctacagtcggcgtctgggacaaaggctacggtcatacgtctcctcacgtccctacccaacccgaacgggcccctacgtcccggttaccttcccccggtggcccggtcccgttcgtccgtcccgaaggtaccgtaccgtaaacccgttccgggaaggaacctacctaacgaaccggtccccggtcccgtttacgggggccctccggtacccgttacggggtaaaccgtaaccgggtaacctttaccccttacccgaccgtttacgtaccgtacgttaccgtggaacggtccgggccgtagggacgaaacgtccgacctaaagtncgtcagcaatgcgngtcancagtcngtgangtngtaccngacgngtcgacgtcgcacttcgcttcacgntccgctaccgnacg

SEQ ID NO: 19971 - DNA, 583 bp, Homo sapiens
  misc_feature: GYAE6OF02JLX22.25.86.H09.1.454.CMB.1.raw
  modified_base (181)..(181): a, c, t, g, unknown or other
  misc_feature (181)..(181): n is a, c, g, or t
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
  modified_base (357)..(357): a, c, t, g, unknown or other
  misc_feature (357)..(357): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (559)..(583): a, c, t, g, unknown or other
  misc_feature (559)..(583): n is a, c, g, or t
tcagactgtacagtcacgaccggtgctcgatttagtgctatagacttgggttgggagaagaacctactatgcagactctgtgaagggtcgattcaccacctccacgagacaacatcaagaactccctgtatctgcaaaatggacagtctgacacctgatgacaccgccttgtattattgtntgaaaggcggtgttgaggtgaagtgactggaacccccgnggtcaggcataccttctacatgggcgtcgtcggggacaaaggggtctaccgggtnaacgtcggtacctccgtccgagccctccctaaccgaacgggcccccaagttcccggggtcccttcccccccgtagggccccncccccgttcgcccttcccgacggaccgccctacccgtcccgggaacggtacacctaccgagccccgggtcccctgggccttcgacccgtcggggtaccaaacgggtaccctaccgtttccccgacgttacgggtacacgttcgtacgacggcgggtcgtgggaccaagggccgacgacgtagggactntgcngcagcgtgcnnnnnnnnnnnnnnnnnnnnnnnnn

SEQ ID NO: 19972 - DNA, 722 bp, Homo sapiens
  misc_feature: GYAE6OF02GHAIE.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctcctgtctgcctctgttcgagacatagtcaccatctacttggtcgggctaggtcgggtctagttggcagtgtctttagccgtggtactcgagacaagaaaccgaggggaactcctaccgtaacgcctccgtaggtacttcgtttagactcgcccttacgtaaggtttagggaaaggtcggtacgtaccctaagtacgtaacggtttccgaggtccggacgtaggtaggtactcggtagggactagtactttacacgttccctacgaacctagtaccgagtcctacggcccgttacgaccgtacgtccgttaagaacgtttacttccgtacgtaacctaaaccttttagttaaccttacggtttaacctaaaacgtttaaacgttttaaccggttaacccttttaccccgttacccgtttacccgttacccgggttaccgggaccggggtaaccggtaaaccggtagggttaacggaacgttaacgtaacccgtaaacggttacgttcgggtaccggtactaccggtacctaaccgttaccgg

SEQ ID NO: 19973 - DNA, 575 bp, Homo sapiens
  misc_feature: GYAE6OF02G33PK.25.86.H09.1.454.CMB.1.raw
  modified_base (215)..(215): a, c, t, g, unknown or other
  misc_feature (215)..(215): n is a, c, g, or t
  modified_base (443)..(443): a, c, t, g, unknown or other
  misc_feature (443)..(443): n is a, c, g, or t
  modified_base (542)..(542): a, c, t, g, unknown or other
  misc_feature (542)..(542): n is a, c, g, or t
  modified_base (550)..(550): a, c, t, g, unknown or other
  misc_feature (550)..(550): n is a, c, g, or t
  modified_base (552)..(575): a, c, t, g, unknown or other
  misc_feature (552)..(575): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctagtaatctgcaaatggaacagtctgacacctgatgacaccgccttgattatgtgtgaaaggcgtgtgaggtgaatgcctggaaccccnggtcaagcgactacttcacagtcgggcgtactcgggggacaaaacgggggactacgggtaccaagtccggtactaccgtctaacggtccctcccaacgaccggggccccaacgttccggttccctttcccccccgtgggcccgtccccgttcgccccgttccgaaccggacggaccctcccgttacccggaagacgcccgaactaacggcccggcccgtcggggtccncgtccccgttggtaccaacggggtaaccttccgtacccgtacttacgtaccgacgtccgtaggacgcgggacgtcggaacgacgggtcacgagacggtnagctagcnannnnnnnnnnnnnnnnnnnnnnnn

SEQ ID NO: 19974 - DNA, 451 bp, Homo sapiens
  misc_feature: GYAE6OF02G3BIT.25.86.H09.1.454.CMB.1.raw
  modified_base (218)..(218): a, c, t, g, unknown or other
  misc_feature (218)..(218): n is a, c, g, or t
  modified_base (310)..(310): a, c, t, g, unknown or other
  misc_feature (310)..(310): n is a, c, g, or t
  modified_base (328)..(328): a, c, t, g, unknown or other
  misc_feature (328)..(328): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (418)..(451): a, c, t, g, unknown or other
  misc_feature (418)..(451): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaaagggactacggtcatcgtctcctcagcctccaccaaggcccatcggtcttcccccnggcgccctgctccaggancacctcgagagcacagcgcctgggctgcctggtcaaggctactcactggtaacngtcngagcgggctgggcaaaggccgagtactagcgnnnnnnnnnnnnnnnnnnnnnnnnnnnnnnnnnn

SEQ ID NO: 19975 - DNA, 721 bp, Homo sapiens
  misc_feature: GYAE6OF02I8J18.25.86.H09.1.454.CMB.1.raw
  modified_base (297)..(297): a, c, t, g, unknown or other
  misc_feature (297)..(297): n is a, c, g, or t
tcagactgtacagtcacgaccggtgctcgatttagtgctatagacttgggtttgggggcaggaggtcagacccactcaggacacagcatggacatgagggtccccgctcagctcctggggcttctgctgctctggctcccagtgcaatgtgccatccagttcgaccagtctccactcctcctgtcctgcctctgttcgacgacagtacgtcaccatcacttcggtcgggctaggtcggtctagttcggctaggtgtcgtttagcccttggtactcagctaagaaaccgaggggaacnccgtacctaaggcctacctgtaattccttagaatcgtcctacgtaggtttaggaacggttcggtaacgtcccgtaattacggtaacgggttaccaggtccggtacgtacggtcggtactaccggttacgggactacggttactttccgacttccccgtacgaacctacaccgtacgccgacgtaccgttcggaccgtacgtccgtaaggaacgttacgttaccgtgtaccctaacgttaactttacgttaccgttacctaaaacgttaacggtttaacgttactttaccccgtacgtttcccgttaccgggtttaccggggcggttaaacgggaccggttaaacgggtacggttaacggtaacttaccggaaaaccggtccgttacgggttaccggcgttaaccggtaccgtaaccgttaccgg

SEQ ID NO: 19976 - DNA, 590 bp, Homo sapiens
  misc_feature: GYAE6OF02G05WK.25.86.H09.1.454.CMB.1.raw
  modified_base (281)..(281): a, c, t, g, unknown or other
  misc_feature (281)..(281): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcggctagtcgggtcattggcagtgctttagcctggtatcagacaagaaaccgaggggaacnctacctaagcctactgtatctttgatcgcctacgtagtttaggaaagtggacgtccatacgagtcagtcgatacgtgtactcgtggacagtattacatccctacacctatcacgcacgcctgacctacgcctaagaacttacttcgagtaaccctaactttatttaacgttacgtaacctaaaactttaacgttaacgtacctttacccgttacttaccgttcccggttacgggacggtacgggtaaccgtaagggttacggaataacgtaacgaaacgtacgttcggacgtacgacgtaccacctacg

SEQ ID NO: 19977 - DNA, 630 bp, Homo sapiens
  misc_feature: GYAE6OF02GMZY9.25.86.H09.1.454.CMB.1.raw
  modified_base (284)..(284): a, c, t, g, unknown or other
  misc_feature (284)..(284): n is a, c, g, or t
tcagactgtacagtcacgaccggtgctcgatttagtgctatagacttggggtttgggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcggtcattggcagtgtctttagcctggtatcgagcaagaaaccgagggggaacnctactaagctcctgacttctttgactcgccctcgtaggtttaggaaagtcggacgtcccatcgaaggttcaggcggagaggtggtatcgtagggacagtatttcactcctacacatcacgcacgcctgcacgtcctagtaagtacttcctacgtacctaaccgtttattacttacgtaactaaacgttaaagttttaaaccgtacctttaccccttacgttcccgttacggttaccggggacgggtaaccgggtaccgaacggggttaggaacgtaacgttaaccggaaaaccgtaccggttggtaccgggtacttaccggaaccttaccgtacttccggttaccg

SEQ ID NO: 19978 - DNA, 420 bp, Homo sapiens
  misc_feature: GYAE6OF02FL7VN.25.86.H09.1.454.CMB.1.raw
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (412)..(420): a, c, t, g, unknown or other
  misc_feature (412)..(420): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggacccccgcggtcagcactacttctacatgggcgtctggggcaaagggactacggtcatcgtctcctcagcctccaccaagggcccatcggtcttcccccnggccgccctgctccaggagcacctccgagagcacagcggccctgggctgcctggtcaaggctacttccactgtacngtctgngcgggctggcaggcgcagagnnnnnnnnn

SEQ ID NO: 19979 - DNA, 515 bp, Homo sapiens
  misc_feature: GYAE6OF02GHADO.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatctacttgtcgggctaggtcgggtcattggcagtgctttagcctggtatcagcagaaaccaggggaagctcctaagctcctgatcttgatgcctcagtttggaagtggacgtccatcaaggttcagcggcagtggatcgtgggacagtatttcatcctcaccatcagcagcctgcacgcctagaatattcagacctaacctattatgtacaactaatttaagacttaccctctcctccgttccggacgggacggaccgtaagggtggagacgtacaaagtactggtcgactcgacacctacg

SEQ ID NO: 19980 - DNA, 515 bp, Homo sapiens
  misc_feature: GYAE6OF02HD0HD.25.86.H09.1.454.CMB.1.raw
  modified_base (280)..(280): a, c, t, g, unknown or other
  misc_feature (280)..(280): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (406)..(406): a, c, t, g, unknown or other
  misc_feature (406)..(406): n is a, c, g, or t
  modified_base (457)..(457): a, c, t, g, unknown or other
  misc_feature (457)..(457): n is a, c, g, or t
  modified_base (511)..(511): a, c, t, g, unknown or other
  misc_feature (511)..(511): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctagtcgggtcattggcagtgctttagccttggtatcagcaagaaaccaggggaanctcctaagcctcctgacttctttgatgtcctcagtttggaaagtggagtccatcgaagttcgagcgnaggtgatcgtgggacngtatttnactcncacatcagtccagctgcacgcctaggaactnttcctagcctaaccttattattcgtactaactaaatttaacgacttccctntcctcgtcggagtacgtacgaaggtgagactacgaacgtatggtacgctcgacnctac

SEQ ID NO: 19981 - DNA, 620 bp, Homo sapiens
  misc_feature: GYAE6OF02GGV5Y.25.86.H09.1.454.CMB.1.raw
  modified_base (288)..(288): a, c, t, g, unknown or other
  misc_feature (288)..(288): n is a, c, g, or t
  modified_base (392)..(392): a, c, t, g, unknown or other
  misc_feature (392)..(392): n is a, c, g, or t
  modified_base (475)..(475): a, c, t, g, unknown or other
  misc_feature (475)..(475): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagctgggttttccttgttgccattttaaaaggtgtccagtgtgaagtgcaacgtggtggagtcggtgggggagccggtggtacgagggccgggggggtccctgagactctcctgtgtagcctctggattcattgtttgatgtattangccatgcacgtggggtccctacgaacggggtccggggaaggtcgtgggaggttcgggtcctcgttcttagtcgtacgttgggagtgggagaacaactactagtncgagctcgtaggaggtaagggtctaactccacctacctaccgaagacaacaacataccgaaactacctaccctagtactctanacgaatacgactagtacgtagactacctgactaccgactaccgtctttagtactttagttgtgtacggtaagggttcggttagggtaggtagggttagaacggttcgtccccggtaaccgggaacccccggtgtaccgtaaccgg

SEQ ID NO: 19982 - DNA, 528 bp, Homo sapiens
  misc_feature: GYAE6OF02IDIQ8.25.86.H09.1.454.CMB.1.raw
  modified_base (354)..(354): a, c, t, g, unknown or other
  misc_feature (354)..(354): n is a, c, g, or t
  modified_base (495)..(528): a, c, t, g, unknown or other
  misc_feature (495)..(528): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggctacggtcatcgtctcctcagccctccaccaagggccccatccggttccttcccccgtgggccgcccctgcctccgacggtgccacccgtccgagngccacaggcccggcccgtcggggctcgcccgttgggtaccaacgggtaccttaccttcccgaacttggtaacctaggtttcctagggaacggtcccgggggactacggggacaaaccggggcccgataacgtaggcagtcnnnnnnnnnnnnnnnnnnnnnnnnnnnnnnnnnn

SEQ ID NO: 19983 - DNA, 623 bp, Homo sapiens
  misc_feature: GYAE6OF02JERNV.25.86.H09.1.454.CMB.1.raw
  modified_base (487)..(487): a, c, t, g, unknown or other
  misc_feature (487)..(487): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagttggactgagctgggtttccttgttgccattttaaaaggtgtccagtgtgaagtgcaactggtggagtcgtgggggagccggtggtacaggccggggggtccctgagactctcctgtgtagcctctggattcattgttgatgattatgccatgcacgtggggtcccgtcgaagggtccggggaagggtcgtgggaggtcggggttctcgttacttagtgacgttgggagtgggaagaagtaacctatatggctaacgactcgtggtaggaacgggttcgtacgttaccgaccctacctacccagacgtaacaactatacgaaagaccttccctgttactctacganaaagttgactagtctagaccactgataccgactacccgtcttacgttagtttcgtggttaggtaaggtaacgggtcgggttggttaggtacggtaggtaacgtccgtccggtaacccgggaccccgtggtacccgg

SEQ ID NO: 19984 - DNA, 682 bp, Homo sapiens
  misc_feature: GYAE6OF02G7QG3.25.86.H09.1.454.CMB.1.raw
tcagactgtacagtcacgaccggtgctcgatttagtgctatagacttgagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacaggccggggggtccctgagactctcctgtgtagcctctggattcattgtttgatgattatgccatgctacgtgggtcccgtcgaacgggtccggggaagggtcgtgggaggttcggggtcttccgttacgtttagtggtacgtttggggagtggggaacgtaaaggtaacccttatagtgaccgtaagaccttcgttggtaggtaaggggttcgtactttcgaacccctacctcccgaaagacgaactaaacgactaacgaaacgtaaccttccccgtagtttactaccgttcgaaactaaagttcggaacctaggttctacggaacctacctgtaactcgaaccgtacccgtactttacgttatttacgttgttaggttaggaaacggggttcgttagggttggaaggtgtaacgttcgggacccgtacccgggtaacccccggtcggtaccgtaaccgg

SEQ ID NO: 19985 - DNA, 435 bp, Homo sapiens
  misc_feature: GYAE6OF02GAESQ.25.86.H09.1.454.CMB.1.raw
  modified_base (95)..(95): a, c, t, g, unknown or other
  misc_feature (95)..(95): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (414)..(426): a, c, t, g, unknown or other
  misc_feature (414)..(426): n is a, c, g, or t
  modified_base (428)..(435): a, c, t, g, unknown or other
  misc_feature (428)..(435): n is a, c, g, or t
tcagactgtacagtcacgaccggtgctcgatttagtgctatagacttgggtttgggagaagaacctactatgcagactctgtgaagggtcgattnaccacctccagagacaacatcaagaactccctgtatctgcaaatggacagtctgacacctgatgacaccgccttgtattatgtgtgaaaggcgtgttgaggtgaatgcctggaaccccgcggtcagcactacttctacatgggcgtctggggcaaagggactacggtcatcgtctcctcagcctccaccaagggccccatcggtcttcccccgtgccgccctgctccaggagcacctctgggggcacgagcggccctgggctgcctggtcaaggactacttccactgtacagtcngagcggntcggcaaggcgcagtgnnnnnnnnnnnnngnnnnnnnn

SEQ ID NO: 19986 - DNA, 529 bp, Homo sapiens
  misc_feature: GYAE6OF02IFP2F.25.86.H09.1.454.CMB.1.raw
  modified_base (218)..(218): a, c, t, g, unknown or other
  misc_feature (218)..(218): n is a, c, g, or t
  modified_base (492)..(492): a, c, t, g, unknown or other
  misc_feature (492)..(492): n is a, c, g, or t
  modified_base (494)..(499): a, c, t, g, unknown or other
  misc_feature (494)..(499): n is a, c, g, or t
  modified_base (501)..(529): a, c, t, g, unknown or other
  misc_feature (501)..(529): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtggggacaaaaggggctacggtcatcgtcctcctcacgcctccaccgaacgggccccagtccggtccttccccccgtgggccgcccctgcctccgaagggacgcccacctccggaagacgccaacgacggcccggcccgtcggggctcgcccgtggtacgaacgggtaacctacctttcccacttcgtacgagtcgtacggacggccggggtctcgggacgaaacggggccgactaagttagcgtncnnnnnngnnnnnnnnnnnnnnnnnnnnnnnnnnnnn

SEQ ID NO: 19987 - DNA, 634 bp, Homo sapiens
  misc_feature: GYAE6OF02F7MH0.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacgttggtcgggctagtcgggtacagttggcagtgtctttagcctggtatcgagtcaagaaaccgaggggaactcgtaccgtaagcctccttaggtattccgtttagactcgtccttaccgtaggtttagggaaaggtcggacgtcccgtatacgtaacggttcgagtcggactaggtcggaactcggtagggactagttactttcatcctactatacactctacgcacgtaccgtgacgacgtcctaggaactacttcgacgtacctaacttagttacttacgtaactaagttaacgtttaacggtacctttaacccgttcttaccgttccttaccgggtacgggtaaccggtaacggtaagggtacggaagttaacgtaaccgtaacgtacgtcggttaggacctcgaccgtaaccg

SEQ ID NO: 19988 - DNA, 522 bp, Homo sapiens
  misc_feature: GYAE6OF02F6AHZ.25.86.H09.1.454.CMB.1.raw
  modified_base (279)..(279): a, c, t, g, unknown or other
  misc_feature (279)..(279): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (451)..(451): a, c, t, g, unknown or other
  misc_feature (451)..(451): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaaagtggagtccagtcaaggttcagcggcaggtgatcgtgggacagtatttcgatcctcaccatcagcacgctgcagcctagaactnttcngactaacctatttatactacaacttaagtttaaggtacttaccctntccttccgttcgggacggagggaccgaagggtcggagaataccgaaagtacgtggtagctacggcactacg

SEQ ID NO: 19989 - DNA, 605 bp, Homo sapiens
  misc_feature: GYAE6OF02IN1J9.25.86.H09.1.454.CMB.1.raw
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
  modified_base (502)..(502): a, c, t, g, unknown or other
  misc_feature (502)..(502): n is a, c, g, or t
  modified_base (554)..(554): a, c, t, g, unknown or other
  misc_feature (554)..(554): n is a, c, g, or t
tcagactgtacagtcacgaccggtgctcgatttagtgctatagacttggggtttgggagaagaacctactatgcagactctgtgaaggtcgattcaccactccagagacaacatcaagaactccctgtatctgcaaatggactagtctgactaccttgagtgacaccgtccttgtattattgtgtgaaggcggtgttgaggtgaatgccgtcggaaccccgnggtcacgcacgttacttctacagtggcgtgtgggacaaggactacggtctatcgtctcctanacgcctaccgaccgacggccctagtcccgttccttccccgtggccgacccgtgccgtcgaggcgtccgaccgtcgagtgtacgtagacgtccggtaccgtggctacgtccgttaggtacgaacgtacttaccgttaccgacgtacggtacctacgtcgtgaaccggtcgggtactagggactaaacgggcctaaccgtaagtgtacgtactgacgtanagacacgacgacgtgacgacgtagacgagcgtatacgtcgtacgtcgtacgngtaagacgtagtacgagtacgtcgtacgtacgtacgtacgtacgtagtacg

SEQ ID NO: 19990 - DNA, 752 bp, Homo sapiens
  misc_feature: GYAE6OF02IGXDK.25.86.H09.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctccaggtgccaaatgtgccatccagttcgacccagtctccactccctcctgtctcgcctctcgttcgganactatagtcacatctacttggtcggtctaggtccggtntagttcggctagtcgtcttagcctggtatcagtacaacgtaaacggagggaacgtcctacgttaacgccttacctgtaacttcgtttagactcgtccttaccgtaagggtttacggaaggtcgtacctaccgtacgtacgtaaacgttccgagtacgggactagggtacggtacgttcggtagggaactacgttacgtttaccacgtacccttacgaacctacgttacgacgtacgtaccgtccgttacgaccgtaccggttaccttaagggtaaacgttaccttccggtacggttaaccctaaaacgggttttactttaacgtaccggttaaaccctaaacgtttaaacggttaaccttaccctttaccccgtttaacgtccccgtttaaccgggtaacccgggggtacggtaaacccgggtttccggaaaacgggttacggaaccgttaaccgtaaacccgtaacgttacgggtcgttcggttaaccgacgtacccttaaccgtcgg

SEQ ID NO: 19991 - DNA, 682 bp, Homo sapiens
  misc_feature: GYAE6OF02IL9FV.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctcgcctctgttcgagacatagtcaccatcacttgtcggctagtcggtcattggcagtgctttagcctggtactcgagacaagaaaccgaggggaactcctaccgtaagctccgtagacttctttagactcgtacccttctaaggtttaggaaacgtggacgtacccataccgtaaaggttcacgcgggcaggtcggatcgtagggactagtattttacgacttcctcaaccgatacgacgtcgtacgcccttgacccgtagtacccgttaggaaacgtcttttaccacgtacccttaaacgtttaagtttacgttacggttaaactaaaccgtttaaaggtttaacggttacttttaccccctagtttacccttacccgggttacgggtaccgggaacgggttaacccgaaagggggtttacggaaacgaaccgtttaaaccgaaaaccggttacgttacgggtacgttaccggttacgaccgtaccttaaccgg

SEQ ID NO: 19992 - DNA, 646 bp, Homo sapiens
  misc_feature: GYAE6OF02H892Y.25.86.H09.1.454.CMB.1.raw
  modified_base (485)..(485): a, c, t, g, unknown or other
  misc_feature (485)..(485): n is a, c, g, or t
  modified_base (613)..(613): a, c, t, g, unknown or other
  misc_feature (613)..(613): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctcgcctctgttcgagacatagtcaccatcacttgtcggctaggtcgggtcagttggcagtgtctttagctggtatcagcaagaaaccgagggaagctacctaagctcctgacttctttagatcgcctacctaggtttaggaaagtggacgtccaactcgtaaacggttcgaggcggacgtaggtggtactcgtaggggaacagtagtttcacttccctacaacctatccgaacgcacgtccgtacgacgtaacgccgttaaggaaacttactttccgtacgacctaaaacccgttttntttacgttaacgtacctaaaaacttaaggttttaaaccgtacctttaaccccttcctccgtttacggttaccgggacgggtaaccgggaacccgttaagggtacggagtaacctaaccggttaaaacncggttaggcggtacctacggacctaccgtaacg

SEQ ID NO: 19993 - DNA, 663 bp, Homo sapiens
  misc_feature: GYAE6OF02IL04V.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctccctgtctgcctctgttcgagacatagtcaccatcacgttggtcgggcttaggtcgggtctagttggcgagttcgtacgttttacgccgtggttatcgacgacgaaacggaaaaccgagggggaacgtccgtaccgtaacgccttccgttagtacttctttagcgttcgtccttacgtaggtttagggaagtcggtacgtccatacgtagttcgagcggacgtaggtgtacgtcggtaggacgtagtactttcacgttcctactaactactacgaacgcgacgccgtgccgacgtccgtaaggacgttacttcgacgtacctaaactttacttagttaacgtaacgtaaaacgttacgtttaaacgttacccttacccgtttacgttcccgttccgttaccggggacggaacgggtaacggtaacggtacgtaagtaacgtaaccgaacggttctacgggcgtacctaccgacgtaccgtcg

SEQ ID NO: 19994 - DNA, 805 bp, Homo sapiens
  misc_feature: GYAE6OF02JPJCL.25.86.H09.1.454.CMB.1.raw
tcagactgtacagtcacgaccggtgctcgatttagtgctatagacttgggtttgggggaggtcgagacccactcaggacacagcatggacatgagggtccccgctcagctcctggggcttcctgctgctctggctcccgaggtgccaaattgtgcccatccgagttcgacccagtcctccatccctcctgtctcgctctgttcgagacatagtcaccatcacgttgtcgggctaggtcggtcagttggcagttgcgtttagccttggtactcgtagaccaggaaacccgaggggaaacgtcctaaccgtaagccttccgtaggtatttcctttaggactccggtacccttccgttaaggtttacggggaaattacggggtacccttaccgtaacgtaccgtaaacgggttttccgaacgggtcggtaccgtaacgggtttcggaacgtttccggtagggggaacctaaggttacctttaccgtacttccccgttaccgtaaccctacgttaccgaaccgacgttaaccgccgttacggacgtaccgaccgttacgtaacggttacctttaccgaccgttaaccttaaccgttatttacgtttacaaccgttaaacttaacgttttaaaccgtaccgtttaccctttaccgttaccctttaccggttaacccgggtacgggtaaccgggttacccgtaaaggggttaccggaacggtttaaccgaaacccgttaaaccggtaaccggtttaggtacccgggtactacccggtaaccgttaccccggttaattcccggtttaaccgg

SEQ ID NO: 19995 - DNA, 632 bp, Homo sapiens
  misc_feature: GYAE6OF02HEZ2S.25.86.H09.1.454.CMB.1.raw
  modified_base (621)..(621): a, c, t, g, unknown or other
  misc_feature (621)..(621): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctccctgtctcgcctctgttcgagacatagtcaccatctacgttggtccgggcttaggtccgggtctagttggcagtgtctttacgccgttaggtactcgaagcgaacggaaaaccgagggggaacgtacctaccgtaacgccttcctagtacttcgtttagatcgtcctacgtagttaggaaagtcggtactcctagtacgtaacggttcacgcggacgaggtcggatcgtacgggacacgtactttcgtactcctacactatcgacgcacgctgacgtacgccgtagaatacgttcgtacgaccttaaccttatttacgttacttaactaaacgttaaagttaacgtacctttacccttactccgttaccgtcgggacggtacggtacggtaaggtacggtaacacgttaaaccgaaacgttacgttcggagtcggtacnccgtacttacg

SEQ ID NO: 19996 - DNA, 543 bp, Homo sapiens
  misc_feature: GYAE6OF02GDVVY.25.86.H09.1.454.CMB.1.raw
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccngggaanctcaagctcctgatcttgatgcctcagtttggaaagtggatccatcaaggttcagcgcagtggatcgtgggacagtatttcatcctcaccatcagcagcctgcacgcctagaagtacttctgacctaaccttatttattagttacaaacgttaatttaacggtactttacccgtcttccgttccgttcgggaccggtacgggaccgtaacgggtggaacggtaactaccgtaaacgacgttggtcggtctacggaccaccgtacg

SEQ ID NO: 19997 - DNA, 600 bp, Homo sapiens
  misc_feature: GYAE6OF02IP1M4.25.86.H09.1.454.CMB.1.raw
  modified_base (255)..(255): a, c, t, g, unknown or other
  misc_feature (255)..(255): n is a, c, g, or t
tcagactgtacagtcacgaccggtgctcgatttagtgctatagacttggggtttgggggggacacctggggacactgaactggtgctgagttactgagatgagccagccctgcagctgtgtccagcctgcccatcctctgctcatttgcatattcccagaacacacctcctgcctgagacttctagaggctggtcactacttctgcaggatcagacccatcaggacacagcagtcggactagtgacggtccccgntcgagcctcgtgggtcttcgtgtctgctcgtcgtcctcccgaggtcgacctaatcggtacaccgtataccgtagttccgacctacgtcctaccgactcctcctagtctcgtctcgttcgtacgactactactacgtccactatcctacgtcggtcggacttacggtcggtagtacgttggacgtcgttacgttacttcggtacgtacgtactccggtaacacgaaaccggaaccggtagggaacctccggtacttaccgtctccgtagtcgttaacgttgtacgttccgtaaccttcggtaacggtttgggaaacgttcgtaaccgtacctacgttacggtacgg

SEQ ID NO: 19998 - DNA, 718 bp, Homo sapiens
  misc_feature: GYAE6OF02ICIEN.25.86.H09.1.454.CMB.1.raw
  modified_base (702)..(702): a, c, t, g, unknown or other
  misc_feature (702)..(702): n is a, c, g, or t
tcagactgtacagtcacgaccggtgctcgatttagtgctatagacttggggtttgggggcgaggagtcagacccactcaggacacagcatggacatgagggtccccgctcagctcctggggcttctgctgctctggctcccaggtcgccaaatgtgccatccagttcgacccagtctccatcctccctgtctcgccttctgttcgagacatagtcaccatcacttggtcggctaggtcggtctagttggcagttcgtcgtttaacgtccgttacggtagttaccaaggtaccgaacggaaaaaccgacgggggtaaacggcccttaacccgtaacggaccgtttccgtaggtaactttcgtttcggtacgtaccgcccgttaccgttaggttaagggtaaggttacgtaccggtacctacgtaacgttaacggtacgtaggcgtaacggtaggtacggtacgtacggtacggtaacgtaggttactttcgtaacctccgtacctaaccgtactacgaacgcggacgtcccgtacggaccacgtaccgtaagaacgttactttccgaacttaactaacggtttactttcgtaagttactaaacgttaagtttaacggacctttacccgtctaaccggttcgtaccgggacggaaccgggtacgtagggagtacgaactaaccgaaagtcgttaggccggttanaccgtaccctataccg

SEQ ID NO: 19999 - DNA, 618 bp, Homo sapiens
  misc_feature: GYAE6OF02F46BL.25.86.H09.1.454.CMB.1.raw
  modified_base (557)..(557): a, c, t, g, unknown or other
  misc_feature (557)..(557): n is a, c, g, or t
  modified_base (563)..(564): a, c, t, g, unknown or other
  misc_feature (563)..(564): n is a, c, g, or t
  modified_base (578)..(579): a, c, t, g, unknown or other
  misc_feature (578)..(579): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
  modified_base (590)..(591): a, c, t, g, unknown or other
  misc_feature (590)..(591): n is a, c, g, or t
  modified_base (593)..(593): a, c, t, g, unknown or other
  misc_feature (593)..(593): n is a, c, g, or t
  modified_base (595)..(596): a, c, t, g, unknown or other
  misc_feature (595)..(596): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(604): a, c, t, g, unknown or other
  misc_feature (602)..(604): n is a, c, g, or t
  modified_base (606)..(607): a, c, t, g, unknown or other
  misc_feature (606)..(607): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
tcagactgtacagtcacgaccggtgctcgatttagtgctatagacttggggtttgggagaagaacctactatgcagactctgtgaagggtcgattcaccacctccagagacaacatcaagaactccctgtatctgcaaatggactagtctgacaccttgatgacaccgtccttgtattatgtgtgaaaggcggtgttgaggtgaatgccgtcggaaccccgcggtcacgcacgtacttctacagtggcgtcgtgggacgaaagggactacggtctatcgtctcctcacgccctccaaccgacggccctacgtccggtccttacccccgtggcccgcccgtcggccgtccgagggacgccgacccgtacggagtacgtaccgtacgaacggtccggtacccgtgggtccgttacggtcccgttacgggttaccgaaacgggtaccgtttaccgttaccccgtaaggttaccggtaaccgtacgttccggtaacgggtaccggacccggggtcgtaaccgggaacgtaaacggggtacccaacgtaaggtacgtattancgttannagtccaagctgacnngnngngnngtnntntnngnangnnngnngcngngngntn

SEQ ID NO: 20000 - DNA, 620 bp, Homo sapiens
  misc_feature: GYAE6OF02HAK6U.25.86.H09.1.454.CMB.1.raw
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggctagtgctttagcctggtatcagcaagaaaccaggggaagctacctaagctctgtattcttgatcgcctcgtagttggaagtggacgtcccatcgtaagttcgagcggcaggtgatcgagggacaggtattacactcctacacatcagtcagtcctgcagtcctagaactctttcgacgacctaaccgttatttacgttcgtaacctaaacgtttaagttttaaacggtacccttttaacccttaccgtttccgttaccccggtttacggggaccgggtaacggggtacccgttaaaggggtccgggaaagtaaccgtaaccgtaaaaaccggtcttacgggtacggtccctaggtacccaaccgttacttcgttaccgg

SEQ ID NO: 20001 - DNA, 844 bp, Homo sapiens
  misc_feature: GYAE6OF02HNE87.25.86.H09.1.454.CMB.1.raw
  modified_base (330)..(330): a, c, t, g, unknown or other
  misc_feature (330)..(330): n is a, c, g, or t
tcagactgtacagtcacgaccggtgctcgatttagtgctatagacttgggtttgggggcaggagtcagacccttactcaggacactaagcatggacatggagggtccccgctcagtctccgtgggcgttcgtgtctgctcgtcggggcctcccgaggtcgccaaatgtgaccactccaggttcaccccagttacctacctattcccgtccctgttccgtcgtcccgttccgtcgttcggactaccgaagttacggccaccgagttcgtacgttggtacgggtacttaggtcgggtactagttcggcgacgtgtcttttagccgttggtanactacgacgaacggaaaccggtaggggtaactaccgtaccgttaacgtccgtaccgtacgtacgtttacttttacgaacgttaccgtacccgttaccgttaggttttaacgggaaacgttcgggtaaccttaccgtaactaccggtaaacggtttccgaagggaccggtacgtacggtaacgggtaccgtcggtaacgggtaactaacggtttactttacgaccgttccgtaacgaaccgtacgtaccgaagtcgtacgtaccgttagtaccgtacgttccgttaaagttaccgtacgttacccgtaacgtaaccttaaaccgttttaagttaccgtttacgtaacttaaaaccgtttaacgggtttaaccgtaaaccgtttacccccgttagttacccgttacccgttcgggtacccgggttacggtaacccggtaacggttaaccgaaccgtaaccgtaacccgaacggttacggttcccgaaccggttccgaccgtacccgtaagttcccg

SEQ ID NO: 20002 - DNA, 750 bp, Homo sapiens
  misc_feature: GYAE6OF02GQ97J.25.86.H09.1.454.CMB.1.raw
  modified_base (311)..(311): a, c, t, g, unknown or other
  misc_feature (311)..(311): n is a, c, g, or t
tcagactgtacagtcacgaccggtgctcgatttagtgctatagacttgggtttgggggcaggagtcagacccactcaggacacagcatggacatgaggtcccgctcagctcctggggcttctgctgctctggctcccaggttgcctaaatgtgccaatccagtttcgacccagtcctccattccctcctggtctaggccttctgttcgagacactacggtcaccatcacgttgccgggtctacggtcgggtcagttcggcctagtcgtctttacgccttaggtactcacgctaacgaaccgtacggggacnctaccgtaacgcccttacgtggtacttcgtttagactcgaccttaccggttagtttacggaaacggttcgacgttacccctaagtaccgtaaacggttcctacggtccggtactacgggtacggtacgtacggtacggggtactaacggttacttttccgaacgtttaccccacttaacccaagtccgtaacgccgtaccgccgttacgacgtaccgtccttaacggaagtacctttacgcgtaacctaactttacgttaatttaccggaacgtaaaccttaaacgtttaccggttaacctttaacccttccgtttaccgttacccggtttaaccggggcccggttaaggggtacccggtaaaggggtcggtaaaccggtagtaaccccgtaaaccggttacgtacgggtcgttaccgtacgtaccggttacttaccgg

SEQ ID NO: 20003 - DNA, 432 bp, Homo sapiens
  misc_feature: GYAE6OF02HLJ26.25.86.H09.1.454.CMB.1.raw
  modified_base (423)..(432): a, c, t, g, unknown or other
  misc_feature (423)..(432): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatggcgtctggggcaaagggctacggtcatcgtctcctcagcctccaccaagggccccatccggtccttcccccgtggccgcccctgcctccgaggacgccacccgtccgagacgcacgagccggcctgggctcgcctggtcaagctactccactgtacagtctgagcggctggcaaggcgacatagnnnnnnnnnn

SEQ ID NO: 20004 - DNA, 624 bp, Homo sapiens
  misc_feature: GYAE6OF02FHKYR.25.86.H09.1.454.CMB.1.raw
  modified_base (281)..(281): a, c, t, g, unknown or other
  misc_feature (281)..(281): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgcggctagtcgggtcattggcagtgctttagcctggtatcagcaagaaaccgagggggaacnctacctaagctcctgattctttgatcgcctctaggtttaggaaagtggacgtcccatacgtaaggttcaggcggcaggtggatcgtgggacagtactttcactcctcaccatcagcacgcctgctacgcctaggaacgtacttctacgtacctaacctttaatttagttacgtaccgtaaacttaaacgttttaacggttaacctttaccccgttaccgtttacccgttcccgtttacggggaccgggtaacgggtaacccggtaagggttacgggaacggtaaccgtaaccgtaaaccgtaccggttacggtaccgggtacctacggtacctaccgttaccg

SEQ ID NO: 20005 - DNA, 448 bp, Homo sapiens
  misc_feature: GYAE6OF02GXBM0.25.86.H09.1.454.CMB.1.raw
  modified_base (434)..(448): a, c, t, g, unknown or other
  misc_feature (434)..(448): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggacaaagggactacggtcatcgtctcctcagcctccaccaaggcccatccggtccttcccccgtggccgccctgcctccgaggacgccacctccgagacgcacacgccggcctgggctcgccgtggtcggtactaccttccactcgtacagtctggacggcgggctgggcgaaggcgacagtagnnnnnnnnnnnnnnn

SEQ ID NO: 20006 - DNA, 835 bp, Homo sapiens
  misc_feature: GYAE6OF02JQN9Q.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtctccatcctccctgtctcgccttctgttcgagacatagtccaccatccacttggccggctagtcgggtcattggcagtgtctttaggcctggtatcagcgaagaaccgaggggaacgcctacgtaagccttaccgtgtacttctttagactcgtacccttacgtaaggtttagggaaacggttcgggtaccgttacccgtaagttaccgtaaacgggtttccgaacgggtccgggtaacgttaacggggttacgggtaacgttacccgggttacgggggaaaccgtaaggtttaaccgtttttacccgaacgttaccccttacccgtaaccctacgttaccgaacggtaccctaacggtcccgttccgaccggtaaccgtaccggttacggtaaacgtttacgtttacccgtaccggtaaacccttaaccgtttaaactttaccgtttaaccgtaaaccggtttaaactttaaacggtttttaaaccgttaaccctttaaccccgttaccgttaccgttaccccgggttttaaccggggacgggttaaccggggtaaaccggtaacggggttaaaccgggtaacggtaaccgttaaacggtaaacccggttaacggttaacgggtccggtaaaccggttccgaaacccggttcccttaaccgg

SEQ ID NO: 20007 - DNA, 572 bp, Homo sapiens
  misc_feature: GYAE6OF02FVQ28.25.86.H09.1.454.CMB.1.raw
  modified_base (285)..(285): a, c, t, g, unknown or other
  misc_feature (285)..(285): n is a, c, g, or t
  modified_base (402)..(402): a, c, t, g, unknown or other
  misc_feature (402)..(402): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtacattggcagtgtctttagcctggtatcagcaagaaaccgaggggaacnctacctaagctcctgtattctttgatcgcctctagttaggaagtgactcccatacgaaggtcagcggcagtgatcgtgggactagtactttcactcctacacctatcagcacgtccngccacgtccgtagaaacgttcttctacgacctaacctttattacttgtaactaaacgttaagtttaacgtacctttaccctcgttcttacccggttcgggacggtaacgggtacgtaacgggtggaactaagtaaccgaacgtagttggtaccgtacgactaccattacg

SEQ ID NO: 20008 - DNA, 597 bp, Homo sapiens
  misc_feature: GYAE6OF02GYP7C.25.86.H09.1.454.CMB.1.raw
  modified_base (344)..(344): a, c, t, g, unknown or other
  misc_feature (344)..(344): n is a, c, g, or t
tcagactgtacagtcacgaccggtgctcgatttagtgctatagacttggaggctcgtgggaaaggagccccagccctgagattcccaggtgattccattcggtgatcagcactgaacacagaactcaccatggagtttggactgagctgggttttccttgttgccattttaaaaggtgtccagtgtgaagtgcaactggtgagtctgggggagccgtggtacacggccgggggggtccctgacgactctccgtgtgtacgcctctggtattcgattgtttgattgattatgccaatgcactggggtccctcgaaggtccgggaagggtctagggagttgggctntcttagtcgtacttgggatggggagaagaacctatatgactagactctaggtgaagggtctattcgaccctaccgtcacgagaccaacatacaacgaacttcccgtagtactctgaacaatggactaggtactacggactaccagactagacctaccgtaccttgtactttagttgttaggttagtaacgggtcggttaggttgacggttagaagttcggtccccttacgggtaacccccgtcggtacaccgg

SEQ ID NO: 20009 - DNA, 998 bp, Homo sapiens
  misc_feature: GYAE6OF02G3USC.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgaccaaatgtcgaccatccagttcgacccagtcctccacttccctccctgtctcgtcccttcttgtcgaagacatacgtccacctatccgtacttcgggtccgggtctaggttccgggtctagttggcctaggttgtacctttacggccgttggttaactcgagaccgaaaggtaaaacccgggaagggggtaactacccgttaccgtaacggtcccgttaccgttacggtaacttttccggtttagtacgtccgttacccttaccggttaaggtttacgggaaaaggttcggtaccgttaccctaacgtacggtaaacgggttcgaacggtcggtacggtacgggtacgtacggttacggtaacggggtaacgtaacggtttaccgttttacccgtaacccgtttaccccgtaaccctaacccgttaaccgttaccggaaacggtacccggttaaccggtccccgttaacgggtacccgttaacccggttacccgggtaaagtaaaccggtttacctttttacccggaaccgtttaaacccttaaacccgtttttttaagttaaaccggttttaaccggtttaaaaacccgttaaaaccgtttttaaaaagggtttttaaaacccgtttaccccgtttttaacccccctttacgttttaccccccgggtttacccgggtttaaaccggggggtacccgggttaaaaaccgggggttaaccggttaacggggggtaaaaccggttaaccggtaaaaccccggtttaaaacgttaaaaaccccggggttaccggttttaacgggggtaccggtttacccccggtaaccggtaacccggttaaccttttaacccggg

SEQ ID NO: 20010 - DNA, 803 bp, Homo sapiens
  misc_feature: GYAE6OF02HT2N3.25.86.H09.1.454.CMB.1.raw
  modified_base (283)..(283): a, c, t, g, unknown or other
  misc_feature (283)..(283): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtccgggctagtcgggtcattggcagtgctttagccgtggtatcgagcagaaccgaggggaacncgtacctaagcctccgtgtattctttgatcggtccctaccgttaggtttacggaaacggttcggaacgttccctagtaccgtaaagggtttccaaggtcgggtacgtaggttaggtatcggtacgggtaacgtaggtactttccgtaacttcccgtacctacccaagttcccgacgaccgtacggaccccgtacgaaccgtacccgttaggtaaccgttactttaccggttaccgtaaccgtaaaccctttaatttacgtttaacgttaacctaaaccgtttaaaaccgttttaacgggttaacccttttaacccctttacccgtttacccggtttacccgggtttaacccggggtaccgggggtaaacccggggttaaccggtaaccgggggttaacgggtaaaccgggtttaaacggtaaacccccggttaaaaacgggtaaccccggttttaaccgggttacgggggttaccctttaacccgggggtccccgtaaacccggtttaatttaccccggg

SEQ ID NO: 20011 - DNA, 665 bp, Homo sapiens
  misc_feature: GYAE6OF02GX6GS.25.86.H09.1.454.CMB.1.raw
  modified_base (257)..(257): a, c, t, g, unknown or other
  misc_feature (257)..(257): n is a, c, g, or t
  modified_base (417)..(417): a, c, t, g, unknown or other
  misc_feature (417)..(417): n is a, c, g, or t
tcagactgtacagtcacgaccggtgctcgatttagtgctatagacttgggtttgggggggacacctggggacactgaactggtgctgagttactgagatgagccagccctgcagctgtgtccagcctgcccatcctctgctcatttgcatattccagaacacaacctcctgccctgaagtacttcttagtaggctggtacacacttctgcaggagtcagacccatcgaggacacagcaatggacatgacgggtcccnctcagtctccgtggggcttctagctgctctcgacctcccgaggtcacctaaatcgacgtccacttccgacgttacgaccctagtcctaccgacttccctacctcgttctcgtaccttcgttacgttaccgaagtacctaagttaacggtccaaacccgtnttaccgtaacgtttacgggtccgggtacttacgggttcggtacgtacgtttagggcctaaggttcgtaccgtttaacggtccttagggtaacttacgaacggaccgtaaacggaaaacccgggtaggggtaaacctaccgttaccgttaaacgccgttaccccgttaggtaactttacgtttcgaatttcgaccctttacgtaaggtttacggaacggttcgggtacctacccgtataccgtaacggg

SEQ ID NO: 20012 - DNA, 425 bp, Homo sapiens
  misc_feature: GYAE6OF02GPG05.25.86.H09.1.454.CMB.1.raw
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (399)..(399): a, c, t, g, unknown or other
  misc_feature (399)..(399): n is a, c, g, or t
  modified_base (405)..(425): a, c, t, g, unknown or other
  misc_feature (405)..(425): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaaaggggactacggtcatcgtctcctcagcctccaccaaggcccatcagtctccccngcnccctgctcaggancaccnccgagagcanagcgcctggctgcctggacaagactactccatgacagtctgagcgggctggacaaggcncatagnnnnnnnnnnnnnnnnnnnnn

SEQ ID NO: 20013 - DNA, 598 bp, Homo sapiens
  misc_feature: GYAE6OF02IPKD4.25.86.H09.1.454.CMB.1.raw
  modified_base (361)..(361): a, c, t, g, unknown or other
  misc_feature (361)..(361): n is a, c, g, or t
tcagactgtacagtcacgaccggtgctcgatttagtgctatagacttgggtttggggggggacacctggggacactgaactggtgctgagttactgagatgagccagccctgcagctgtgtccagcctgcccatcctctgctcatttgcatattcccagaacacaacctcctgccctgaagacttcttagtaggctggtcacacttcttgcaggagtcacgacccactcgaggacacagcagtggactatggacgggtcccccgctcagccgtccgtggggcttcgtgctgctcgtcgctcccgaggtcgacctaatgcgcctaatccgtagttacaccgtcgtcctacctctccctcctntctcgtctctgtcagctactacgtccaccatccgtacgttcggtacggtcttacggtcggttctaggttggctaggtcgttacgttcgtcgttagtactcgtaacgacgaacggtaaaccggtaagggaccttaccgtaccgtaacgtccgttactcgttacgtttcgttacgtctacggtacccttagttaacggttaagggtacggttacggaccgtaccgtagtaaccgtacgg

SEQ ID NO: 20014 - DNA, 508 bp, Homo sapiens
  misc_feature: GYAE6OF02H92JJ.25.86.H09.1.454.CMB.1.raw
  modified_base (141)..(141): a, c, t, g, unknown or other
  misc_feature (141)..(141): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
  modified_base (453)..(453): a, c, t, g, unknown or other
  misc_feature (453)..(453): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
tcagactgtacagtcacgaccggtgctcgatttagtgctatagacttgggtttgggggcaggagtcagacccactcaggacacagcatggacatgagggtccccgctcagctctggggcttctgctgctctgctccaggtnccaaatgtcgccatccagttgacccagtctccatcctccctgtctgcctcttgttcgaagacatagcaccattccagttgcggcttagtcgggtcattggcagtgactttagctggtncagnaagaaaccnggggaatctacctaagctcctgacttctttagnctcctctagtttcggaaagttcgagttccaatgaacgttnagcgcagtcgattcagggacngtatttcgattccanaccntacggnacngcctgctagctagacnttcagcaacttntaggttaccaataatttacggactttacccngtccttcctaggcgacggtctaagggnagattaacaacgtntcggntccnacatc

SEQ ID NO: 20015 - DNA, 474 bp, Homo sapiens
  misc_feature: GYAE6OF02H9QU3.25.86.H09.1.454.CMB.1.raw
  modified_base (219)..(219): a, c, t, g, unknown or other
  misc_feature (219)..(219): n is a, c, g, or t
  modified_base (413)..(413): a, c, t, g, unknown or other
  misc_feature (413)..(413): n is a, c, g, or t
  modified_base (455)..(474): a, c, t, g, unknown or other
  misc_feature (455)..(474): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgcctttgtattattgtgtgaaaggcggtgttgaggtgaatgcctggaacccccgngtcagcactacttctacatgggcgtcgtggggacaaagggctacggtcatcgtctcctcacgcctccaccgaagggccccagtccggttccttccccctgggccgcccctgcctccgaggacgccaccgtccgagacgcacacggccggccgtcgggctcgccgtggtacacggtcctaccttccacgtgtacngtctggacggcgggtcgtgggacaagggccgacaagtagcannnnnnnnnnnnnnnnnnnn

SEQ ID NO: 20016 - DNA, 594 bp, Homo sapiens
  misc_feature: GYAE6OF02I3CWN.25.86.H09.1.454.CMB.1.raw
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
tcagactgtacagtcacgaccggtgctcgatttagtgctatagacttgggtttgggggcaggagtcagacccactcaggacacagcatggacatgaggggtccccgctcagctcctgggggcttctgctgctctggctcccaggtgccaaatgtgccatccagttgacccagtctccatcctccctgtctgcctctgttcgagacatagtcaccatctacttgtcgggctaggtcgggtcattggcagtgtctttagcctggtatcagcacgaaacgagggganctactagctcctgtatcgttntatcgcctccgtagtttaggaagtggtacgtccctatacgaagttcaggcggacgaggtggtatcgtacgggactagtatttacacttcccgtaccaacctctaccgacgtacgacgtcccgtacgcgacgccgtaggaacttacgttcctacgacctaaccttattactacgttactaaacgttaagtttaacgtctttaacccttcttaccgtccgttccgggtacggtacggaccggtaagggtaggacgtaactacgaacgtaagtcggtagtactcgacacgtc

SEQ ID NO: 20017 - DNA, 622 bp, Homo sapiens
  misc_feature: GYAE6OF02JYBV9.25.86.H09.1.454.CMB.1.raw
  modified_base (492)..(492): a, c, t, g, unknown or other
  misc_feature (492)..(492): n is a, c, g, or t
  modified_base (560)..(560): a, c, t, g, unknown or other
  misc_feature (560)..(560): n is a, c, g, or t
tcagactgtacagtcacgaccggtgctcgatttagtgctatagacttgggtttgggggcaggagtcagacccactcaggacacagcatggacatgagggtccccgctcagcctcctggggcttctgctgctctggctcccgaggtcgccaaatgtgcccatcccagttcgacccagtcctccactccctcctgtctcgcatctgtcggagacagaatcgagcatctacgtcgccgggagtacgtcgagggactaagttagactaagtttattacgtcctaggttagtaccaaacgaacgtaaacgacgggtaagtacgttaccgtaagtcctcgtagtactacgttaagtctacgtcgtcctacccgtaacgtttaccacgtccggacggtcccctagttccgttcggtacacggcgtctaaggtcgtaatcggtacgggacgattacggtcaccgtcttagacctacgaacgcgttagaccgccttcgganaccgtcgtaaagagtcgttggactactatttacgacgtataacgaattacgttataccgccgtacctntaccggttgtaacggcgggtacgtagacggtacgagtacaccgttagaccgtggtcacgtta

SEQ ID NO: 20018 - DNA, 645 bp, Homo sapiens
  misc_feature: GYAE6OF02G5Y9S.25.86.H09.1.454.CMB.1.raw
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcagttggcagtgtctttagcctggtatcagcaagaaaccgaggggaagctacctaagctcctgtattctttgatcgtcctcctaggtttggaaagtggacgtccctagtcgtaaggttcaggcgcgagtaggatcgtagggacagtactttcactcctacacctatcgagcacgcctgcagtccgtagaagtactttcgtacgtaacctaaactttagtttaactttacgtaaccttaaaacgtttaaacgttttaaacggtaccttttaaccccgttcctttcccgtacccggtttacggggtaccggggtaaccgggtacccggtaaagggtacgggtaacgtaaccgttaacggaaaaccgttacggttaggtacgggtcctcggaaccctacgtacgttcccgttacgg

SEQ ID NO: 20019 - DNA, 423 bp, Homo sapiens
  misc_feature: GYAE6OF02FS7OK.25.86.H09.1.454.CMB.1.raw
  modified_base (311)..(311): a, c, t, g, unknown or other
  misc_feature (311)..(311): n is a, c, g, or t
  modified_base (414)..(423): a, c, t, g, unknown or other
  misc_feature (414)..(423): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaaggggactacggtcatcgtctcctcagcctccaccaagggcccatcggtcttccccnggcgccctgctccaggagcacctcgagagccacagcggccctgggctgcctggtcaaggctacttccactgtacagtctgagcgggctggcaaggcgcatagnnnnnnnnnn

SEQ ID NO: 20020 - DNA, 427 bp, Homo sapiens
  misc_feature: GYAE6OF02F6REG.25.86.H09.1.454.CMB.1.raw
  modified_base (415)..(415): a, c, t, g, unknown or other
  misc_feature (415)..(415): n is a, c, g, or t
  modified_base (420)..(427): a, c, t, g, unknown or other
  misc_feature (420)..(427): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaaccccgcggtcagcactacttctacatgggcgtcgtggggcaaaggggactacggtcatcgtctcctcagccctccaccaagggcccatcggtcttcccctggccgccctgctccaggcgcacctcgagacgcacaggccggaccgtgggctgcctggtacaaggctacttccactgacagtctgaggcggctggcaacggcganagagnnnnnnnn

SEQ ID NO: 20021 - DNA, 482 bp, Homo sapiens
  misc_feature: GYAE6OF02GNZAD.25.86.H09.1.454.CMB.1.raw
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
  modified_base (462)..(462): a, c, t, g, unknown or other
  misc_feature (462)..(462): n is a, c, g, or t
  modified_base (466)..(482): a, c, t, g, unknown or other
  misc_feature (466)..(482): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctcgggaacccccgcggtcagcacctacttctacagtgggcgtcgtgggggacaaaggggacttacggtcagttccgtcctcctcacgcccctccaccaacgggccccagtcggtcccttccccgnggcccnccctgcctccgaggcnccacctccggagacnccacgacggccggcccgtgggcctgcccgtggtacaacggacttacctccacgttcgaacgtgtccgnggagccgggntcgggacgacggcgacngagnnnnnnnnnnnnnnnnn

SEQ ID NO: 20022 - DNA, 747 bp, Homo sapiens
  misc_feature: GYAE6OF02G9M1W.25.86.H09.1.454.CMB.1.raw
  modified_base (299)..(299): a, c, t, g, unknown or other
  misc_feature (299)..(299): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggcctcccaggtgccaaatgtgccatcctagttcgacccagtctccatccctccctgtctcgccttctgttcgagacatagtcaccatctacttggtcggctaggtcggtctagttggcagtgtctttacgcgttggtatcgagtacaacggaaaccggaggggaanccttaccgtaacgtccgtaccgttagtacgtttacctttggtaacgttcgtacccttaccgtaaggttttaacggggtaaggtacggggacttaccccgacgttaccggtaagggtttacgacgggtaccggtacgaggtacggacgttcggtaacggggacctaaggtactttcctacgtcccttacgaaccgtacgtaccgtacgacgtaccgtccgtacggaccgaacgttcccgtaaggttaacgttacctttacgtacgtaaccgttaacctttaacgttacgttaccgtaactaaacgtttaaagttaaccgttaacgtttacccctcgtttacccgtcccggttacggaccgggtaacggggaaccgttaagggtacgaaccgtacgtaacggtaaaccggtagttaccggtacggtaaccgtccggtacctaccgttacg

SEQ ID NO: 20023 - DNA, 806 bp, Homo sapiens
  misc_feature: GYAE6OF02GS5UP.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctcctgtctgcctctgttcgagacatagtcaccatcacgttggtcgggctacggtcgggtctagttggactaggttcgtctttacggccttaggtactccgagcaaacggaaaccggaggggaactcctaccgtaacgtccttccgtagtactttcgtttagacgttcgtacccttacgttaagggttttaagggaaacggttcggggtaaccgttacccctaagttaccggtaaacggggtttccgaacgggtccgggtacgtagggttacggtaacgttccgggtaggggaactacggtttacctttacaccgtttcccgtacctaacccgtacttaccgaacgacctaccggttccgtacggtaccgacggttacccgttaagggaaacgtttctttaccggtaacgtacccgttttaaacctttaacgtttaacctttaaccggttaaacctaaaagtttttaaaccgttttaaaccgggttaacccttttaccccgttacctttaccccggttaccggttaccgggggtaaccgggtaacgggtaacccggtaaggggttaacgaaacggtacctaaaccggtaaacgtcgttaggtaccgtactacggtacctacttaccg

SEQ ID NO: 20024 - DNA, 697 bp, Homo sapiens
  misc_feature: GYAE6OF02GA5CL.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtctccatcctcctgtctgcctctgttcgagacatagtcaccatctacttgtcggctagtcgggtcattggctagtgtctttagccgtggtactcgagtcaacgtaaaccgaggggtaacgtccttaccgtaacgtcctaccttggtacttcgtttgtactcgtccttccgtagtttagggaaagtcggtacgtccctaatacgtaaggtttacgaggcggtactaggtcggtaacgttcggtaggacgtaagttactttcacgtacctacctacctactccgacgacctacgtcctacgacgaccgtaccgtagaacgttacgttcctacgtacctaaacgttaactttacgttaacgttacgttaaaacgtttaaacgtttaaacgggttaccctttaacccttaaccgttcccgttacccggttaccgggtaccgggtaaccggggtaccggtaaggggtacgtaaggtaactaaccgtaaaccggtacgttacggtacggtaccgtcggtacctaccgttacg

SEQ ID NO: 20025 - DNA, 544 bp, Homo sapiens
  misc_feature: GYAE6OF02JH2YO.25.86.H09.1.454.CMB.1.raw
  modified_base (218)..(218): a, c, t, g, unknown or other
  misc_feature (218)..(218): n is a, c, g, or t
  modified_base (325)..(325): a, c, t, g, unknown or other
  misc_feature (325)..(325): n is a, c, g, or t
  modified_base (421)..(421): a, c, t, g, unknown or other
  misc_feature (421)..(421): n is a, c, g, or t
  modified_base (473)..(473): a, c, t, g, unknown or other
  misc_feature (473)..(473): n is a, c, g, or t
  modified_base (486)..(487): a, c, t, g, unknown or other
  misc_feature (486)..(487): n is a, c, g, or t
  modified_base (489)..(489): a, c, t, g, unknown or other
  misc_feature (489)..(489): n is a, c, g, or t
  modified_base (491)..(492): a, c, t, g, unknown or other
  misc_feature (491)..(492): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
  modified_base (532)..(532): a, c, t, g, unknown or other
  misc_feature (532)..(532): n is a, c, g, or t
  modified_base (539)..(540): a, c, t, g, unknown or other
  misc_feature (539)..(540): n is a, c, g, or t
  modified_base (544)..(544): a, c, t, g, unknown or other
  misc_feature (544)..(544): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcacgcactacttcacatgggctcgtggggacaaaggggcctacggtccagtccgtctcctcacgccctaccaccaacgggcccctagtccggtccttcccccgngggcccgccctggcctccgaggacgcccaccgtccgagacgcacgagccggccctgggcctgcccgtggtacaaggccttactccacgttcgtacncggtcctggacgcgggtcctgggaccgtaagggccgtacgaagttacgacgnacgtgtccagtcnngngnngcgngcngcgngcncgcgactgacgcncncgngacagtcngcgacgnngatn

SEQ ID NO: 20026 - DNA, 724 bp, Homo sapiens
  misc_feature: GYAE6OF02IQJNG.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtcctccactcctccctgtcctgcctctgttcgagacatagtccacctatcctacttggtccgggacttacggtcggtactagttcggcgtaggttgtcttttacggcccttgggtactccgagaccaacggaaaccggtaagggggaacgtcctaccgtaacggtccttccgtagtactttcgtttaggactcgtcccttacggttacggtttagggaaacgtcggtacgtccctagttacgtaacggttcacgggtccggacgtaggtacggtacgtacggtgggaactacgttacctttacgtaccgttaccctacaaccctatccgacggtcacggtaccctggacctaccggacttaacggaatttaccgttcgacgttaacctaacctttagttacttacgttaaaccaaagtttaacgttaaccgtacctttaccctctttacccgttcgggttaacggaccgggtaacggtaaccggaagggttaccggaattaaccgaaccggttaaacgtacggttggtccgtacgacgtaccctacggttacc

SEQ ID NO: 20027 - DNA, 588 bp, Homo sapiens
  misc_feature: GYAE6OF02FVDEX.25.86.H09.1.454.CMB.1.raw
  modified_base (281)..(281): a, c, t, g, unknown or other
  misc_feature (281)..(281): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcagaaaccgaggggaanctacctaagctcctgactctttgatcgcctccgtagtttaggaaagtggacgtcccatcgaaggttcaggcggcaggtggatcgtgggacagtactttcactcctacacctatcagccgacgccgtcgaccgacgccgtagacgtactttccgtacgtacctaaccttaatttacgttcgtaactaaacttaagtttaacggtacctttaccctccttccgttcccgttcgggacgggtacggtaccggtaagggtacggagtacgtaaccgtaaacgtacgtggtacggtctcgacctaccgtacg

SEQ ID NO: 20028 - DNA, 725 bp, Homo sapiens
  misc_feature: GYAE6OF02G91DJ.25.86.H09.1.454.CMB.1.raw
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtcctccatcctccctgtctgcctctgttcgagacatagtcaccatctacgttgtcgggctacgtcgggtcagttggcagtgctttagccttggtatcagcaacggaaaccgaggggaacgtctacctaagctccgtggtacttctttagactcgcccttcgtaagtttacggtaaagtcggacgttacccaagtcgtaaacggttcgacggtcggacgacggtggagtccggtagggaactacgttaactttctaaccgtttccctacaaccctagttccaaagtccgtaacgtccttacgaccgaacggttaccctagggttaactaacgtttaccgtacgtaacccttaacgttaactttttaacttcgtaaactaaacgtttaaacgtttaaacgtacctttaacccgttccttaccgtttcccgttaacggggtccggaaccgggaccgttaaaggggtaccggtaaacgttaaccggtaaagtaaaacccggtaacggttttcggtaacgggtcccgttaacggtacccctacgggttacttcccggttaacc

SEQ ID NO: 20029 - DNA, 658 bp, Homo sapiens
  misc_feature: GYAE6OF02JYPZ0.25.86.H09.1.454.CMB.1.raw
  modified_base (165)..(165): a, c, t, g, unknown or other
  misc_feature (165)..(165): n is a, c, g, or t
  modified_base (496)..(496): a, c, t, g, unknown or other
  misc_feature (496)..(496): n is a, c, g, or t
  modified_base (587)..(587): a, c, t, g, unknown or other
  misc_feature (587)..(587): n is a, c, g, or t
  modified_base (622)..(622): a, c, t, g, unknown or other
  misc_feature (622)..(622): n is a, c, g, or t
  modified_base (627)..(627): a, c, t, g, unknown or other
  misc_feature (627)..(627): n is a, c, g, or t
  modified_base (631)..(634): a, c, t, g, unknown or other
  misc_feature (631)..(634): n is a, c, g, or t
  modified_base (636)..(648): a, c, t, g, unknown or other
  misc_feature (636)..(648): n is a, c, g, or t
  modified_base (650)..(658): a, c, t, g, unknown or other
  misc_feature (650)..(658): n is a, c, g, or t
tcagactgtacagtcacgaccggtgctcgatttagtgctatagacttgggtttgggagaagaacctactatgcagactctgtgaagggtcgattcaccacctccagagacaacatcaacgaactccctgtactctgacaaatggacagtctacgaccacctaganacgaccgcccgttcgttacgtttaattgttaggtggtaacggtaacggggttacggttgggttaggtaaggtacgtaacggtacccggtacccgggtaacccccggacccgggtacggtttacccactacccttaaaccgtacctttaccgggacgttacggtcgggggtcccttaagggggccgtaacggtaaggtactaccggtactacgtcgtctcctcaccgtacgccccaacggacccggtaccttcccggtccggtcccgttccccgcggcctaccgcggtcctccggaacggtccgaaccctcggtccgacgacgccgtaaccngggtcccctcggcccgttggaccctagggtccctaaccgtacggtaacctttcccgaaccgcgttacgtagtaccgtcggacgtacccggngggacctcgggaactaacgggcaaacgtgtagcanacgtnccgnnnncnnnnnnnnnnnnngnnnnnnnnn

SEQ ID NO: 20030 - DNA, 426 bp, Homo sapiens
  misc_feature: GYAE6OF02FS6XK.25.86.H09.1.454.CMB.1.raw
  modified_base (414)..(426): a, c, t, g, unknown or other
  misc_feature (414)..(426): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggccccatcggtcttccccctggcgccctgcctccaggagcaccctcgagagcacagcggccctgggctgcctggtcaaggactacttccactgtacagtctgagcgggctggcaggcgcatgnnnnnnnnnnnnn

SEQ ID NO: 20031 - DNA, 772 bp, Homo sapiens
  misc_feature: GYAE6OF02HANOO.25.86.H09.1.454.CMB.1.raw
tcagactgtacagtcacgaccggtgctcgatttagtgctatagacttgggtttggggggagccagacccactcaggacacagcatggacatgagggtccccgctcagctcctggggcttctgctgctctggcctcccaggtcgccaaatgtgccatccagttcgacccagtctccatccctccctgtctgccttgtgttcgagacatacgtcaccattacctacgttcggtcggacttacggtcgggtcagttcggctagtcgtctttagccgttggtactcagtacgaacggtaaccggaggggaactccttaccgtaacggtccttaccgtgttaacttcgtttagacgtcgtacccgttaccgttaaggttagggaaacggttcgggtaccttacccgaacgttacggtaaacggttccggaacggtccggtacgtaggtacggtagttccgggtaagggtaccttaagtaccgtttactaccgtacccgtactaaccgtactacgacgtacacggccttacgacgtacgtaccggttagtaaaccgttcgttacctacgtacttaaccgtttattagtttaacgtaaccgttaaacttaacggtttaaccgtttaaccgtttacccgttctttaacccgggttacccggttacgggggtaacccggggtaacgtaccgggtaaggttaccggaagtaccggtaaaccgtaaaccgtacggtttacggaccggtacgtaccgaacccgtccgtacggttacccttacgg

SEQ ID NO: 20032 - DNA, 552 bp, Homo sapiens
  misc_feature: GYAE6OF02FX68D.25.86.H09.1.454.CMB.1.raw
  modified_base (194)..(194): a, c, t, g, unknown or other
  misc_feature (194)..(194): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtcctccatcctccctgtctgcctntgttcgagacatagtcaccatcacgttgtcgtgcttaggtcgggtcagttggcagtgctttagcctggtatcagcagaaccgagggaatctcctaagctctgatctttgatgcctctagttacggaaagtcggacgtccatacgagttcagcgctaggtgtatcgagggactagtntttacgatccctacaacntacagcacgtcctgacagcctagaagtnttccgngtacctaacttagttatgtaactaacttaagtttaacgtaccttaccttctaccgtttaccgtcgggacgtaacggtacggtaacggtgaacgttacacgtaaacgtcgtcggtacgctacgaccgtacg

SEQ ID NO: 20033 - DNA, 766 bp, Homo sapiens
  misc_feature: GYAE6OF02H55Q1.25.86.H09.1.454.CMB.1.raw
  modified_base (134)..(134): a, c, t, g, unknown or other
  misc_feature (134)..(134): n is a, c, g, or t
  modified_base (410)..(410): a, c, t, g, unknown or other
  misc_feature (410)..(410): n is a, c, g, or t
  modified_base (625)..(625): a, c, t, g, unknown or other
  misc_feature (625)..(625): n is a, c, g, or t
tcagactgtacagtcacgaccggtgctcgatttagtgctatagacttgggtttgggggcaggagtcagacccactcaggacacagcatggacatgacgggtccccgctcagctccgtggggcttctgctgctcnggctcccaggtgccaaatgtgcccatccgagttcgacccagtcctccacttccctcctgtctcgcctctgttcgagacatagtcacctatcacgttcggtcgggacttaggtccgggtactagttcggctagtcgtctttacgcgtggtactcgagcgaacgaaaccggaggggaacctcgtacccgtaagcttaccgtgtacgttcgttttagcgttccgtccgtaccgttaggtttaggaaacggtggtaccgtcctagtacgtaacgttacgnggaccggtagtaggtcgggtactacggttaacgggacgttagtaaccttttacgaccctttcccgtaaccctaccgtagtacccgacgtaccgaccgttcccgtggaccgtaaggtacccgttagtaaagttaccttcggaaccgtaccttaaacgtttagtttacgtaacgtaaccgtaaagtttaaacggtttaacgtaccccgttttaaccncgtttaacccggtttccgtaccggggaaccggttacccggggtaaacggtaacggggttggaaaccgtttaacccgtaaacgtaaaccggttccgggttaccggtaaaccgggttcccgaccgttaccggaccgtttaacg

SEQ ID NO: 20034 - DNA, 742 bp, Homo sapiens
  misc_feature: GYAE6OF02FUBJS.25.86.H09.1.454.CMB.1.raw
  modified_base (283)..(283): a, c, t, g, unknown or other
  misc_feature (283)..(283): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgtcgagacatagtcaccatcacttgcgggctagtcgggtcagttggcagtgctttagccttggtatcgagacaaggaaaccagggggaancctaccgtaagcctccgtgattctttgactcgtccctcgtaggtttacggaaaggttcggacgtcccctaagtacgtaacggttcgagggtccggtacgaggttcgggaacgttccggtacgggggacctaacggtttacttttaccgaaccgttccctaacctaaccgaacttccgtaagccgtaacggtcccttacgggccctaaggtacccgttaggaaaccgttactttacccgtagtaaacccgtttaaccgttacttttaaacgttcggttaaaacctaagtttaaaaccgttttaaccgggttaaccctttaaccccgttaccgttcccgtttaccccggtttaccggggtaccgggtaaacgggtacccgggtaaaggggtcggaaacgttaaacttaaccgtaaacgtaccggtttagggtcccggacctcggtaccccgtagttaaccg

SEQ ID NO: 20035 - DNA, 577 bp, Homo sapiens
  misc_feature: GYAE6OF02IE3BO.25.86.H09.1.454.CMB.1.raw
  modified_base (219)..(219): a, c, t, g, unknown or other
  misc_feature (219)..(219): n is a, c, g, or t
  modified_base (545)..(577): a, c, t, g, unknown or other
  misc_feature (545)..(577): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctcggaacccccgnggtcagctactacttctacagtgggcgtgtggggacgaaagggactacggtcagtcgtctcctcacgtccctaccgaaccgaacgggcccctaagttcccgggttccctttccccccgtgggcccgcccccttggacctccgaagggaccgcctaacccgtcggaagcgaccaacgtacggccccggtccgtgggccttcggtcccgtagggtaccgaaacgggtaacccttaacccgtttcccgaacgttcgtaaccgtaacggtttccgtggggaacggccggggttaccgtagggaccgaaacgggtcgaactaggttaagcnnnnnnnnnnnnnnnnnnnnnnnnnnnnnnnnn

SEQ ID NO: 20036 - DNA, 651 bp, Homo sapiens
  misc_feature: GYAE6OF02GIRU9.25.86.H09.1.454.CMB.1.raw
  modified_base (298)..(298): a, c, t, g, unknown or other
  misc_feature (298)..(298): n is a, c, g, or t
tcagactgtacagtcacgaccggtgctcgatttagtgctatagacttgggtttgggtgcaggagtcagacccactcaggacacagcatggacatgagggtccccgctcagctcctggggcttctgctgctctggctcccaggtgaccaaatgtgccatccagttcgacccagtcctccatccctcctgtctcgcctctggttcgagtacagtactcaccatcacgttgtcgggcctaggtcggtcagttcggcaggtgtcgtttagccttggtatcagcaacgaaaccgaggggaacncgtaccaagtcctaccgtgtactccgtttgactcgtaccctccgtaggtttaggaaaggtggaaccgttccctaagtaccgtaacggtcacggtccgacgaggtgtaacttccggtagggaccgttaagtaccgtttacaccttaccgttacccaagtactccgtaacaccgtaaccgcgtcgacgacgcccgttaagaacgttccttacgtccgtacttaaaccttagttaacgttccgtaaactaaacgttaacttaacggttacttacctaccgttcgtaccgttacgggaccggaacggtaacgaaggtcggaactacgaagtaacgacgtgtaggccgtagacctacg

SEQ ID NO: 20037 - DNA, 864 bp, Homo sapiens
  misc_feature: GYAE6OF02I7PIX.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgaccaaatgtgccatccagttgacccagtctccatcctcctgtctgcctctgtcgagactatgtccacctatcctacgttggtccgggcttaggtccgggtactagttggcctaggtcgtactttacgccgttggtactcgagacgaacgaaaccggagggaactcctaccgtaagcctccgtagtcttcttgactcgccttcgtaggtttaaggaagtggtacctccgtatacgtaaggttcacggtccggtagaggtaggaacgtcggtacggtacgtagttactttacgactaccgtactaaccgtattaaccgaggtacccgtacgtaccgttaccggtaccgaaccggtaccggttaacggtaaacgttaccgtttaccgtacggttaaaccccttaaaccggtttaaacgttttaaccgtttaaccgttaaacccgttaaaaacgtttaaaccgtttttaaacgggttaaacccctttttaaccccggttacccgttttacccgggtttaaccccgggttttacccgggggaaccgggggtttaaacccggggttaaacccggggttaaacgggggtttaaaccggggtaaaccggtttaaaacccggtttaaaccccggtaaaaacccgggtttaaaacccgggtttccgggtttaaaccggggtaccccggtttaacccgggttaacccgttaacccccggtttttaacccgg

SEQ ID NO: 20038 - DNA, 685 bp, Homo sapiens
  misc_feature: GYAE6OF02GE2ER.25.86.H09.1.454.CMB.1.raw
  modified_base (294)..(294): a, c, t, g, unknown or other
  misc_feature (294)..(294): n is a, c, g, or t
tcagactgtacagtcacgaccggtgctcgatttagtgctatagacttgggtttgggggggaggtcagacccactcaggacacagcatggacatgagggtccccgctcagctcctggggcttctgctgctctggctcccaggtgccaaatgtgccatccagttgacccagtctccatcctccctgtctgcctctgttacagacatagcaccatcgattgcggggctaggtcgggtcatttgggctaggttcgtctttaagccgttggtaactaagcaacgaaaccgaggggaacncctacctaagctcctgtactttgtttgactcgtcccgtacttagggtttaagggtaaaagtcgggtaacgttaccctacgttacgaaaggtttcgaacgggccggtacgagggttaggtacgtcgtcgggaactagtgttttaccattccctacacgtacacgtacgcaacgtaccgtcgacctacggacctagttaaagtctttactacgaccttaaacctttaagtttactttacgtaacttaaaccttaagtttaaaccggtacctttaacccgttccttccgtttaccggtacgggtcgggtaacgaccgggtagtacggtaacgtcgaaaccgtaaacgtacggttgtacgggcgtacgtaaccgtctaacggtttcacgtttacc

SEQ ID NO: 20039 - DNA, 540 bp, Homo sapiens
  misc_feature: GYAE6OF02GVGFQ.25.86.H09.1.454.CMB.1.raw
  modified_base (187)..(187): a, c, t, g, unknown or other
  misc_feature (187)..(187): n is a, c, g, or t
  modified_base (236)..(236): a, c, t, g, unknown or other
  misc_feature (236)..(236): n is a, c, g, or t
  modified_base (342)..(342): a, c, t, g, unknown or other
  misc_feature (342)..(342): n is a, c, g, or t
  modified_base (511)..(540): a, c, t, g, unknown or other
  misc_feature (511)..(540): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaagtggacagtctgacacctgatgacaccgccttgtattattgtgtgaaaggnggtgttggaggtgaatgcctcggaccccgcggtcagcactacttctacntgggcgtcgtggggacgaaagggactacggctatccggtcctcctctacgtcccctaccgaccgaacgggtccccaagttccgggttcccttcccccgtcggcccnccctcgcctccgaggaccgcctaccgtccgacgacgccacgacggcccgggccgtcggggtcctcggtcccgtcggacaacgggtaccttaaccgttccacgttacgtaccgtacgttacgcggtcgggccgggccgttagggaccggaacggtcgaccgtagtacgannnnnnnnnnnnnnnnnnnnnnnnnnnnnn

SEQ ID NO: 20040 - DNA, 698 bp, Homo sapiens
  misc_feature: GYAE6OF02IDMQD.25.86.H09.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (278)..(278): a, c, t, g, unknown or other
  misc_feature (278)..(278): n is a, c, g, or t
  modified_base (320)..(320): a, c, t, g, unknown or other
  misc_feature (320)..(320): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtcgccaaatggtnccatccagttgacccagtctccatcctcctgtctgcctctgttacganacgattagtcacctatcctacttggtcgggacttggtacgggtctagttcgggctaggtcgtactttacgccgtggtntaccgagaccaacggtaaaccgaggggtaactctaccgtaanccctccgttagtacttacttagactccggtaccttccgtaaggtttaggaaacgttcggaacgtcccgtaatacggtaaaggttccgaggtacggacgtaggtcggtaagtccggtagggaactagtacctttacgacctccgtacgacctacgtccacgacgtacgtcctacggctaaacggtccgtaagaacggttacctttacgacgttaaccgtactttaattacgttacgtaacgtaaacgttaacgtttaccgtaaccttaccgttcctttacccgtcggtacgggacgggaacgtaccgttagggtacgcttaacgaaccgtaaacgtcggtacggtacggtcgaccgtaccgtacgttacgtgtttaccg

SEQ ID NO: 20041 - DNA, 429 bp, Homo sapiens
  misc_feature: GYAE6OF02FH2RL.25.86.H09.1.454.CMB.1.raw
  modified_base (339)..(339): a, c, t, g, unknown or other
  misc_feature (339)..(339): n is a, c, g, or t
  modified_base (420)..(429): a, c, t, g, unknown or other
  misc_feature (420)..(429): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggacccccgcggtcagcactacttctacatgggcgtctggggcaaagggactacggtcatcgtctcctcagcctccaccaagggcccatcggtcttccccctggcgccctgctccaggagcacctccgagancacagcggccctggcctgccctgggtcaaggacctacttccacgtgtacagtctgagcgggctgggcaagggcgtcatagnnnnnnnnnn

SEQ ID NO: 20042 - DNA, 556 bp, Homo sapiens
  misc_feature: GYAE6OF02GTOQL.25.86.H09.1.454.CMB.1.raw
  modified_base (323)..(323): a, c, t, g, unknown or other
  misc_feature (323)..(323): n is a, c, g, or t
  modified_base (351)..(351): a, c, t, g, unknown or other
  misc_feature (351)..(351): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (524)..(556): a, c, t, g, unknown or other
  misc_feature (524)..(556): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctcggaacccccgcggtcagccactacttctacagtgggcgtcgtggggacaaaggactacggtcatcgtctcctcacgccctccaccgaacgggcccacgtccggtcccttcccccgnggcccgccccgtcgcctaccacgggacnccctaccctcccggagacgccaccgacgcccgggtcccgtggggcctcggtcccgtcgggtaacaacgggtaccttacccttacctaccgttagtttaccgtacgttggaccggggtccggggtaccgttacgggacccggtaacgggcgtaccaaggtacgngagcncatgnnnnnnnnnnnnnnnnnnnnnnnnnnnnnnnnn

SEQ ID NO: 20043 - DNA, 745 bp, Homo sapiens
  misc_feature: GYAE6OF02J2G0V.25.86.H09.1.454.CMB.1.raw
  modified_base (305)..(305): a, c, t, g, unknown or other
  misc_feature (305)..(305): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttccgagacatacgtcaccatcacttggccgggcttacggtcggggtcagtttcgggcctagtcgtcgtttagccgttggtactcagtcgaacgaaaccgaaggggaacnccgttaccgtaagttacctggtattaccgtttgtactgtacccgttaccgtaaggttttagggaaaacggtttcgggaaccggtccccttaaagtaccgtaaacggggtttccgaagggtcccggtagtaaggttcgggtaactttcggtacggggtaactacgttagttttaccagtttacccgtactaacctagtttaacggctaacggtccgtacgtacccgtaggtaccctaggtaaaacgttgtttaccggtacctaccgtaaacccttagttaactttacgtaaacctaacgttaaaacgttttaacggaactttcccgtacttccgtttacccgggtagtaccgggtagggaccttagggtaccgtaagtaaccgtacgtaaacccggttagtacggtacggttcctaggtacctacgttaacgtcggtttac

SEQ ID NO: 20044 - DNA, 751 bp, Homo sapiens
  misc_feature: GYAE6OF02J0PU7.25.86.H09.1.454.CMB.1.raw
  modified_base (207)..(207): a, c, t, g, unknown or other
  misc_feature (207)..(207): n is a, c, g, or t
  modified_base (348)..(348): a, c, t, g, unknown or other
  misc_feature (348)..(348): n is a, c, g, or t
tcagactgtacagtcacgaccggtgctcgatttagtgctatagacttgggtttgggggcaggagtcagaccccactcaggacacagcatggacatgagggtccccgctcagctcctggggcttctgctgctcgtggctcccaggtcgccaaagtgtgcccatccgtagttcgacccagtctccatccctcccgtgtctcgtcccttntggttaccgagtaaccagttacggtacctaacctattcgtaacctttgggtcgggtacctaacggttcgggtactagtttcggactggtgtacgtttacggccttggtaactcgagtacgaacggaaccggaggggtaacncctaccgtaagccttacgtgtacgttcgttagcgtacgtcctcgtaggttaggtaaggtcggtaccgtaccgtactacgtaacggtaccgagtcggtacgtacggtaggtacggtacgtacggggtactaagttacgtttaccacgttacctacggaccctatccgacgtaccactcccggtagaccgtagtaccgttagtaacgttcgttacgacccgttaacgtacttaaacgttccgttaacgtaacttaaaccgttaaccggtttaacgttaaccccttcccgtttacccgttagttaaccccggtcgggtacggggtaacggtaacggtaacggtacggtaacgtacggttaacgaaccggtacgttacgggtacgtccgtaaccgtcctagttaccg

SEQ ID NO: 20045 - DNA, 461 bp, Homo sapiens
  misc_feature: GYAE6OF02I65EY.25.86.H09.1.454.CMB.1.raw
  modified_base (217)..(217): a, c, t, g, unknown or other
  misc_feature (217)..(217): n is a, c, g, or t
  modified_base (280)..(280): a, c, t, g, unknown or other
  misc_feature (280)..(280): n is a, c, g, or t
  modified_base (320)..(320): a, c, t, g, unknown or other
  misc_feature (320)..(320): n is a, c, g, or t
  modified_base (326)..(326): a, c, t, g, unknown or other
  misc_feature (326)..(326): n is a, c, g, or t
  modified_base (398)..(398): a, c, t, g, unknown or other
  misc_feature (398)..(398): n is a, c, g, or t
  modified_base (417)..(417): a, c, t, g, unknown or other
  misc_feature (417)..(417): n is a, c, g, or t
  modified_base (442)..(461): a, c, t, g, unknown or other
  misc_feature (442)..(461): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggttgtgaggtgaatgcctggacccccgnggtcagcactacttcacagtgggctcgtggggacaaacggggactacggtcatcgtctccctnacgccctcaaccaagggcccatcggtcctccccgtggccncccgtncctccgaggtacgcacctcgagtacgcacgagccggcctgggactcgcctgtccaaaggtcctaccttaccnctagactagtcgttgacgnggcgtgacgtaagcggcagtacgcnnnnnnnnnnnnnnnnnnnn

SEQ ID NO: 20046 - DNA, 882 bp, Homo sapiens
  misc_feature: GYAE6OF02IAGUG.25.86.H09.1.454.CMB.1.raw
  modified_base (156)..(156): a, c, t, g, unknown or other
  misc_feature (156)..(156): n is a, c, g, or t
  modified_base (168)..(168): a, c, t, g, unknown or other
  misc_feature (168)..(168): n is a, c, g, or t
  modified_base (840)..(840): a, c, t, g, unknown or other
  misc_feature (840)..(840): n is a, c, g, or t
tcagactgtacagtcacgaccggtgctcgatttagtgctatagacttggggtttggggggcagggagtcagaccccactcagggacacagcatggacatggagggtcccccgctccagcctccgtggggcttctgctgctcgtggcctccgaggtnaccaaatgtacnccatccctagttcgaccctagtcctaccatccctcctgtcctcgtcctcgtggttaccgagtaacctattacgtacccaccgtacttctaaccgttcgggttaccggggacctttaggggttcccggggtataacggtttcgggaccgtaggttaccgttaccgttttacggccgttagggttaactccgtaacggacgaaaacgggtaaaccccggaaggggggtaacctaccgttaaccccgttaaaggtccctttacccggttaggtaacttttccgttttacggtaacttccggttaccccgtttaaccgggttaagggtttttaacgggaaacggggttaccggtaacccggttaaccccgttaacggttaaccggggttaaacgggttcccggaacggggttacccggggtaaacgtaggggttaacgggtacgtttaccggtaacgggggtaaccgtagggttaaccttacccgtaactttcccgtaaccgttaacttaacgttaccggaacgtcccgtaaacggtcccgtaacggtaccgtacggtacccttaagggtaaatcggttaacgtacgtaacttaaagtttccttaacgtaagtaataaacgtacttaactactcccgtactcgttacgtacgtcgggaacggtacgaggtaacggngtacgtaaccgtagtacgtacgtgtacgtacgaccgacgtac

SEQ ID NO: 20047 - DNA, 665 bp, Homo sapiens
  misc_feature: GYAE6OF02ICP17.25.86.H09.1.454.CMB.1.raw
  modified_base (238)..(238): a, c, t, g, unknown or other
  misc_feature (238)..(238): n is a, c, g, or t
  modified_base (286)..(286): a, c, t, g, unknown or other
  misc_feature (286)..(286): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtcctccatccctccctgtctcgcctctgttcgagacatagtcaccatcacttgtcggctagtcgggtnattggcagtgtctttagcctggtatcagcaagaaaccgtaggggaacnctacctaacgcttccgtagtattctttagatcggtcctaccgtaggttttacgggaaaggtggtactacccaatcgtaaacgggttcaaggtcggacgtaaggtcggactacgtacgggaactagtattttccacgttaccctacacctatcaagcacgtctggctacgtaccgtagtaacgtacgtttcctacgtaacctaaaccgtttaatttacgttacgttaaaccgtaaaacgtttaaacgtttaaacggttaaccttacccgttcttacccgtttacccgttacgggacgggtaaccgggtaaccgtaagggtaacggaacgtaacgttaaccgaaacgtacgtacgtacggtactacggaccctacgtaacg

SEQ ID NO: 20048 - DNA, 527 bp, Homo sapiens
  misc_feature: GYAE6OF02J1RQP.25.86.H09.1.454.CMB.1.raw
  modified_base (179)..(179): a, c, t, g, unknown or other
  misc_feature (179)..(179): n is a, c, g, or t
  modified_base (296)..(296): a, c, t, g, unknown or other
  misc_feature (296)..(296): n is a, c, g, or t
  modified_base (389)..(389): a, c, t, g, unknown or other
  misc_feature (389)..(389): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
  modified_base (502)..(513): a, c, t, g, unknown or other
  misc_feature (502)..(513): n is a, c, g, or t
  modified_base (515)..(527): a, c, t, g, unknown or other
  misc_feature (515)..(527): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgngtgaaaggcggtgttgaggtgaatcgccgtcgggaacccccgcggtcacgctacctacttactacagtcgggcgtcgtgggggacaaaaggggtctacggtcagttcgtctccgtcncggtccctccgaacccgaagggcccacgtccgggtcccttcccccgtggccctcccgtcgcctccgaaggcgccacccgtcgagcgacaccgnggccgcccgtggctacgccgtggacaacggtacctacttccgactgtacctgtacgtgacggtcgggctggacctaggccacgtacgtagctancgangtnacngctgangcnnnnnnnnnnnncnnnnnnnnnnnnn

SEQ ID NO: 20049 - DNA, 724 bp, Homo sapiens
  misc_feature: GYAE6OF02HSNFS.25.86.H09.1.454.CMB.1.raw
  modified_base (255)..(255): a, c, t, g, unknown or other
  misc_feature (255)..(255): n is a, c, g, or t
  modified_base (317)..(317): a, c, t, g, unknown or other
  misc_feature (317)..(317): n is a, c, g, or t
  modified_base (514)..(514): a, c, t, g, unknown or other
  misc_feature (514)..(514): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgaccaaatgtcgccatccagttcgacccagtctccatccctccctgtctcgccttctcgttcgacgactatacgtaccacatcctaacgtttggtcggcttacggtccggtntagttggctagtcgtcgtttacgcccgttggtactcgaagcaacggaaacccgtaggggacnccgttaccaggtccttaccgtgtactttactttggaccttcgtacccttacggttaggttaacgggaaacgtcgggtacctacccctaatccgtaacggttaccgacggtccggtacgagggttacggattaccgggtacggactaggttactttcgaccttcctaccgaacctacgtacgacgtacgacttaccgngtaccaacgtccggttaacgtaacgtactttccgaaccgtaaacctttaacttactttaaccgttacttaaacggaaactttttaacggtaaccgttaaccctttacccgttccgttaaaccgttcccgtacgggaccgttaacggaaccgtagggtaccgtaagtacgtaaaccgtacggtaacgtggtcgaccgttacacgtactacg

SEQ ID NO: 20050 - DNA, 506 bp, Homo sapiens
  misc_feature: GYAE6OF02HE1Z6.25.86.H09.1.454.CMB.1.raw
  modified_base (471)..(473): a, c, t, g, unknown or other
  misc_feature (471)..(473): n is a, c, g, or t
  modified_base (477)..(477): a, c, t, g, unknown or other
  misc_feature (477)..(477): n is a, c, g, or t
  modified_base (479)..(506): a, c, t, g, unknown or other
  misc_feature (479)..(506): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctcggaacccccgcggtcagcactacttctacatgggcgtcgtggggcaaagggactacggtcatcgtctcctcagcctccaccgaacggcccacgtcggtccctccccccgtcggccgcccgtcgcctccgaggacgcacctccgagagcacacggccggcccgtgggcctcgccgtcggtcgaacggtacttaccttaccacttcgtaacgtaggttccgtagacgggccgggctacggggaccaaaggggccgcgtaagtgannncagngnnnnnnnnnnnnnnnnnnnnnnnnnnnn

SEQ ID NO: 20051 - DNA, 775 bp, Homo sapiens
  misc_feature: GYAE6OF02ILQDH.25.86.H09.1.454.CMB.1.raw
  modified_base (534)..(534): a, c, t, g, unknown or other
  misc_feature (534)..(534): n is a, c, g, or t
tcagactgtacagtcacgaccggtgctcgatttagtgctatagacttgggtttgggggcaggagtcagacccactcaggacacagcatggacatgagggtccccgctcagctccgtggggcttctgctgctctggcctcccaggtgccaaagtgtgccactccagttcgaccctagtcctcctactccctccctgtctcgtccttcgttgttcgacgactagtagtaccacctatcgtacgttcggtccgggtacttacggtcgggtctagttcggacgtaggttcgtacgtttacgtccgttaggttactacgaacgtaccgaacggaaaaccggtaacgggggaactaccgtaccgtaaacgtccgttccgttcgtaactttcgtttacgtacgttccgtacccgttacgttaggttaagggtaacggtacggtaccgtacctagttacgtaacggttcgacggtacggtacgtaggtggtacgtaggtacggtaactacgttacgttacctactccccgtactaacccgtntaacccgagaccgtagtccctacggcaccgttaacgtaggtaacgtccttacgaccttaaccgtaaactttattacgtaacgttaacgtaaacgttttaaagttaaccgttacctttacccgttacgtttacccgttaccgggttaccggtaggttacgttaaccggaccgggttaaggtaacgtaacgttaacgaaaccggttaacgttacggtcgaccgttcggtaccgtaccgtaccg

SEQ ID NO: 20052 - DNA, 726 bp, Homo sapiens
  misc_feature: GYAE6OF02ISO66.25.86.H09.1.454.CMB.1.raw
  modified_base (194)..(194): a, c, t, g, unknown or other
  misc_feature (194)..(194): n is a, c, g, or t
  modified_base (350)..(350): a, c, t, g, unknown or other
  misc_feature (350)..(350): n is a, c, g, or t
tcagactgtacagtcacgaccggtgctcgatttagtgctatagacttgggtttgggggcaggagtcagacccactcaggacacagcatggacatgagggtccccgctcagctcctgggcttctgctgctctggctcccaggtgccaaatgtgccatccagttcgacccagtctccatccctcctgtctcgcctntgtcgagacagtagtcaccatctacgttggtccggcgtacggtcggtctagttggactagttcgtacgtttacgccgttaggtattcgagaccgtaacggaaaccggaggggaacgtaccgtactaaacgtccttaccgtgtacttcgtttacggnttccgtacccttacgtaaggtttaggtaacggtacggaccgtacccgaagttaccggtaagttccgacggtcgggtacgtaggtaggtaccgttacggacgggtaacgtacggttaacttttacccgaacgtttaccccgtaccgaaccttgaacgaacgtccaaggtcccacgactaccgacggttaacaagtcgttacgtactaaccgtaatttacgttaagttactaacgtaaacgttaagttaccgttaacctttacccgtcgtacccgtcggttaacccggggacgggttaacggaccggttaagggacttacggtaacgtaaccgtaaaccgcggttaaggtcggtaacctcggtaacccgtactaaccg

SEQ ID NO: 20053 - DNA, 937 bp, Homo sapiens
  misc_feature: GYAE6OF02H79GR.25.86.H09.1.454.CMB.1.raw
tcagactgtacagtcacgaccggtgctcgatttagtgctatagacttgggtttgggggcaggagtcagacccactcaggacacagcatggacatggagggtccccgctcagctccgtggggcttctgctgcctcgtcggcctccgaggtcgaccaaatcgtcgacctactaccgtagttccgacccgtacgtcctaccctacttccccgttcccctggtctcgtccttcgtaggttacgagtactatacgtaccacctactctacgttggcggacttgggtcgtactgtacggctagtcgtacttacgtcgttagtactcgaacgtacgaacggtaacgacggggtacacgttaccgtaacgtccttacgtcgtacttgttacacgttcgtaccttacggttaacgggttaacggaacggttcgaccgttaccctaacggttaacctacgggttacacggtaccggtacgttaacggtacggtacggtttacggaacggttaccgttacggtacttttaacccacgttaccgtacctaaaccgttacggtaccgtaacgtacggtacccgtacggtacccgtaacggtaccgtttaaccggttaaaccgttaaacgggttaccgttttacccggtaaacgtttaacccgttttaaaccgtttacgttttaaccggttaaaccgttaaacccgtttaaaaaggtttttaaacccggttaaaaccggtttttaacccccgttaacccgtttccgggtttaaccccggtttaccgggtaaccggggttaaacccggggttaacccggggttaaaccggggttcgggtttaaaccggggtaaaccggttaacccgttaaacccgggttaacggtttcccggggttaaccggttacccggttaccggttaacccgtttaccccgtaaaccgttttccccggg

SEQ ID NO: 20054 - DNA, 676 bp, Homo sapiens
  misc_feature: GYAE6OF02G2G1Y.25.86.H09.1.454.CMB.1.raw
tcagactgtacagtcacgaccggtgctcgatttagtgctatagacttggggtttggggggagtcagacccactcaggacacagcatggacatgagggtccccgctcagctcctggggcttctgctgctctggctcccaggtgccaaatgtgccatccagtcgacccagtcctccatcctcctgtctgcctctgttcgagacatacgtcaccatctacgttggcgggtctaggtcgggtcagttcggcgtagtcgtctttagccgtggtactcacgacaaggaaacccgaggggtaactcctaccgtaacggtcctccgttagtacttctttggacttcgaccctaccgtaggtttaaggaagttcgggactaccctagtacgtaggttcaggcggtataggtggatcggtaggactagtactttcgactcccgtacaactcgtacgagacctacgtccgtagacccgaggtacccgtagggaaacttacgttccgtacggaaccttaaacgttttatttacgttacgtaaacttaacttaaacggtttaacgtaccttttcccctagttccggtttaccggtaccggggacggtaacgggtacccgtaagggtacggaactaacgtaacggaaccgtacgtggttacggactaccggacctacgtacgttcgtacg

SEQ ID NO: 20055 - DNA, 776 bp, Homo sapiens
  misc_feature: GYAE6OF02FMXJ2.25.86.H09.1.454.CMB.1.raw
  modified_base (763)..(763): a, c, t, g, unknown or other
  misc_feature (763)..(763): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagcttgggtttttccttgttgcctattttaaaaggtgtccagtgtgaagtgcaacgtggtggagtcgtgggggagccggtggtacgagggcccggggggtcccgtggagacctctccgtgtgtacgcctctggtattcagttgtttgatgtatttatgtccagtgtcacgttcgggtccgtacgtaacgggtccggggaagggtcgagggtaggtcgggtccttcttacgttagtgtacgttgggtagtagggaacgaaacggtaaacctacgttagtacgacgaacgtaacgttcgtaggtacggaacgggttcgtaccgttacccaacccgtaaccctccgaaagaacgaaccaaacgtaactaaccgaaacgttaccctacccgttgttaactcgtaccaaaggtaaactacgggaaccacgtttacaccggtacctacgtacggtaactaaccggtacccgtaccccgtttcgtttaacgggttttaattccgtttaagggggtaaccgttaaggggttaaacggggttcgggtttcgggtttaaaggtaacgggtttagtaacggtccccgggttaacccgggtaacccccgggtttaccccccgggngggtttaaccccg

SEQ ID NO: 20056 - DNA, 633 bp, Homo sapiens
  misc_feature: GYAE6OF02FXWTM.25.86.H09.1.454.CMB.1.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (311)..(311): a, c, t, g, unknown or other
  misc_feature (311)..(311): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgtcgagacatagtcaccgatctacttggtcggctaggtcgggtctagttggacagtntcgtttagccgtaggtatcagacaagaaaccgaggggaanctaccaagctctagtattcttgntcgctacgtagttacgaagtggacgtccatacgtaacggtcacggtcggctaggtggactcggtaggactagtagttcactaccgtcaacgtatcgactcgacgtccgtagcgtacgctaggtaactacgtcgtactaacgtaacctttacgtttagttaccgtaacttaaacgttaacgttttaaacgtacctttacccttcgttccgttacccggtcgggtaaccggtacgggtaacgtaacgggtagggtaacctaaagttaccggtaaaaacgttacgtgggtaggtccgtaacggacctaccgtaagttccttaacg

SEQ ID NO: 20057 - DNA, 537 bp, Homo sapiens
  misc_feature: GYAE6OF02F05AF.25.86.H09.1.454.CMB.1.raw
  modified_base (504)..(505): a, c, t, g, unknown or other
  misc_feature (504)..(505): n is a, c, g, or t
  modified_base (507)..(537): a, c, t, g, unknown or other
  misc_feature (507)..(537): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggacccccgcggtcagcacttacttctacagtgggcgtcgtggggcaaaggggactacggtcatcgtctcctcacgccctccaccgaacgggccccattccgggtcccttccccccgtgggcccgtcccctgcctccgagggacgccacccgtccgagacgaccacgacggccggcccgtgggcctcggcccgtgggtaccgaaagggtacccttaccgttacccgacgttacgtaacctggttcctaggacggtccgggggcgtacggggacgaaacgggccgacgtaagtacgggnngnnnnnnnnnnnnnnnnnnnnnnnnnnnnnnn

SEQ ID NO: 20058 - DNA, 676 bp, Homo sapiens
  misc_feature: GYAE6OF02G8R38.25.86.H09.1.454.CMB.1.raw
  modified_base (466)..(466): a, c, t, g, unknown or other
  misc_feature (466)..(466): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgaccatccgagttgacccagtctccatccctcctgtctgcctctgttcgagacatagtcaccatctacgttggtcgggcttaggtcgggtactagttggcagttcgtacgttagccgtaggtatacgagacgaacggtaaaccgaggggaacgtcctaccgtaagcctccgtagtattacgtttgacgttacgtcctaccgtaggttaggtaacggtcggacgtccctagtacgtaaggtcgaggtcggacgaggtaggtactcggagggtactagttacgttctactccctaccgtactaacgtcacggtacncgtctacgacgtaccggacttagaatcgttaccgtcgaaccttaaccgtttatttaacgtacgttaaacgttaaacttaaacggttttaacgaccctttacccgttctttaccggtccgttacggggacgggtaccggtaaccgggtaagggtccggtaacgtaacgtaacggtaaaccgttagcggttacggactacgtacaaccgtcg

SEQ ID NO: 20059 - DNA, 614 bp, Homo sapiens
  misc_feature: GYAE6OF02F56LD.25.86.H09.1.454.CMB.1.raw
  modified_base (287)..(287): a, c, t, g, unknown or other
  misc_feature (287)..(287): n is a, c, g, or t
  modified_base (423)..(423): a, c, t, g, unknown or other
  misc_feature (423)..(423): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcggtcattggcagtcgtctttagccgtggtactcagcaacgaaaccgaggggaacnctacaaggcctccgtgtacttcttgatcgcctccgtaggttaggaagtcggacgtcccatacgtaaggttcaggcggacaggtgatcgacgggacaggttacttcactcccgtacacctatcacgtcaacgccgtnaccgtacgaccgttagaacggttcttaccgtacgtacctaaaccttgttactacgttactaaacgtttaagtttaacggtacctttaacccgtcctttccgttacccggtacggggtaccggaacgggtacctaacggggtgtaacgacgtaaccgtaaacgtcgttacggcggactcggacctaacgtcg

SEQ ID NO: 20060 - DNA, 674 bp, Homo sapiens
  misc_feature: GYAE6OF02IORLX.25.86.H09.1.454.CMB.1.raw
  modified_base (108)..(108): a, c, t, g, unknown or other
  misc_feature (108)..(108): n is a, c, g, or t
tcagactgtacagtcacgaccggtgctcgatttagtgctatagacttggggtttggggggcaggagtcagacccactcaggacacagcatggacatgagggtccccgntcagctcctggggcttctgctgctctggctcccaggtgccaaatgtgccatccagttgacccagtctccatcctccctgtctcgcctctgttcgagtacatacgccacctatcacttggtcggctaggtcggtcagttggctagttgtctttagcctggtactcgagtacaagaaaccggaggggaacgtcctaaccgtaacgtccttaccgtagtacgttctttagacttcgtaccctacgttaaggtttaggaaggtcggtacgtaccatacgtaacggttcacggtcggacgtaggtagtactacgaggaccagttactttcacttccacgaactacgtacacgacgtaccgtcgtagacctacggtacgttagtaacgtactttcgacgtaaccgtaattttagttacgttagtaaacctaaagtttaaacgttaccgtaccttttacccgtcttaaccgttccggtacgggtacggggtaaaccgtacggtaagggtaactacggtaactaacccggaaagttcggttacggtaccgacggtaccgtaccgtaacttccgg

SEQ ID NO: 20061 - DNA, 962 bp, Homo sapiens
  misc_feature: GYAE6OF02GSWPN.25.86.H09.1.454.CMB.1.raw
tcagactgtacagtcacgaccggtgctcgatttagtgctatagacttgggtttgggggcaggagtcagacccactcaggacacagcatggacatgagggtccccgctcagcctccgtggggtcttctgctgctctcggcctacccgaggtcgaccaaagttgtcgacctactccgtagttaccgacccgtagttcctaccgacttccctcccgttggttcctcggtacccttcgttcgttacggaacgtactagttacgtaccacctacttacctacgtttcggtcgggtcttagggttccgggtactaggttcggactaggttcgtacgtttagccgttaggtactcgaacgtacgaaacggaaacccggaggggaacgtcccgtacgtaacgtccgttaccgtacgtacgtttacttaggtacgtccggtacccttaccggttaggtttaaccgggtaagggtaccgggtaccgttaacccgtaacgtttaaccggtaaacggtttccggacgggtaccgggtacggtaacgggttacggtaacggtttacccgggaacgggttaaccttaaacggtttaccgtttttaacccaaccctttttacccccgaaacccgtttaacgtaaccgttacccggaaccgttacccggaaccggtcccgttaccgggtaacccgtacccggttaccggttaaacggttaaaccgttttacgttaccgtaaacccggtaacccttttaaacgtttaacggttttaacccgttaacggttaaaccgttttaaaacttttaaaccggttttaacccgtaacccttttaccccggtttaccgtttccggttaacccgggtaacggggtttaccgggaacccgggttaaccggtaacggggttaacggtacctaaccggtaaccgtaaaggtttacgacgggttccgaaccgtcgtaacccgtgtttacccg

SEQ ID NO: 20062 - DNA, 892 bp, Homo sapiens
  misc_feature: GYAE6OF02FOX2F.25.86.H09.1.454.CMB.1.raw
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttcgacccagtcctccatccctccctgtctcgccttcgtgttcgagacatagtcaccatcacgttggtcggctaggtcgggtctagttggactaggttcgtactttacggcccgttaggtactccgaacgaccgaaacggaaaacccggaaggggggtaacgtcccttaacccggtaaacgtcccgttacccgttggtaacttttcgttttggaacgttccggtacccttaccggttaagggttttaacgggtaaaacggttcggggtaacccgttacccgtaagttaaccggtaaagggtttccgaacgggtccggggtacgtaacggggttacgggtaacgttaccgggtacggggtaacctaacgggtttaaccttttaccgtaaccgttccccgttaaccctaacccgtaacgttaccgtaacggacccgtaaccgggtacccgttacggaacccggtaccggttaacccgttaaggtaaaaccggtttacctttacccggtaaccgttaacccttaaaccgttttaacgttttaacgttaaccgttaaacctaaaaacgtttaaaccggttttaaaccggttaacccttttaccccgttaccgtttacccggtttcccggtttaaccggggaaccgggttaaccggggtaacgtaacgggtacggtaacggtaacgtaaccggtaaacgtacgtcggtcggtacgtaccgacctacgtacttcgttacg

SEQ ID NO: 20063 - DNA, 748 bp, Homo sapiens
  misc_feature: GYAE6OF02GW258.25.86.H09.1.454.CMB.1.raw
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatacgtcaccatctacgttgtcggctaggtcggtactagttggactaggtgtctttagtcccgtaggtactactacgacgaacgtaaacgaacgggaaggaccgtactacgtactccgtagtctactttcgtacgtcgtccgtacgttacggttaggtaacggtaggtacgtaccgtacgtacgtaagttacgtacggcggacgtacgtaggtacgttacgtacgggtaagtacgttacgtttacgtaccttaccgtaccctacctaaacggtcctaacggaccgtacggtccgtcccggtacgaccggtccggtacgtaaaggttaccgttacgtacccgttaaccgtaacccttaacgttttaccggttaacgttaccgtaaaacctttaaaccgtttaaacggttcctttaaccccttccgttaccgtttacccggtaccgggtaaccgggtacgggttaaccgaacgggttaggaacggtaacgtaacgtaaacccgtaggttcggtacggtccgttacggcctaaaccgtcgttacgttaccg

SEQ ID NO: 20064 - DNA, 798 bp, Homo sapiens
  misc_feature: GYAE6OF02GX44P.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctccgtggggcttctgctgctctggctcccgaggtcgaccaaatgtgccactcctagttcgacccagtcctccactccctcctgtctcgtccttctggttcgacgacatacgtccacctatcctacgttggtccgggtctacggtcgggtactagttggcgtagttcgtacgtttagccgttaggtactctacgacgaacggaaaccggaaggggtaacgtccgtaccgtaacgtccttaccgtgtactttcgtttgtacgttccgtccttaccgttaggtttaacgggaacggtacggtaccgtccgtaacgtacgtaacggtcacggccggtacgacggtcggtacgtcggtaggtacgtacggttacttactacgttcccaactaccgacgtccgaacgcctacgtccgttacgaccgtaccggtaccgtaaggttaccgttacttacggtacctaaaccgtttaaacgttttcgttaaacgttaccggaaacctttaaaaccgttaacgtttttaacccggtacctttaaccccggtttacgttacccggttcccgttaaccgggggtacccgggaaacggttaacccggtaacgggttaacgggtaaacctaacccggttaaaccggtaaaccggttacgggttacggtaaccggtcgttaacccgaccgttaacccgttcgg

SEQ ID NO: 20065 - DNA, 841 bp, Homo sapiens
  misc_feature: GYAE6OF02FSB7O.25.86.H09.1.454.CMB.1.raw
tcagactgtacagtcacgaccggtgctcgatttagtgctatagacttgagctctgggaaaggagccccagccctgagattcccaggtcgattccattcggtgatcagcactgacacagactcaccatggagtttggactgagcgtggtttccttgtgcctagtttaaaaggtgtccagtgtgaagtgacaactggtggagtcgtgggggagccggtaggtaccgagggcccgggggggttccctggagaccttccgtcccgtggttgtagtccccttgtcggatttccattcgtttgacttgactttagtcggccctaagttcgaccgttacctggggttcccgtacggtaacggttacccgggggtaaagttcgtagggtacggttgggttaccttcgttacgtttagtcggtaaccggtttgggtaacggttaggggaaccggtaaacgtaacccgttaacgttacgtaccggtacgaacgttacgtccggttaggttaggggtaaacccgggtttccgtacctttacccgaccccgtaaccctacccgaagtaacccggaaccctaaacccgtaccgttaaacccgtaaaccgttaaccccgttaccccgttaacgtttaccgtacctttacggaaaccgttaaaccggttaacgggtacccgtaaccgttaccgttaccggaacccttaccgttaccgtaacgttaaccggtacccgtacccgttaccgtttagttacgtttacgttacgtacggtaacggtaaggttccgggttagttagggacgttaacgacggtacgacccggttacccgggacccccgtaggtacctaaccgg

SEQ ID NO: 20066 - DNA, 815 bp, Homo sapiens
  misc_feature: GYAE6OF02ITXXC.25.86.H09.1.454.CMB.1.raw
tcagactgtacagtcacgaccggtgctcgatttagtgctatagacttgagctctgggaaaggagccccagccctgagattcccaggtgattccattcggtgatcagcactgaacacagaactcaccagtggagtttggactgagcgttgggttttccttgttcgcctaagttttaaaaggtgtccagtgtgaagtgacaacgtggtggagtcggtgggggacgccggtaggtacgacgggcccgggggggtccctggagtaccttcgtccgtggtgtacgcctcgtggtattctagttggtttagagttgtatttagtcgcctaagtcgacgtaccgttcggggttcccggtacggtaacgggggtaccgggggtaaggtcggttagggtaggttcgggtaccttcgttacgtttagtcggtacggttagggacgtaggggtaacgtaaacggtaaaccttactacgtcgtacgacgtacgtcgttggtacgggtaaacgggtcgtaaccgtttacccgaaaccctacccgtaacgaacggaaacctaaccgtaaacctaagttaaacccgaaaacggttacccttacccgtagttactaccgttagaacccgtaaaggttcgaacgtccgtttacgaacgaacccttacccgtagtacgtaccgacccttaccggttaccttttagttaacctttgggttacggttacgggtaaggttaacgggggttaccggtttggttaagggtaacgttaggtccgaccggggtttaacccccggtaacccgggtaacccccggtcggttacccgaaacgg

SEQ ID NO: 20067 - DNA, 508 bp, Homo sapiens
  misc_feature: GYAE6OF02JPBFA.25.86.H09.1.454.CMB.1.raw
  modified_base (224)..(224): a, c, t, g, unknown or other
  misc_feature (224)..(224): n is a, c, g, or t
  modified_base (486)..(508): a, c, t, g, unknown or other
  misc_feature (486)..(508): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggtcggtgttgaggtgaagtgccgtacgggaacccccgngggtcacgccgtacttaccttctacgtatgggcgttcggtcggggacaaacgggacgtacggtctagtccgtcctcctgacgccctcctaaccgaacgggccctacgttccggtacccttcccccgtggccctcccgtcgcctccggaggcgccacctccggagacgcacgcgccggcccgttggccgtgcccgtggacacggtaccttccgcctactcgtacacgtcgcgagggcgtcgcggtcgaaggcgactagtacgnnnnnnnnnnnnnnnnnnnnnnn

SEQ ID NO: 20068 - DNA, 694 bp, Homo sapiens
  misc_feature: GYAE6OF02I7X0W.25.86.H09.1.454.CMB.1.raw
  modified_base (195)..(195): a, c, t, g, unknown or other
  misc_feature (195)..(195): n is a, c, g, or t
tcagactgtacagtcacgaccggtgctcgatttagtgctatagacttggggtttggggggagtcagacccactcaggacacagcatggacatgagggtccccgctcagctcctggggcttctgctgctctggctcccaggtgccaaatgtgcccatccgagttcgacccagtctccatcctccctgtcctgcctntgtcgagacatagtccacatctacttggtccggacttaggtcggtccagttcggcagtcgtacttagccgttggtactcacgcgtaagaaaccggaggggtaacgccgtaccgtaacgtcctacctgtacttcgtttgacgtcgccttacgtagttagaaggttgacgtacccataccgtaacgttcgacggcgacgaggtggcgtacgtacgggactaagttcttctacgttccctacgaccgtacgtaccgtagaccgacgtacccgtgaccgtagtcccgtaagaacgttacgtttccgtacgtaccctaaaccgtttactttacggtagttaaccggtaaactttaacggttttaaaccgtaacctttacccgttcgtttaaccgttcccggtttaacgggacccgggtaacggtaccggtaagggtacgggactaaccgtaaacgtaaacgacggttgacgggttctaccggactacgtaccgttcgttaaccg

SEQ ID NO: 20069 - DNA, 690 bp, Homo sapiens
  misc_feature: GYAE6OF02INOUG.25.86.H09.1.454.CMB.1.raw
  modified_base (226)..(226): a, c, t, g, unknown or other
  misc_feature (226)..(226): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagcgttgggttttccttgttgcctattttaaaaggtgtccagtgtgaagtgcaactggtggagtcgtggggacgccgtggtacgngggccggggggtccctggagtactcgtccgtgtgtacgccgtcgtgtatcgagtcttacagtactaaatatagtgtagtaacgtggtccgccgtaggcgtaccgaggggagggcgtggaggtcggcgactagttcggtagtaggtaagtaggtaacgtaacttagtaaaactacgtacgacgtagacgtacgtaggtgggtaacgggccgtattacgacttagtccctacgtaacgaacgaactaaacgaaccgaagtacgtcgttaattttcgttgcgaacgtaaactaggaaacctacgtccgtagaacgggaccgaccggtaagtaacgtaaccggtcctttacgttaagttaagtttacgtttcggacggttaacgtaacgtactaaaaggtaacgtaaggaccgttagggtacggtccggtaagggttccttaacggtccggtaaacggttcccggggg

SEQ ID NO: 20070 - DNA, 803 bp, Homo sapiens
  misc_feature: GYAE6OF02IRWV0.25.86.H09.1.454.CMB.1.raw
  modified_base (302)..(302): a, c, t, g, unknown or other
  misc_feature (302)..(302): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtcgccatccagttcgacccagtcctccatccctccctgtctgccttctgttcgagacatagtccacctatcacttggtcgggtctaggtcgggtctagttggacagtgtctttacggcctggtatcgagcaacggaaaccggaggggaacncctaccgtaacgccttacccgtagactttcgtttagacttccgtcccttacggtaaggtttagggaaacggttcggaccgttacccgtaagttacccgtaacgggtttccgaagggtccggtacgtaacgggtagggtaccgttcggtacggggaactaggttaaccttttccgtacctttaccccgtacctaacccgtaacgttccaacggaccgtaccggtacccgttacggaccctaaccggtacccgttaaggaaacgtttccgttaccgtacggtaaaccctaaaccgtttaacgtttacttaaccgttaacccttaaaagttaaacgttttaaccggtaaacccttttccccgttattaccccgggtttccggttaccgggggtacccggggtaacgggttaacccgtaaagggggtccggttaaacgtaaccgtaaaacccgttaaaccggtacgttgggtacccggtacgtaccggtacccttacgttaccgg

SEQ ID NO: 20071 - DNA, 687 bp, Homo sapiens
  misc_feature: GYAE6OF02HUKJ2.25.86.H09.1.454.CMB.1.raw
  modified_base (564)..(564): a, c, t, g, unknown or other
  misc_feature (564)..(564): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagctgggttttccttgttgccattttaaaaggtgtccagtgtgagtgcaactggtggagtcgtgggggagccgtggtacaggccggggggtccctgagactctcctgtgtagcctctggattcagttgtttgatgtattatcgccatgctacgtcgggtcccgtacggtacggggtccggggggtaagggttcggtgggaggttcgggttctcgttcgttagtggtacgttggggagtaggggaagaacggtaaccttaacgtagtacggactaacggtactcgttaggtacggtaaaggggttccgtaacttccgaaccccgtaccctaccgaaggtaaccgaacctaaacaacttaacgaaaaccgtcccttacccgttagtacgttcctagaacctaagcggactagtcagtaccacgtnacgtcgaccgtacccgtattacgtatttaggttagttacgggtaagggtaacgggtcggtttaggtaggtaggttacgacgttccggtacccggtacccgggaacccccgtgggacctaccgg

SEQ ID NO: 20072 - DNA, 709 bp, Homo sapiens
  misc_feature: GYAE6OF02IOZSA.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgacccaaagtgtgcctatccaagttcgacccagtcctccatccctcctgtctcgcctcgtgtacgagactattacgacaccactccacgtttggaccgggtctaacggttcgggactagttggctagtcggtacttacggacctaggttactcgaacgacgtaaaccgaaaccggaggggtaacgaccttaccttaaagcccgtaactcggttacttccgttagtacgtcggtaacccctcgtaaggtttaaggaacgggttaggaccgttacccgaattaccggtaaacggttcggaccgaccgggtacgtaacggtttacgggaactacgggtacccgggtaactagggtttaccttaccctaagtaccctacctaaccgtacgtacgacgtacgacgtctacgacacggttaccgagtaaggtacttctaacgtctaacttatacgtacgtacctaaagtaacttaacgttaactccctatccgttacgtccggacggaacggtaccgaagggttaccgagaaacctagtaacgaagttcggaacgtcgacgtacaccgtacg

SEQ ID NO: 20073 - DNA, 758 bp, Homo sapiens
  misc_feature: GYAE6OF02IFPVX.25.86.H09.1.454.CMB.1.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgaccaaatgtgccatccagttcgacccagtcctccatccctccctgtctcgcctcttgtcgagtacatacgtcacntcacgttgtcggtntaggtcggtactagttggctaggttcgtacgttttacggtccgttaggtaactcgaacgaccgtaaaccggaaaaccgggtaacgggggaacgtaccttacccgtaaacgtcccgttaccgttaggtaacttttccgttaggacttccgtcccgttacggttagggttacggaaggttcggaccgttcctagtacggtaacggttcgacggccggtagtacggtaggtacgttccggaagggtactacgtttactttccaacgtttcccgtacctaaccgtacgttaaccgacggtacctaaccggtcgttaaccggcgtaaccgtaccggtaagtaaggttacctttccggaacttaacccttaacttaacgtttacttacggtaaacttaaacgttaacgttaacgttacctttaccctcttaccgttccggtacggtaacggtaacggtaccggtaggtacggtaactaaccggttaacggaaccgtagttggtacggacttggaccctaacgttcttacgttcc

SEQ ID NO: 20074 - DNA, 690 bp, Homo sapiens
  misc_feature: GYAE6OF02JHNKQ.25.86.H09.1.454.CMB.1.raw
  modified_base (131)..(131): a, c, t, g, unknown or other
  misc_feature (131)..(131): n is a, c, g, or t
  modified_base (152)..(152): a, c, t, g, unknown or other
  misc_feature (152)..(152): n is a, c, g, or t
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
  modified_base (529)..(529): a, c, t, g, unknown or other
  misc_feature (529)..(529): n is a, c, g, or t
  modified_base (676)..(676): a, c, t, g, unknown or other
  misc_feature (676)..(676): n is a, c, g, or t
tcagactgtacagtcacgaccggtgctcgatttagtgctatagacttgggtttgggggcaggagtcagacccactcaggacacagcatggacatgagggtccccgctcagctcctgggcttctgctgctcnggctcccaggtcgacaaatgngccatccagttcgacccagtctaccactccctccctgtcgtcnccttctgttcgagacatacgacaccatccattagtcggggacttacggtcgggtctaattgggactagtccgtattacgtccgtggtancctagacacgtaaaaccgaggggtaactacctccggttaaagccttacctaggtacttcgtttaagagtcggtacccttacgtacgggtttaaggaaacgtcgggtaacctccgtaactaacggtaacggttccgaagggccggtagtaacggtgacgttacggaggaaccgtatacttacgtactacccgtacacgtactaacgactcgtaacgccgagaccgatccgaagacttgttaacccncggtaaatacgtttaactacgttaactaactaaagttaaaccgttaaccgtacctttaccctcgttaaccctccgtacgggaccggtaggaaccggttaaggtacggaactaaccgtaaacgtaacgttaacggtcgacgttacccnccttacctacgttc

SEQ ID NO: 20075 - DNA, 703 bp, Homo sapiens
  misc_feature: GYAE6OF02F48SP.25.86.H09.1.454.CMB.1.raw
  modified_base (189)..(189): a, c, t, g, unknown or other
  misc_feature (189)..(189): n is a, c, g, or t
  modified_base (230)..(230): a, c, t, g, unknown or other
  misc_feature (230)..(230): n is a, c, g, or t
  modified_base (274)..(274): a, c, t, g, unknown or other
  misc_feature (274)..(274): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctcctgtctgcctntgttcgagacatagtcaccatcacttgcggctaggtcggtnagttgcagtgcttagcctggtatcagcagaaaccgaggggaacnctacctaagctcctgacttctttagatcgcctaccgtagtttaggaaagttcggacgttcccaagtccgaaggtttcaaggcggtacaggttcggattcggtacggggaactagttacgtttaccgacttcccgtacctaacctagttccgaaacggcccgtaaaggtccccgttaggacccgaacgggtacccccgttaaagggtaaacgttaacgtttcccgtacggaacccttaaacgttacttttaacgttacgtaaccgaaaacttaagtttaaaccggttaccttaacccttccgttacgtttacccggtttacggggaaccgggtaaccgggtaccgtaagggtacgggtaaacgtaacctttaaccggaaaaaccgttcgtaaggttcggtaccgtacgtacctaaccgtagtccgttacg

SEQ ID NO: 20076 - DNA, 741 bp, Homo sapiens
  misc_feature: GYAE6OF02IN6EZ.25.86.H09.1.454.CMB.1.raw
  modified_base (222)..(222): a, c, t, g, unknown or other
  misc_feature (222)..(222): n is a, c, g, or t
  modified_base (632)..(632): a, c, t, g, unknown or other
  misc_feature (632)..(632): n is a, c, g, or t
  modified_base (645)..(645): a, c, t, g, unknown or other
  misc_feature (645)..(645): n is a, c, g, or t
tcagactgtacagtcacgaccggtgctcgatttagtgctatagacttggggttgggagaagaacctactatgcagactctgtgaaggtcgattcacacctccagagacaacatcaagaactcctgtatctgcaaatggacagtctgacacctgatgacaccgcttgttacttattagtgtgaaaggtgtacgtttgaggtgaactgaccgcggaacccccgnggtacagcctactacttctacagtggcgtggtcgggacaaacgggtctacggtacatcggtccttctcacggtcctcaccgaaaggtcctagtccgtttccgttaccccgtggtcccgaccctgaccttccggtaaggaccgtcccaaccgtttcccgaaggaaccgtcgaaccgtaaggcccggggcccttggggacccttggacccgttcgggtaccgtaaaacggggtaccctttaaccgtacccgtaagttacccgggtttaacaacggtttaccgtttcggtaaacgggtccccggggttaacggttaccgggaaccttaaacggggaccccgttaaccgtaaagttccggttaaagcttaaacggcggcctaacgaacgaccgttcgacggtaccttaccgganaccgggttaaccncgtaacgtaccgacgtacgtacgccggtacgtacggtcgacggtactaccgttacgaaccgtcgtaacctcgtaacctttccggacgttacggtac

SEQ ID NO: 20077 - DNA, 461 bp, Homo sapiens
  misc_feature: GYAE6OF02FZI0U.25.86.H09.1.454.CMB.1.raw
  modified_base (219)..(219): a, c, t, g, unknown or other
  misc_feature (219)..(219): n is a, c, g, or t
  modified_base (278)..(278): a, c, t, g, unknown or other
  misc_feature (278)..(278): n is a, c, g, or t
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (445)..(461): a, c, t, g, unknown or other
  misc_feature (445)..(461): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgtccttgtattattgtgtgaaaggcggtgttgaggtgaatgcctggaacccccgnggtcagcactacttctacagtggggctcgtggggcaaaaggggctacggtcagtcgtcncctcacgccctaccacccaagggccccatcggtccttccccctggccgcccctnccgtccacggganccacctccgagagcacncgccggcctagggctggcccgtggtacaaggtactacgttccacgtgtaacacgtctgacggtcggctgggcaaggcnatnannnnnnnnnnnnnnnnn

SEQ ID NO: 20078 - DNA, 429 bp, Homo sapiens
  misc_feature: GYAE6OF02FU92U.25.86.H09.1.454.CMB.1.raw
  modified_base (391)..(391): a, c, t, g, unknown or other
  misc_feature (391)..(391): n is a, c, g, or t
  modified_base (421)..(429): a, c, t, g, unknown or other
  misc_feature (421)..(429): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtcgtggggcaaaggggactacggtcatcgtctcctcagccctccaccaagggcccatccggtcttccccctggccgccctgcctccaggagcacctccgagagcacagcggccctgggctgcctggtcaaggctacttccactgtacngtctgagcgggctgggcaagggcgcatagnnnnnnnnn

SEQ ID NO: 20079 - DNA, 611 bp, Homo sapiens
  misc_feature: GYAE6OF02GLZ3F.25.86.H09.1.454.CMB.1.raw
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtctgggggagccgtggtacaggccgggggggtccctgagactctcctgtgtagcctctggattcatgtttgatgattatgccatgacactgggtcccgtgaagggtccgggaagggtctgggaggtggtctctcttanggtacttgggatggggagaagaacctatatgcagctgngtaggagggtcgattcaccacctcagagaacacatacaagacctcctagtatcgtcgacaatacggactacgtctacgaactaccctagtatacgtaccgtacccgtacctttacgttatttattcggttaggttaacggtaaaggggttccggttcgggtttaaggtaggggttagtaaggttacggtacccgttacccgggtaaccccccgggtagggtacccgtaaccgg

SEQ ID NO: 20080 - DNA, 705 bp, Homo sapiens
  misc_feature: GYAE6OF02IOYMS.25.86.H09.1.454.CMB.1.raw
  modified_base (261)..(261): a, c, t, g, unknown or other
  misc_feature (261)..(261): n is a, c, g, or t
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
  modified_base (396)..(396): a, c, t, g, unknown or other
  misc_feature (396)..(396): n is a, c, g, or t
tcagactgtacagtcacgaccggtgctcgatttagtgctatagacttggggtttgggggccaggagtcagacccactcaggacacaggcatggacatgagggtccccgctcagctcctgggcttctgctgctctggcctccaggtcaccaaagtgtagccatccagtttcgacccagtctccattccctcccttgtccttcggcctacgtcggttaccgagacctattagtacccacctaatacctaacgttggtccgggnttacggtcgggtactagttggccaggttgtactttagcccttagtactcgagccaaggaaaccgngggaactcctaccgtaancgtcctgtacttcgttagactgtcctacgtagttaggagttcggctacccgntaccgtagtcacggcagtacgtaggtatcggaggtactagttactttacgccttacgtacctacctacgtacgacgtacgacgtaccgtcgaaccgtcgttaccgaagtaacgtaccttacggtcctaaccgtaacttacgtaagttaccgtaacgttaaaccttaggttaacgttacccttttaacccgccgtttaaccgtcccgggttagtaccgggtcggtaaaccgttacggggaaccgtaacggttacctaacgggttaaaccgtacggttacgggtctacggtaccgtacgtaaccccgttag

SEQ ID NO: 20081 - DNA, 601 bp, Homo sapiens
  misc_feature: GYAE6OF02G2GND.25.86.H09.1.454.CMB.1.raw
  modified_base (220)..(220): a, c, t, g, unknown or other
  misc_feature (220)..(220): n is a, c, g, or t
  modified_base (374)..(374): a, c, t, g, unknown or other
  misc_feature (374)..(374): n is a, c, g, or t
  modified_base (565)..(565): a, c, t, g, unknown or other
  misc_feature (565)..(565): n is a, c, g, or t
  modified_base (567)..(601): a, c, t, g, unknown or other
  misc_feature (567)..(601): n is a, c, g, or t
tcagactgtacagtcacgaccggtgctcgatttagtgctatagacttggggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctcggaacccccgnggtcagcactacttctacagtgggcgtcggtggggacaaaggggactacggtacagtcgtcctcctcacgccctcccaaccgaacgggccctacgttcccggttccccttccccccgtcgggcccgtccccgtcgcccgttaccgagggtaccncccgtaaccccgtccgggaacgaccgccaacggtaccggccccggtcccggtgggtccgtcgtacccgtacgggtaccgaaaccgggtacctttacccgttaccctacggttaccggtacctacggttccgtacggggtacgggaccgggggtctaccggggaacggaacgggccggtacgtaacgaggcngnnnnnnnnnnnnnnnnnnnnnnnnnnnnnnnnnnn

SEQ ID NO: 20082 - DNA, 535 bp, Homo sapiens
  misc_feature: GYAE6OF02F96IH.25.86.H09.1.454.CMB.1.raw
  modified_base (246)..(246): a, c, t, g, unknown or other
  misc_feature (246)..(246): n is a, c, g, or t
  modified_base (351)..(351): a, c, t, g, unknown or other
  misc_feature (351)..(351): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (502)..(505): a, c, t, g, unknown or other
  misc_feature (502)..(505): n is a, c, g, or t
  modified_base (507)..(535): a, c, t, g, unknown or other
  misc_feature (507)..(535): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaagtggacagtctgacacctgatgacaccgccttgtattattgtgtgaaaggcggtgttgaggtgaatgcctggaacccccgcggtcagcactacttctacatgggcgtcgnggggcaaaggggactacggtcatcgtcctcctcacgccctccaccaacgggccccacgttccggtcccttcccccgtgggcccgcccctggcctccgacgggacnccacccgttccgagacgccacgacgccggcccgtgggcctcggccgtggtaccaacggtaccttaccgttccacgttcgtaaccgtaggttcgtacgggacggtccgggtcgtacgggaccgtaagggccgacgtataggcgtanagngcnnnngnnnnnnnnnnnnnnnnnnnnnnnnnnnnn

SEQ ID NO: 20083 - DNA, 571 bp, Homo sapiens
  misc_feature: GYAE6OF02IXXE6.25.86.H09.1.454.CMB.1.raw
  modified_base (133)..(133): a, c, t, g, unknown or other
  misc_feature (133)..(133): n is a, c, g, or t
  modified_base (278)..(278): a, c, t, g, unknown or other
  misc_feature (278)..(278): n is a, c, g, or t
  modified_base (367)..(367): a, c, t, g, unknown or other
  misc_feature (367)..(367): n is a, c, g, or t
tcagactgtacagtcacgaccggtgctcgatttagtgctatagacttgggtttgggggggagtcagacccactcaggacacagcatggacatgagggtccccgctcagctcctggggcttctgctgctctggntcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctcctaagctcctgatctttgatgcctccagtttggaaagtggatcccatcaaggttcaggcggcaggtggatcgtgggacagtattcntcctcaccatccagcagcctgcagtcctagaaggttattctgtacctaaccttattattgtactaactaagtttaaggactttaccctcttccgttccgttaccgggcgggtacgggtaccgtaagggtcggaacgtaacgtaaccgaaaacggtacgttacgggtacgggtccgttcggaccgtaaccgtacgttacgttacg

SEQ ID NO: 20084 - DNA, 972 bp, Homo sapiens
  misc_feature: GYAE6OF02GYHCD.25.86.H09.1.454.CMB.1.raw
tcagactgtacagtcacgaccggtgctcgatttagtgctatagacttgggttgggagaagaacctactatgcagactctgtgaagggtcgattcaccacctccagagacaacatcaagaactccctgtatctgcaaatggaccagtctgacacctgatcgtacacccgtccttgtacttagttgtgtagaaagggtcggtgttcggaaggttcggaattcgcccgttacgggaaacccccccgtgggtaccacggtacctaaccttacgttactaacctagttcggggtccttaccgggtcgggggtaaccaaaacgggggtccgtaaaccgggttaacctagtttcccggttccttaccccgttaccgtaaccggtcccccttaaacccccggtaacccccggaaaacccgggggtccccctaaaccggttttaccccggggtttacccccgtttttaccccccccccggttggggtaccccgggtcccccccgtttcgggtaaccccgtttaccccggtaagggggacccggttaaccccgtaacccccggtacccgggttaaaaccggtaccggaacccgttaacccggaacggtcccggggttaccccccgtggggggttacccccgttcgggttacccccgttcggggtttaaccgtaaacccggggtaacccgtttaaccccttttacccccgtaaacggttacccggttaacccgaaccggggttttaccgtttacggaacccggggtcccgggggtaccgtttaacgggggaacccgaaaacccgggggtttcggggtaccccaaaaggggtttcggaacgcgggtacttcggtaagtccggtaaacgtcggtacgtacgtacgtacgggtaccttacgtaggtacctcgtacgtacgtacgtagtcgtcgtacgacgtactacgaaccgtacgcggactaacgacctacgtcgtacgagtacg

SEQ ID NO: 20085 - DNA, 920 bp, Homo sapiens
  misc_feature: GYAE6OF02HJYNM.25.86.H09.1.454.CMB.1.raw
tcagactgtacagtcacgaccggtgctcgatttagtgctatagacttgggtttggggggagtcagacccactcaggacacagcatggacatgagggtccccgctcagctcctggggcttctgctgctcgtggctcccaggtgaccaaatgtcgccatccagttcgacccagtcctccatccctccctgtctgcctcgtgttcgaagaccagttacgtaccacctatcctacgtttcgggtccgggtacttagggtccgggtactaggttcggactaggttcgtaccttttagccgttaggttactacgaggtaaccgaaacggaaaaccggaacgggggtaactaccccgtaccgtaacgtacccgttcgttacgtacgtttccggtttaagtacgtccgtaccccgttacgttaagggtttaacgggtaacggtacggtaccgttaaccctagtaaccggttaagggttaccggtaacggtcgggtacggtaacgggtacggtacgttcgggtacgggaagttacggttaacctttccctaccgtttacccgtaccctaccgtaacgtaccggtacccgaacggtccgtacccgtcgggtaccgaacggtcgttaacggtaaccgttaacgtttacccgtacgttaaacccgttaacccgtttaagtttaaaccgtttacgttaaaccttaaacgggtttaaaactttttaccgggttaaccctttttaccccgttaccgttaaccccggtttaacccgggttccgggggtaaccggggttaaccggggaaccgggtttaacggggaaacccggttaagttaaaccccggtaaacggttaaaaccggttcgggtttaaccgggaccggtttacgtacccggaacccgttttaacccgttccggtttaaccgtttcccgg

SEQ ID NO: 20086 - DNA, 567 bp, Homo sapiens
  misc_feature: GYAE6OF02I6WHB.25.86.H09.1.454.CMB.1.raw
  modified_base (298)..(298): a, c, t, g, unknown or other
  misc_feature (298)..(298): n is a, c, g, or t
  modified_base (384)..(384): a, c, t, g, unknown or other
  misc_feature (384)..(384): n is a, c, g, or t
  modified_base (529)..(534): a, c, t, g, unknown or other
  misc_feature (529)..(534): n is a, c, g, or t
  modified_base (536)..(536): a, c, t, g, unknown or other
  misc_feature (536)..(536): n is a, c, g, or t
  modified_base (538)..(543): a, c, t, g, unknown or other
  misc_feature (538)..(543): n is a, c, g, or t
  modified_base (545)..(567): a, c, t, g, unknown or other
  misc_feature (545)..(567): n is a, c, g, or t
tcagactgtacagtcacgaccggtgctcgatttagtgctatagacttggggtttgggagaagaacctactatgcagactctgtgaagggtcgattcaccacctccagagacaacatcaagaactccctgtatctgacaaatggacagtctgacacctgatcgacaccgcttgtattatgtgtagaaggtcgtgttggagtgatgccgtacggaccccgtggcagctactacttcacgagttgggcgtcggtacggggacgaaaacgggtacgtacggtactacgtcgttcctcctacnccgtccctacccgaaccggaaccggtcccctacgttcccggttcccttacccccgtcggccccgtccctcgcgtacccgaggaccncccgacctcggacgacgaccaacgccggtccggcccggtggtcccgtccggtcggtacggtacctaacggtaacttaccgttaccgtcttaccggtactcgttcgaggacggccgggtcgtacggcggtacgacggactagcggnnnnnngncnnnnnncnnnnnnnnnnnnnnnnnnnnnnn

SEQ ID NO: 20087 - DNA, 614 bp, Homo sapiens
  misc_feature: GYAE6OF02I4C7Q.25.86.H09.1.454.CMB.1.raw
  modified_base (215)..(215): a, c, t, g, unknown or other
  misc_feature (215)..(215): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
  modified_base (578)..(578): a, c, t, g, unknown or other
  misc_feature (578)..(578): n is a, c, g, or t
  modified_base (580)..(586): a, c, t, g, unknown or other
  misc_feature (580)..(586): n is a, c, g, or t
  modified_base (588)..(602): a, c, t, g, unknown or other
  misc_feature (588)..(602): n is a, c, g, or t
  modified_base (604)..(614): a, c, t, g, unknown or other
  misc_feature (604)..(614): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatagacagtctgacacctgatgacaccgccttgtattatgtgtgaaggcggtgtgaggtgatgcctcggaacccccgnggtcagccgacttacttccgtactagtcgggccgttcgtagggggacaaaggggtacgttacggtaccgtattccggtaccttccctctaacggtccccttacccgaacccgaaacggggcccctacgttcccgggttccttttcccccccgnggccccgtcccgttccgcctaacccggnggacgtacccnccgttaccgacgacgccaacgccggcccgggcccggtgggtaccgtcccggtcccggttacgtaccggaaacggttcccttaaaccgttccgtacccgttcgttaaccgtacggtaccgttagggaccggtccggggacgtcgggaccctaacggcgaccgtaacgtcgancnnnnnnncnnnnnnnnnnnnnnngnnnnnnnnnnn

SEQ ID NO: 20088 - DNA, 818 bp, Homo sapiens
  misc_feature: GYAE6OF02GWQQO.25.86.H09.1.454.CMB.1.raw
  modified_base (106)..(106): a, c, t, g, unknown or other
  misc_feature (106)..(106): n is a, c, g, or t
  modified_base (152)..(152): a, c, t, g, unknown or other
  misc_feature (152)..(152): n is a, c, g, or t
  modified_base (172)..(172): a, c, t, g, unknown or other
  misc_feature (172)..(172): n is a, c, g, or t
  modified_base (201)..(201): a, c, t, g, unknown or other
  misc_feature (201)..(201): n is a, c, g, or t
tcagactgtacagtcacgaccggtgctcgatttagtgctatagacttgggtttgggggcaggagtcagacccactcaggacacagcatggacatgagggtccccgntcagctcctggggcttctgctgctctggctccaggtgccaaatgtnccatccagttgacccagtcnccatcctcctgtctgcctcttgtcatacntacgtcactatcacttgtcggcttagtcgggtcagttcggactaggtgttctttacggtccttagggtatacgaagtaccgaaacggaaaccgtagggggaaatccgtaccgtaaacggcttcctagtacttcgtttagtactcgtaccttcgtagtttagggaacgtcggtactacccgtaacgttaccggtaaagggttctaacgggacgggtacgtacggttaacgggtacgttaccggttacggggtaacccgtagggtttaaactttttaccggtaaacctttcccggtttaaacccacccgtaaacgttcccgtaaaacgtacccgttaaccggacccttaacgggacccgtaaaccgttaccggtaacgtaaaccggttaactttccggtaactacccgtttaaacctttctttaaccgtttacggtaaacttaaccgttttaaaagttaaccggtttaaccttaacccggtttcccttaccgggtttccctaacgggggttacgggtaaccccggggtaacggtaacgggttaccgggtaacgttaaccggaaacgttaaaccgggaaacgtttcggaccgttacgggccttaacgtcctttaaccggg

SEQ ID NO: 20089 - DNA, 572 bp, Homo sapiens
  misc_feature: GYAE6OF02IMF6S.25.86.H09.1.454.CMB.1.raw
  modified_base (155)..(155): a, c, t, g, unknown or other
  misc_feature (155)..(155): n is a, c, g, or t
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (259)..(259): a, c, t, g, unknown or other
  misc_feature (259)..(259): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (354)..(354): a, c, t, g, unknown or other
  misc_feature (354)..(354): n is a, c, g, or t
  modified_base (515)..(515): a, c, t, g, unknown or other
  misc_feature (515)..(515): n is a, c, g, or t
  modified_base (523)..(523): a, c, t, g, unknown or other
  misc_feature (523)..(523): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (535)..(536): a, c, t, g, unknown or other
  misc_feature (535)..(536): n is a, c, g, or t
  modified_base (541)..(545): a, c, t, g, unknown or other
  misc_feature (541)..(545): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (555)..(556): a, c, t, g, unknown or other
  misc_feature (555)..(556): n is a, c, g, or t
  modified_base (558)..(560): a, c, t, g, unknown or other
  misc_feature (558)..(560): n is a, c, g, or t
  modified_base (564)..(564): a, c, t, g, unknown or other
  misc_feature (564)..(564): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
tcagactgtacagtcacgaccggtgctcgatttagtgctatagacttgggttgggagaagaacctactatgcagactctgtggaagggtcgattcaccacctccagacgacaacatcgaaagtaacctccctagtactcgtgactaaatggaacngtctgaccacctgatcgaccaccgtcctttgtattattgtgtagaaggcggtgtgtaggtnatcggcctaccggaccccgngggtcagccacttacttcgacgngtcgggtctgacggggtacaaggggtacctggctacgtgtcctccgtacncgccgtaaccncggaacgcctcgtccgttccctcccgacggtccncccgtcggccttccggagtacgtccgaccgcgtacgacaccgtcgacggtcccggaccgtggtaccgtcgtccggtcgaccgtaaccgtacttaaccgtccgtacgtacggtctaacggtacgtcggaggtccgcggtacggcgacgtcgaactcggtacngtgcagcntgnccancnncnncgtannnnncgngcngtcnntnnncgcnctgncncn

SEQ ID NO: 20090 - DNA, 814 bp, Homo sapiens
  misc_feature: GYAE6OF02FWIXR.25.86.H09.1.454.CMB.1.raw
tcagactgtacagtcacgaccggtgctcgatttagtgctatagacttgggtttgggggagtcagacccactcaggacacagcatggacatggacgggtccccgctcagctccgtggggcttctgctgctctggctcccaggtgaccaaatgtcgccatccagttcgaccctagtcctccatccctccctgtctcgcctctcgttcgagacatacgtcaccatctacttggtcggctaggtcggtactagttcggctagtcgtctttacggcctaggtatcagacaacggaaaccgaggggtaacgcctaccgtaacgtctccgtagtacgttcgtttagactcgtacccgttaccgtaagggttttacggaaaaggttcggtaaccggtacccaagttaaccgtaaacggttacgaacggccgggtacgtagggtacggtaacgttaccggtacggggtaacctaagttaccgttttacaacctttccccgtactaaacccgtaacttaccgaacggtcgtaaccggtcccgtacggtaccctaccggtacccgtacggtaaacgttacgttaccgtacgtaaccctaaaccgtttacgttttaacttaccggtaaaccttaaaacgtttaaaccgttttaaacggtttaacccttttaaccccgttcctttaacccgtttaccggttaaccgggtaaccggggtaacgggtaacccggttaacggggtacggtaacgtaaccgtaaaccggtaaaccgtaccggttaggtaccggtacgtccgttaaaccctacggttaacttccgttaaccg

SEQ ID NO: 20091 - DNA, 535 bp, Homo sapiens
  misc_feature: GYAE6OF02JJAM8.25.86.H09.1.454.CMB.1.raw
  modified_base (213)..(213): a, c, t, g, unknown or other
  misc_feature (213)..(213): n is a, c, g, or t
  modified_base (311)..(311): a, c, t, g, unknown or other
  misc_feature (311)..(311): n is a, c, g, or t
  modified_base (507)..(535): a, c, t, g, unknown or other
  misc_feature (507)..(535): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatcttcaaatggacagtctgacacctgatgacaccgccttgtattattgtgtgaaggcggtgttgagtgaatgctcggaccccnggtcagcactacttctacatggctcgtggggcaaagggctacggtcagtcgtctctcacgcctccacaacgggcctactccggttccttaccccccgnggcccgccccgtgaccgttcccgaaggccgaccgacccgttccggaggacgccgaacgtacgggccccggacccgtgggtccgtccggtccgtacggggtactaaaccggggtccttacccttacccgcgttaacgtccgcggttacgtcggacgggtcgggcgtccgggcgtaaacgggccgataagtggatcgnnnnnnnnnnnnnnnnnnnnnnnnnnnnn

SEQ ID NO: 20092 - DNA, 688 bp, Homo sapiens
  misc_feature: GYAE6OF02GKYTK.25.86.H09.1.454.CMB.1.raw
  modified_base (445)..(445): a, c, t, g, unknown or other
  misc_feature (445)..(445): n is a, c, g, or t
  modified_base (461)..(461): a, c, t, g, unknown or other
  misc_feature (461)..(461): n is a, c, g, or t
  modified_base (525)..(525): a, c, t, g, unknown or other
  misc_feature (525)..(525): n is a, c, g, or t
tcagactgtacagtcacgaccggtgctcgatttagtgctatagacttgggtttgggggcgaggagtcagacccactcaggacacagcagtggacatgacgggtccccgctcagctccgtggggcttcgtcgcctgccttcgtcggtcctccccgagggttcgaccctaaaagttcggtcgaccctaatccctaaggttccaccccgtaggttcctccaccgttccctccctggtctaccgtcctcgtagttcgacgctaatcgccgtacatcctacgtggtcggacttgggtcggtctagttcggactgtcgtacttacgcttgtacgtctagacaacgaaccggagggagtacctacaacggcttccgtatcttcgttgtagtccgtccgtaagttacgttaggtaacggttcggaccgttactacgtacgtacgttcgaacgnggtccgaggtagtacngtacggacgtactcgttgaccctctactaccgtctacgctacgacgtgaccgtccgcgacgtanacgttattccgtatacccgtaattaacttagttaccaacttaacgttaacgtttaacccgttcgttaacctccgttacgtttaccgtccggtacggtacggaacggttaccggagtaacgtacgtacgtaaccggtagtaaccgtggactgtacctagtaccg

SEQ ID NO: 20093 - DNA, 882 bp, Homo sapiens
  misc_feature: GYAE6OF02FI2UI.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctccgtggggcttctgctgctctggctcccaggtgccaaatgtgccatccagttcgacccagtcctccatccctccctgtctcgcctctgttcgagactagtcgtaccacctatcctacgttggtcgggcttaggtccgggtactagttcggctaggtcgtctttacgcccttggtactcgacgtcaacggaaaccgagggggaactccgtaccctaaggtcttccgtagtattcttagtactcgcccttacgtaggtttacggaaagttcggacgttcccgatacgtaaccgggttcgacggtaccgggtacagggtaggtacgtccggtacgggggtaactacgtttactttacgtaccgttacccgtacctaaccgtataccgacgtccggtaccgtacgtacggtaccgtaacggtccttaacggggaaatttaccggttacccgttacgtaacccgtttaaaccgtttacttttaacgggtttaccggtttaaacccgtaaaaacgtttttaaaaccggtttttaaaacccggttaacctttttaaccccccgttttaacccggtttacccccggtttaccccggtttaacccgggggggttaacccggggtaaacccggggggtttaacccggggttaaacggggttaacccgggtaaaggtttaaaccccggtaaaccggttaaacccgggttaacggttttaccggggttaaacccgggttcccggtaacccgggttaacccccttaccggttttaaacccggg

SEQ ID NO: 20094 - DNA, 515 bp, Homo sapiens
  misc_feature: GYAE6OF02F36U2.25.86.H09.1.454.CMB.1.raw
  modified_base (343)..(343): a, c, t, g, unknown or other
  misc_feature (343)..(343): n is a, c, g, or t
  modified_base (477)..(477): a, c, t, g, unknown or other
  misc_feature (477)..(477): n is a, c, g, or t
  modified_base (480)..(486): a, c, t, g, unknown or other
  misc_feature (480)..(486): n is a, c, g, or t
  modified_base (488)..(515): a, c, t, g, unknown or other
  misc_feature (488)..(515): n is a, c, g, or t
tcagactgtacagtcacgaccggtgctcgatttagtgctatagactttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggttgttgaggtagaatgcctcggaacccccgcggtcagcactacttctacagtggcgtcgtggggacgaaacgggacgacggtcatccgtcctccttcacgcctaccccaccgaacgggaccccatcggtccttcccccgtggccgcccgttnccgtccgaggacgccacctccggagacgcaccgacgccggccctgggctcgtccctggtcaaacgggtaccttaccgtcctacgtcgtaacctggtactggacggcgggtctgggcaacgggccacgtagtcgncgnnnnnnngnnnnnnnnnnnnnnnnnnnnnnnnnnnn

SEQ ID NO: 20095 - DNA, 800 bp, Homo sapiens
  misc_feature: GYAE6OF02IXZVZ.25.86.H09.1.454.CMB.1.raw
  modified_base (125)..(125): a, c, t, g, unknown or other
  misc_feature (125)..(125): n is a, c, g, or t
  modified_base (329)..(329): a, c, t, g, unknown or other
  misc_feature (329)..(329): n is a, c, g, or t
  modified_base (365)..(365): a, c, t, g, unknown or other
  misc_feature (365)..(365): n is a, c, g, or t
  modified_base (494)..(494): a, c, t, g, unknown or other
  misc_feature (494)..(494): n is a, c, g, or t
tcagactgtacagtcacgaccggtgctcgatttagtgctatagactttgggtttgggggcaggagtcagacccactcaggacacagcatggacatgagggtccccgctcagctcctggggcttcngctgctctggctcccaggtcgaccaaattgtgccatcccagttgacccagtctccatcctaccctgtctgccttctcggttcgagactatagactaccatactacttcggtcgggtacgtacggttcgggactagttcggctaggtgtacgttttacggccgttaggtactacgacgacgtaaacggaaaacggaggggtaacnccttaaccgtacgtctccgtagtactttctttacgnttccgccttaccgttaagggtttagggaaacggttcggtaacctacccgtaattaacgggtaacggttccgaacggtaccggtagtacgggttacgtaaacggttcgtaaccgggtaaacaacggtttntttaacccggtattacccgtaccgtaacgtaaccgtaaccgaacgtccgtaacggttcctaacggtaccgtacggttaccgtaacgttaagttaactttacgtacgtaacctttaacttacgtttaagttaccgttaataaacgtttaacgtttaacgtaaccctttacgtttacccgttaccgttccgggttaaccggacggggtaacgtaacccgggtaacgggtttacggaacggtaaaccgtaaaccgtaaaccgggttacgttacgggttaaccgtaccgtcgtaaccgtacccggttacg

SEQ ID NO: 20096 - DNA, 701 bp, Homo sapiens
  misc_feature: GYAE6OF02F61HT.25.86.H09.1.454.CMB.1.raw
  modified_base (357)..(357): a, c, t, g, unknown or other
  misc_feature (357)..(357): n is a, c, g, or t
  modified_base (559)..(559): a, c, t, g, unknown or other
  misc_feature (559)..(559): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagcttgggttttccttgtgcctattttaaaggtgtccagtgtgaagtgcaactggtggagtcgtgggggagccgtggtacacgggccgggggggtcctaggacgacttctcctgtgtagcctcgtggattcattgttcgattggatttagtcgcctatcgactacgtcggtccgtacgtacgggtccggggaaggtcgtggacggtggtctcgttntagtgtacgttgggagtcgggaataacggtaacctactacgtgactagtactcgtgtacggtaacgggtactacttaccgaacctacctaccgtaacggtacgaacctaactaataccgaaacgtaccgtcccgttaacgttacgtacgttcgtaacgtaacgtacggtaaccgtacgttaccgtacgtacctaccggtaanacgttaaccggacccgtaccggttacctttacgttatttaccggttagtacggtaacggtaaacgggtcggttaccggttaggtacggttaagtaccgtccggtacccggtacccggtacccccggtaggtccgtaacccgg

SEQ ID NO: 20097 - DNA, 505 bp, Homo sapiens
  misc_feature: GYAE6OF02G7XDA.25.86.H09.1.454.CMB.1.raw
  modified_base (199)..(199): a, c, t, g, unknown or other
  misc_feature (199)..(199): n is a, c, g, or t
  modified_base (217)..(217): a, c, t, g, unknown or other
  misc_feature (217)..(217): n is a, c, g, or t
  modified_base (456)..(456): a, c, t, g, unknown or other
  misc_feature (456)..(456): n is a, c, g, or t
  modified_base (478)..(479): a, c, t, g, unknown or other
  misc_feature (478)..(479): n is a, c, g, or t
  modified_base (481)..(505): a, c, t, g, unknown or other
  misc_feature (481)..(505): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattatgtgtgaaaggcggtgttgaggtnaatgcctggaacccccgngtcagcactactcacatgggcgtcgtggggacaaagggactacggtcatccgtctcctcacgcctccaaccgagggcccctagtccggtcccttccccccgtgggcccgcccgttcgccgtcccgaagggacgtcccgaccctcccggagacgccacgacggcggccccgtggggcctccgccgttggtaccgtaaagccttaaccttccactacgtaacacgtcgagacggtccgggntacggacgaaggtccacagtgnngnnnnnnnnnnnnnnnnnnnnnnnnn

SEQ ID NO: 20098 - DNA, 496 bp, Homo sapiens
  misc_feature: GYAE6OF02GGX41.25.86.H09.1.454.CMB.1.raw
  modified_base (387)..(387): a, c, t, g, unknown or other
  misc_feature (387)..(387): n is a, c, g, or t
  modified_base (469)..(496): a, c, t, g, unknown or other
  misc_feature (469)..(496): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaaatggacagtctgacacctgatgacaccgccttgtattattgtgtagaaaggcggtgttgaggtgaatgcctcggaacccccgcggtcagcactacttctacagtgggctcgtggggacaaagggactacggtcatcgtctcctcacgcctccaccgaacgggcccagttccggttccttcccccgtggcccgtcccttgcctccgaaggacgacccaccgtccggagacgaccacgtacgccggtccgngggctcgccgtggtacgaacggtacctaccttcacgtgtacagtccgtgagggcgggctaggcgaaaggctcaagtagcagnnnnnnnnnnnnnnnnnnnnnnnnnnnn

SEQ ID NO: 20099 - DNA, 856 bp, Homo sapiens
  misc_feature: GYAE6OF02FJ4RW.25.86.H09.1.454.CMB.1.raw
tcagactgtacagtcacgaccggtgctcgatttagtgctatagacttgggtttggggagctctgggaaaggagccccagccctgagattccccaggtgattccattcggtgatcagcactgaacacagaactcaccatggagtttggactgagcttgggttttccttgttgcctaattttaaaaggtgtccagtgtgaagtgacaacgtggtggagtcgtgggggagccgtggtacgaggccggggggtcctgacgactcgtcctgtgtacgccgtgtggtactctagtttgttagtagtacgttattacgtcgacgtagtcgaccgttaccgggttccggggtccgtaacgggtacgggggtaccgggggtaacggtcgggtcggggttacgggttccgggttcgttccgtttaagttacggttacggttacgggttgggtaagggtaacggggtaaacgtaaaccgttaaaccgttacgttaacgtcgaaccgtaacgtcgttacggttagggtaacgggtacggtacttacccgtacccctaacccgtaccgtaaccgaacggaacctaacaaactacgtaaacgaaacccgttaccccttacgttaacgttaccgtaaactaccgtaaacgtacgtaccggtaacgttacgtacctaaccggtccctaaacggttactaaccggtacccgaaacccgttttcccggttacttttaagggttttaactttgggttaaccgggtttaagggaacgggggtttaaccgggttggtttaaggggtagggtttacggttaaagtcccggtaccccgggttaccccgacccccgggggtaacccgttgtaaccccggg

SEQ ID NO: 20100 - DNA, 904 bp, Homo sapiens
  misc_feature: GYAE6OF02IG6I0.25.86.H09.1.454.CMB.1.raw
  modified_base (163)..(163): a, c, t, g, unknown or other
  misc_feature (163)..(163): n is a, c, g, or t
  modified_base (359)..(359): a, c, t, g, unknown or other
  misc_feature (359)..(359): n is a, c, g, or t
tcagactgtacagtcacgaccggtgctcgatttagtgctatagacttggggtttgggggcaggagtcagacccactcaggacacagcatggacatggacgggtccccgctcacgctccgtggggtcttctgctgctcgtcgcctccgagtcgactaagtgtcnctactcgtagtacgacctagtcctacctacgttccctcccgtcgttctccgtcctttacggttcgttacggacgacctaagttaccgtacctacctacgtccgttacggttcggggtccgggtaacgttccggggtccgggttactacggttcggtccgtaggtttccgttaccggtttacgtccggttagtaacnccggtaacgaaaccggtaaccgggaaacggggtaacgggtactaaccccgtttaccgaaccgtccgttccgtacgtttacttccggtttacggcggttaccccgtttacccggttaaggttaacggggttaaccgggtaaacgggggtttaaccggtaccccttaacgggttaaccgtaaccgggtttaaccgggaccgggtcggttaacgggtcgtacgggtaacggtaccgggtagggttaacgaacggttaacgtttccgttaacccttccgtacctacccgtaactaccgaccgtacgtaccgtccgttacggaccgtacgaccggttaccgtaagtacgttactaccgtaactacgtttaacttagtttactacgtaacgtttaacgttaacggttacctttaccgttcccgtaccttacccggggttaccgggtaaggtacccgggtaacgggtacggtaaccggggtactaacccggtaaacgtaaccgttaacggttccgtacgggtacccgtacgtaccgtaccgttagttcccgg

SEQ ID NO: 20101 - DNA, 451 bp, Homo sapiens
  misc_feature: GYAE6OF02I6X89.25.86.H09.1.454.CMB.1.raw
  modified_base (279)..(279): a, c, t, g, unknown or other
  misc_feature (279)..(279): n is a, c, g, or t
  modified_base (427)..(451): a, c, t, g, unknown or other
  misc_feature (427)..(451): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggtggtgttgaggtgaatgcctggaacccccgcggtcagcactacttctacatgggcgtctggggcaaagggactacggtcatcgtctcctcancctccaccaagggccccatcggtcttccccctggccgccctgctccaggagccacctccgagagcacacgccgccctgggctcgcctggtcaaggactacttccgactgtacagtctcggagcgggctcgggcaaggcgacagtagcnnnnnnnnnnnnnnnnnnnnnnnnn

SEQ ID NO: 20102 - DNA, 854 bp, Homo sapiens
  misc_feature: GYAE6OF02GO1QC.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctgctcccgaggtcgaccaaatgtcgccactccagttcgacccagtcctccactccctcctgtctcgcctctgtcgagacatacgtaccacctacttcctacgttcggtccgggtcgttacggtccgggtacgtagttcggcgtagttcgttacgtttacgccgttaggtactaccgacgaccgaaacggaaaacccggtaacggggtaaccgtacccgttacccgtaaccgtccgttaccgtacgtacgtttcgtttacggtcgtacgtaccccgttaccggttaacggtttaagggtaacggttacgggtaccgtacccgtaacgttaacggtaacggttacgacggtcgggtacgtacggttacggtacgttcgggtaacggtacgtacggttacgttacctacgttacccaccgtaccctagtaccgacgaccgtacgtccgtacgtaccgaaccgtcgtaacgtaacgttaccttacggttaccgtaaccttaaacgttagtttaacctaaccgttaacgttaaacgtttaaagtttaacccgttaacctttccccgttaccgtttaccccgggtttaccgggtaacccgggggtaccggtaacccgggtaacgggttaaccggggtaacggtaaaccgttaacccggttaaacgtaacccgggtttaacggttccggttaaccgggtaccggttacccttaccgttaccgttaacccg

SEQ ID NO: 20103 - DNA, 815 bp, Homo sapiens
  misc_feature: GYAE6OF02INT8B.25.86.H09.1.454.CMB.1.raw
tcagactgtacagtcacgaccggtgctcgatttagtgctatagactttgggtttgggggcaggagtcagacccactcaggacacagcatggacatgagggtcccgctcagctcctggggcttctgctgctctggctcccaggtgcctaaatgtgccactcctagttcgacccagttcctccattccctcccttgttcgtcgcccttcgtcgttccgagactatacgtccacgtacttcctaacgtttcgggtccgggtacttacgggttcgggtacgtagtttcggacgtacggttcggtacgtttaacgtccggttaggttaccttacgacgtacgtaacggaaaaccggtagggtaaacgtccttaacccggtaacgtccgttacgtcgttacgttcttacgtcgtacgtacccgtacttacgggttacgtaaggtacgtaccgacctagtacgtaacggtttacgagacgtacgtacggtacgtacgtcgtacggaattcgttatttaccgtacgttcctaccggtacctactacggtactacggtacgtccgttacgtaccgaccgttaaccgttaacgggtaacttacgttacttaaccggactttaaacccgttaacttaccggtttaacgttaaccgttaaacgttaagtttacccgttaaaccgtttacccgttaccttcccgggtacggtttaccgggtacggggtaacccgttaacggtacggtaaccggttaacggtaaaccgtaaccgttaaaacggtccgttacgggttaccggtacgtttaaccggacccgttagtacccg

SEQ ID NO: 20104 - DNA, 904 bp, Homo sapiens
  misc_feature: GYAE6OF02F4OAE.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtcctccactcctccctgtctgcctctgtcgagactatacgtcacctatcacttggtcgggcttaggtcgggtctagttcggacaggttgtacctttacggcccttagggtacttcgagtaccgaaacggaaaacccggaaggggggaaactccgttacccttaaaggtcccgttaccccgttagggtaacttttccgtttttaggaacgtttccggtacccccgtttacccgttaaagggtttttaacgggggtaaaaacgggtttcggggtaaccggttacccccgtaaagtttaacccgggtaaaaccgggtttttaccgaacggggtacccgggtaccggtaaggggtttacgggtacgttccggtaacgggggtaaacctaacgggtttaactttttacccgaacgttttcccctaaccggtaacccttaaacgtaccgtaaacgtccgtaaaccggtccgttacggacctaccggtacccgttaaggaaaccgtttacgttaccgtacgtaacccttaaactttagtttaacgttacgtaaccgttaaaacgtttaaggtttaaccggtttaccttttacccgtaccttttaccccggtttaaccgggttccgggacggggtaaccgggaaccggttaaacggggttacggaaacgttaaccgtaaccggaaaaaccgttcggttcgggtaacggtacccggtaaccgtacccgtaccgtttaaccgg

SEQ ID NO: 20105 - DNA, 796 bp, Homo sapiens
  misc_feature: GYAE6OF02IOQNU.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggcctccgaggtgaccaatgtgccatcccagttcgacccagtcctccactccctccctgtcctcgtcctgttcgttcgagactatacgtcacctatctacgttggtcgggcttacggtcgggtactagttcggcgtacgtcgttacgtttacgccgttggttactcgaacgacaaacggaaaccggtaggggaactaccttaccgtaacgtccttaccgttaggtaacttttacctttacgtccgtacccgttaccgttaggttaggaaaccggttcggtaactaccccttaggtaccgtaacggttcgaaccggtcgtaccgtaggtacggtagttaccgggtaacggtactacggttaccgtttaccacgttaccctaaccgtactaccgtacgtacgtacgtaccggtcctacggacctaccggtactacggtaaacgttccgttacgttaaccgtaacttaacgttacgtttaacgtaaccgttaaacttaaaccggttaacgtttaaccggtaacccttttacccgtaccgtttacgtaacccgggtacgggtacccgggtaacggttacggtaacgggtacgtaacgttaaccgtaaaccgttaacggtaccggtttacgggtaccgtacctaccggtaccgtaccgttacttaccgg

SEQ ID NO: 20106 - DNA, 930 bp, Homo sapiens
  misc_feature: GYAE6OF02H7T43.25.86.H09.1.454.CMB.1.raw
  modified_base (210)..(210): a, c, t, g, unknown or other
  misc_feature (210)..(210): n is a, c, g, or t
  modified_base (337)..(337): a, c, t, g, unknown or other
  misc_feature (337)..(337): n is a, c, g, or t
tcagactgtacagtcacgaccggtgctcgatttagtgctatagacttgagctctgggaaaggagccccagccctgagattcccaggtgattccattcggtgatcagcactgaacacagaactcaccataggagtttggactgagcttggttttccttgttgcctaattttaaaggtgtaccagtgtgaagtgcaacgtggtggagtcggngggggacgccggtaggtaccgacggggtcccggggggtccccttggacgaccttccgttccgtaggttgtacgtccttacgtaggtattccgttagttagtttgattaggtaattagtcgacctacncggtacctaccggttcggtacccggtaacggtaacgggggttaccgggggtaagggttccggtagggtacggtttcgggttcccgtttacgttacgtttacggtaggttacccggttaggggtagggtaacggaaccggtaaaacggtaaccgttaccggtttagaccggtaactaccggttacttaccgggtggtaaaccgggtagggtacctaccgtacccgttaacccaaccgttccgaacggaaacgtaacctaaacaacgtacctaaaccgtacccgttaacccgttagttaaccgttacctaacggtaacgtaaacgttacgaaccgttacgtaccgaaccgttaacccgtacggttaaaccctacggttaaccctaacccgggttaacccgtttccgtttttaaacggggtttaatttttaccggtttagggtttaacgggttaaaacggggttaacgggggtttaccggggtttaaccgggtttagggggttaaaacggtttcccgggttaaacggtcccccgggttaccccgggttaacccccggggtaacccccggtttacccgggaacccgtttaacccggg

SEQ ID NO: 20107 - DNA, 276 bp, Homo sapiens
  misc_feature: GYAE6OF01EP606.42.78.H01.1.454.CMB.1.raw
  modified_base (255)..(276): a, c, t, g, unknown or other
  misc_feature (255)..(276): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnnnnnnnnnnnnnnnnnn

SEQ ID NO: 20108 - DNA, 254 bp, Homo sapiens
  misc_feature: GYAE6OF01BR1TU.42.78.H01.1.454.CMB.1.raw
  modified_base (254)..(254): a, c, t, g, unknown or other
  misc_feature (254)..(254): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagn

SEQ ID NO: 20109 - DNA, 256 bp, Homo sapiens
  misc_feature: GYAE6OF01B2XMV.42.78.H01.1.454.CMB.1.raw
  modified_base (254)..(256): a, c, t, g, unknown or other
  misc_feature (254)..(256): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnn

SEQ ID NO: 20110 - DNA, 219 bp, Homo sapiens
  misc_feature: GYAE6OF01CMS83.42.78.H01.1.454.CMB.1.raw
  modified_base (219)..(219): a, c, t, g, unknown or other
  misc_feature (219)..(219): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagn

SEQ ID NO: 20111 - DNA, 220 bp, Homo sapiens
  misc_feature: GYAE6OF01D38IV.42.78.H01.1.454.CMB.1.raw
  modified_base (218)..(220): a, c, t, g, unknown or other
  misc_feature (218)..(220): n is a, c, g, or t
tcagtgacgtatgtcacgaccggtgctcgatttagtgtgagtagtttgggtttgggccagggaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnnn

SEQ ID NO: 20112 - DNA, 219 bp, Homo sapiens
  misc_feature: GYAE6OF01BCYFZ.42.78.H01.1.454.CMB.1.raw
  modified_base (218)..(219): a, c, t, g, unknown or other
  misc_feature (218)..(219): n is a, c, g, or t
tcagtgacgtatgtcacgaccggtgctcgatttagtgtgagtagtttgggtttgggccagggaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnn

SEQ ID NO: 20113 - DNA, 220 bp, Homo sapiens; identical to SEQ ID NO: 20111
  misc_feature: GYAE6OF01CCBFX.42.78.H01.1.454.CMB.1.raw
  modified_base (218)..(220): a, c, t, g, unknown or other
  misc_feature (218)..(220): n is a, c, g, or t

SEQ ID NO: 20114 - DNA, 255 bp, Homo sapiens
  misc_feature: GYAE6OF01C7Y1G.42.78.H01.1.454.CMB.1.raw
  modified_base (254)..(255): a, c, t, g, unknown or other
  misc_feature (254)..(255): n is a, c, g, or t
tcagtgacgtatgtcacgaccggtgctcgatttagtgtgagtagtttgggtttgggtaccggttgctaccggacgagttttactcctggggccagggaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnn

SEQ ID NO: 20115 - DNA, 255 bp, Homo sapiens
  misc_feature: GYAE6OF01BIK3U.42.78.H01.1.454.CMB.1.raw
  modified_base (254)..(255): a, c, t, g, unknown or other
  misc_feature (254)..(255): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnn

SEQ ID NO: 20116 - DNA, 281 bp, Homo sapiens
  misc_feature: GYAE6OF01BSU9G.42.78.H01.1.454.CMB.1.raw
  modified_base (220)..(220): a, c, t, g, unknown or other
  misc_feature (220)..(220): n is a, c, g, or t
  modified_base (254)..(281): a, c, t, g, unknown or other
  misc_feature (254)..(281): n is a, c, g, or t
tcagtgacgtatgtcacgaccggtgctcgatttagtgtgagtagtttgggtttgggtaccggttgctaccggacgagtttgactcctgggccagggaacctggtcaccgtctcctcagcttccaccaagggcccatcggtcttcccctggcgccctgctccaggagcacctctgggggcacagcggccctgggctgcctggtcaaggactactttccacngtacgtcactgagcgggctggcaaggcgcatagnnnnnnnnnnnnnnnnnnnnnnnnnnnn

SEQ ID NO: 20117 - DNA, 221 bp, Homo sapiens
  misc_feature: GYAE6OF01BJ2GX.42.78.H01.1.454.CMB.1.raw
  modified_base (220)..(221): a, c, t, g, unknown or other
  misc_feature (220)..(221): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnn

SEQ ID NO: 20118 - DNA, 254 bp, Homo sapiens; identical to SEQ ID NO: 20108
  misc_feature: GYAE6OF01BRDT6.42.78.H01.1.454.CMB.1.raw
  modified_base (254)..(254): a, c, t, g, unknown or other
  misc_feature (254)..(254): n is a, c, g, or t

SEQ ID NO: 20119 - DNA, 223 bp, Homo sapiens
  misc_feature: GYAE6OF01CH5O7.42.78.H01.1.454.CMB.1.raw
  modified_base (219)..(223): a, c, t, g, unknown or other
  misc_feature (219)..(223): n is a, c, g, or t
tcagtgacgtatgtcacgaccggtgctcgatttagtgtgagtagtttgggtttgggccagggaaccctggtcaccgtctcctcagcttccaccaagggcccatcggtcttccccctggcgccctgctccaggagcacctctggggcacagcggccctgggctgcctggtcaaggactacttccacatacgtcactgagcgggctggcaaggcgcatagnnnnn

SEQ ID NO: 20120 - DNA, 256 bp, Homo sapiens; identical to SEQ ID NO: 20109
  misc_feature: GYAE6OF01DQY7U.42.78.H01.1.454.CMB.1.raw
  modified_base (254)..(256): a, c, t, g, unknown or other
  misc_feature (254)..(256): n is a, c, g, or t

SEQ ID NO: 20121 - DNA, 257 bp, Homo sapiens
  misc_feature: GYAE6OF01EGZ2J.42.78.H01.1.454.CMB.1.raw
  modified_base (255)..(257): a, c, t, g, unknown or other
  misc_feature (255)..(257): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnn

SEQ ID NO: 20122 - DNA, 252 bp, Homo sapiens
  misc_feature: GYAE6OF01CITBY.42.78.H01.1.454.CMB.1.raw
  modified_base (223)..(252): a, c, t, g, unknown or other
  misc_feature (223)..(252): n is a, c, g, or t
tcagtgacgtatgtcacgaccggtgctcgatttagtgtgagtagtttgggtttggggccgagggaaccctggtcaccgtctcctcagcttccaccaagggcccatcggtcttccccctggcgccctgctccaggagcacctcgtggggcacagcggccctgggctgcctggtcaaggactacttccacatacgtcactgagcgggctggcaagggcgcatagnnnnnnnnnnnnnnnnnnnnnnnnnnnnnn

SEQ ID NO: 20123 - DNA, 260 bp, Homo sapiens
  misc_feature: GYAE6OF01CPAWS.42.78.H01.1.454.CMB.1.raw
  modified_base (252)..(260): a, c, t, g, unknown or other
  misc_feature (252)..(260): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggccatcggtcttcccctggcgcctgctccaggagcacctctgggggcacagcggccctgggctgcctggtcaaggactacttccacatacgtcactgagcgggctggcaaggcgcatagnnnnnnnnn

SEQ ID NO: 20124 - DNA, 256 bp, Homo sapiens
  misc_feature: GYAE6OF01DXT11.42.78.H01.1.454.CMB.1.raw
  modified_base (255)..(256): a, c, t, g, unknown or other
  misc_feature (255)..(256): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnn

SEQ ID NO: 20125 - DNA, 223 bp, Homo sapiens
  misc_feature: GYAE6OF01AU5ME.42.78.H01.1.454.CMB.1.raw
  modified_base (220)..(223): a, c, t, g, unknown or other
  misc_feature (220)..(223): n is a, c, g, or t
tcagtgacgtatgtcacgaccggtgctcgatttagtgtgagtagtttgggtttggggccagggaaccctggtcaccgtctcctcagcttccaccaagggcccatcggtcttccccctggcgccctgctccaggagcacctctggggcacagcggccctgggctgcctggtcaaggactacttccacatacgtcactgagcgggctggcaaggcgcatagnnnn

SEQ ID NO: 20126 - DNA, 255 bp, Homo sapiens
  misc_feature: GYAE6OF01BJZXT.42.78.H01.1.454.CMB.1.raw
  modified_base (253)..(255): a, c, t, g, unknown or other
  misc_feature (253)..(255): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttcccctggcgccctgctccaggagcacctctgggggcacagcggccctgggctgcctggtcaaggactacttccacatacgtcactgagcggctggcaaggcgcatagnnn

SEQ ID NO: 20127 - DNA, 254 bp, Homo sapiens; identical to SEQ ID NO: 20108
  misc_feature: GYAE6OF01C4MNN.42.78.H01.1.454.CMB.1.raw
  modified_base (254)..(254): a, c, t, g, unknown or other
  misc_feature (254)..(254): n is a, c, g, or t

SEQ ID NO: 20128 - DNA, 257 bp, Homo sapiens
  misc_feature: GYAE6OF01AM16W.42.78.H01.1.454.CMB.1.raw
  modified_base (254)..(257): a, c, t, g, unknown or other
  misc_feature (254)..(257): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnn

SEQ ID NO: 20129 - DNA, 261 bp, Homo sapiens
  misc_feature: GYAE6OF01DWI0E.42.78.H01.1.454.CMB.1.raw
  modified_base (254)..(261): a, c, t, g, unknown or other
  misc_feature (254)..(261): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnnnn

SEQ ID NO: 20130 - DNA, 222 bp, Homo sapiens
  misc_feature: GYAE6OF01ARTJL.42.78.H01.1.454.CMB.1.raw
  modified_base (221)..(222): a, c, t, g, unknown or other
  misc_feature (221)..(222): n is a, c, g, or t
tcagtgacgtatgtcacgaccggtgctcgatttagtgtgagtagtttgggtttggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnn

SEQ ID NO: 20131 - DNA, 268 bp, Homo sapiens
  misc_feature: GYAE6OF01E0BDE.42.78.H01.1.454.CMB.1.raw
  modified_base (253)..(268): a, c, t, g, unknown or other
  misc_feature (253)..(268): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctggctgcctggtcaaggctacttccacatacgtcactgagcgggctggcaaggcgcatagnnnnnnnnnnnnnnnn

SEQ ID NO: 20132 - DNA, 280 bp, Homo sapiens
  misc_feature: GYAE6OF01EWH6O.42.78.H01.1.454.CMB.1.raw
  modified_base (256)..(280): a, c, t, g, unknown or other
  misc_feature (256)..(280): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagccttccaccaagggcccatcggtcttccccctggcgccctgctccaggagcacctctgggggcacagcggccctgggctgcctggtcaaggctacttccacatacgtcactgagcgggctggcaaggcgcaatagnnnnnnnnnnnnnnnnnnnnnnnnn

SEQ ID NO: 20133 - DNA, 256 bp, Homo sapiens; identical to SEQ ID NO: 20124
  misc_feature: GYAE6OF01A1O1E.42.78.H01.1.454.CMB.1.raw
  modified_base (255)..(256): a, c, t, g, unknown or other
  misc_feature (255)..(256): n is a, c, g, or t

SEQ ID NO: 20134 - DNA, 265 bp, Homo sapiens
  misc_feature: GYAE6OF01EKE2J.42.78.H01.1.454.CMB.1.raw
  modified_base (255)..(265): a, c, t, g, unknown or other
  misc_feature (255)..(265): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnnnnnnn

SEQ ID NO: 20135 - DNA, 263 bp, Homo sapiens
  misc_feature: GYAE6OF01EVBE2.42.78.H01.1.454.CMB.1.raw
  modified_base (153)..(153): a, c, t, g, unknown or other
  misc_feature (153)..(153): n is a, c, g, or t
  modified_base (254)..(263): a, c, t, g, unknown or other
  misc_feature (254)..(263): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaaggcccatcggtcttcccctggcncctgctccaggagcacctcgtgggggcacagcggcccgtgggctgcctggtcaaggactacttccacatacgtcactgagcgggctggcaaggcgcatagnnnnnnnnnn

SEQ ID NO: 20136 - DNA, 257 bp, Homo sapiens; identical to SEQ ID NO: 20128
  misc_feature: GYAE6OF01AHJ91.42.78.H01.1.454.CMB.1.raw
  modified_base (254)..(257): a, c, t, g, unknown or other
  misc_feature (254)..(257): n is a, c, g, or t

SEQ ID NO: 20137 - DNA, 270 bp, Homo sapiens
  misc_feature: GYAE6OF01DN7OU.42.78.H01.1.454.CMB.1.raw
  modified_base (255)..(270): a, c, t, g, unknown or other
  misc_feature (255)..(270): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnnnnnnnnnnnn

SEQ ID NO: 20138 - DNA, 266 bp, Homo sapiens
  misc_feature: GYAE6OF01ARKBD.42.78.H01.1.454.CMB.1.raw
  modified_base (255)..(266): a, c, t, g, unknown or other
  misc_feature (255)..(266): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnnnnnnnn

SEQ ID NO: 20139 - DNA, 278 bp, Homo sapiens
  misc_feature: GYAE6OF01CTRLB.42.78.H01.1.454.CMB.1.raw
  modified_base (200)..(200): a, c, t, g, unknown or other
  misc_feature (200)..(200): n is a, c, g, or t
  modified_base (273)..(278): a, c, t, g, unknown or other
  misc_feature (273)..(278): n is a, c, g, or t
tcagtgacgtatgtcacgaccggtgctcgatttagtgtgagtagtttgggtttgggtcagcctccctggccatcagtgggctccggtccgaggatgaggctgattattactgtgcagcagtgggatgacagcctgagtggtcatgtcttcggaactgggaccaaggtcaccgtctaggcacgcccaaggcccaaaccccntgtcactctcgttccccaccctcctacacgataccgtcacgtggacggcgggctggacaaggcacaataaggnnnnnn

SEQ ID NO: 20140 - DNA, 261 bp, Homo sapiens
  misc_feature: GYAE6OF01ENK4Q.42.78.H01.1.454.CMB.1.raw
  modified_base (256)..(261): a, c, t, g, unknown or other
  misc_feature (256)..(261): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctcgtgggggcacagcggccctgggctgcctggtcaaggactacttccacatacgtcactgagcgggctggcaaggcgcatagnnnnnn

SEQ ID NO: 20141 - DNA, 634 bp, Homo sapiens
  misc_feature: GYAE6OF01DO8IL.42.78.H01.1.454.CMB.1.raw
  modified_base (295)..(295): a, c, t, g, unknown or other
  misc_feature (295)..(295): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
tcagtgacgtatgtcacgaccggtgctcgatttagtgtgagtagtttgggtttgggtaccgttgctaccggacgagtttcgacctccgtgggcctagggaaccctggttcaccgttctcctcagcttaccaaccaagggcccatcggtctcccctggcgcctgctcgagagctaccttcgtggggcactagtacggcctgggctgccgtggtcaacggtacttacgttccgacgtacgtacggtccaccgtgggacgggccgggggtctcgggacgaacggcgtcctaagtaggngctcagagattagtagcctgatcaactggactccgtggccaacngacaggaggngngngngngtcgtgtagtntgngngagtgngcagtatagtatangacgacgacgtcgacggacgtacgtacgtacgtacgtacgtagacgtacgtaacgtacgaacgtacgtacgtacgtacgtactacgtacgagtacgtagacgtacgacgacgacgacgacgacgacgacgtacgtacgttacgtagttacgtagtacgtacgtagtacgtacggtacggtaccgggtaccggtaccggtacgtaccgtacgacggtacggacggacggacgtcgtcggtcg

SEQ ID NO: 20142 - DNA, 262 bp, Homo sapiens
  misc_feature: GYAE6OF01DTAT3.42.78.H01.1.454.CMB.1.raw
  modified_base (236)..(236): a, c, t, g, unknown or other
  misc_feature (236)..(236): n is a, c, g, or t
  modified_base (252)..(262): a, c, t, g, unknown or other
  misc_feature (252)..(262): n is a, c, g, or t
tcagtgacgtatgtcacgaccggtgctcgatttagtgtgagtagtttgggtttgggtacggtgctaccggacgagtttgactcctggggccagggaaccctggtcaccgtctcctcagcttccaccaaggcccatcggtcttcccctggcgccctgctccaggagcacctctgggggcacaggcggccctgggctgcctggtcaaggactacttccacatacgtcactgagcgggntggcaaggcgcatagnnnnnnnnnnn

SEQ ID NO: 20143 - DNA, 231 bp, Homo sapiens
  misc_feature: GYAE6OF01DE7BW.42.78.H01.1.454.CMB.1.raw
  modified_base (218)..(218): a, c, t, g, unknown or other
  misc_feature (218)..(218): n is a, c, g, or t
  modified_base (224)..(231): a, c, t, g, unknown or other
  misc_feature (224)..(231): n is a, c, g, or t
tcagtgacgtatgtcacgaccggtgctcgatttagtgtgagtagtttgggtttggggccagggaaccctggtcaccgtctcctcagcttccaccaagggcccatcggtcttccccctggccgccctgctccaggagcacctcgtgggggcacaggcggccctgggctgcctggtcaaggactacttccacatacgtcactgagcgggctggcaaggcncatagnnnnnnnn

SEQ ID NO: 20144 - DNA, 261 bp, Homo sapiens
  misc_feature: GYAE6OF01DX9YE.42.78.H01.1.454.CMB.1.raw
  modified_base (255)..(261): a, c, t, g, unknown or other
  misc_feature (255)..(261): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnnn

SEQ ID NO: 20145 - DNA, 255 bp, Homo sapiens
  misc_feature: GYAE6OF01DRVX7.42.78.H01.1.454.CMB.1.raw
  modified_base (186)..(186): a, c, t, g, unknown or other
  misc_feature (186)..(186): n is a, c, g, or t
  modified_base (223)..(223): a, c, t, g, unknown or other
  misc_feature (223)..(223): n is a, c, g, or t
  modified_base (226)..(255): a, c, t, g, unknown or other
  misc_feature (226)..(255): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggagcacctcgtgggggcacagcggccctgggctgcctggtcaaggctacttccanatacgtcacgtgagcggggtctggcaagggcgactanagnnnnnnnnnnnnnnnnnnnnnnnnnnnnnn

SEQ ID NO: 20146 - DNA, 263 bp, Homo sapiens
  misc_feature: GYAE6OF01B15E9.42.78.H01.1.454.CMB.1.raw
  modified_base (252)..(263): a, c, t, g, unknown or other
  misc_feature (252)..(263): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtctcccctggcgcctgctccaggagcacctctgggggcacagcggccctgggctgcctggtcaaggactacttccacatacgtcactgagcgggctggcaaggcgcatagnnnnnnnnnnnn

SEQ ID NO: 20147 - DNA, 282 bp, Homo sapiens
  misc_feature: GYAE6OF01BXP6C.42.78.H01.1.454.CMB.1.raw
  modified_base (267)..(282): a, c, t, g, unknown or other
  misc_feature (267)..(282): n is a, c, g, or t
tcagtgacgtatgtcacgaccggtgctcgatttagtgtgagtagtttgggtttgggtaccggttgctaccggacgagtttgactccgtggggccagggaaccctggtcaccgtctcctcagcttccaccaagggcccatcggtccttcccctggccgcctgctccaggacgcacctcgtgggggcacagccggcccgtgggctgcctggtcaaggactacttccactatacgtcactggaggcgggctaggacgaaggcgacatagnnnnnnnnnnnnnnnn

SEQ ID NO: 20148 - DNA, 282 bp, Homo sapiens
  misc_feature: GYAE6OF01BX0TF.42.78.H01.1.454.CMB.1.raw
  modified_base (150)..(150): a, c, t, g, unknown or other
  misc_feature (150)..(150): n is a, c, g, or t
  modified_base (162)..(162): a, c, t, g, unknown or other
  misc_feature (162)..(162): n is a, c, g, or t
  modified_base (168)..(168): a, c, t, g, unknown or other
  misc_feature (168)..(168): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (247)..(282): a, c, t, g, unknown or other
  misc_feature (247)..(282): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccacaaggccatcggtctcccctggcncctgctcaggancactgnggggcacagcggccctgggctgcctggtcaaggactacttccgacatacgtcactgagcgggntggcaaggcncatagnnnnnnnnnnnnnnnnnnnnnnnnnnnnnnnnnnnn

SEQ ID NO: 20149 - DNA, 343 bp, Homo sapiens
  misc_feature: GYAE6OF01CT6EN.42.78.H01.1.454.CMB.1.raw
  modified_base (199)..(199): a, c, t, g, unknown or other
  misc_feature (199)..(199): n is a, c, g, or t
  modified_base (302)..(343): a, c, t, g, unknown or other
  misc_feature (302)..(343): n is a, c, g, or t
tcagtgacgtatgtcacgaccggtgctcgatttagtgtgagtagtttgggtttgggtaccggttgctaccggacgagtttgactccgtgggccacgggaaccctggtcaccgtctcctcagccttccaccgaacgggccctattccggttccttcccccgtggcccgcccgtgcctaccgaggacgccaccgttccggngggggaccacgaggccggcccgtgggctcgccgtgggtacaacggtactaccttcacctatacgcagtcggacggcggccgtaggaccgaaggccgatagtgnnnnnnnnnnnnnnnnnnnnnnnnnnnnnnnnnnnnnnnnnn

SEQ ID NO: 20150 - DNA, 282 bp, Homo sapiens
  misc_feature: GYAE6OF01DJMEY.42.78.H01.1.454.CMB.1.raw
  modified_base (150)..(150): a, c, t, g, unknown or other
  misc_feature (150)..(150): n is a, c, g, or t
  modified_base (168)..(168): a, c, t, g, unknown or other
  misc_feature (168)..(168): n is a, c, g, or t
  modified_base (246)..(246): a, c, t, g, unknown or other
  misc_feature (246)..(246): n is a, c, g, or t
  modified_base (262)..(282): a, c, t, g, unknown or other
  misc_feature (262)..(282): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaaggcccatcggtccttccccnggcgcctgctccaggacncacctcgtgggggcacgagccggcccgtgggctcgccgtggtcaaggtacttacttccacatacgtcactgaggcggntggcaaggcgcatagnnnnnnnnnnnnnnnnnnnnn

SEQ ID NO: 20151 - DNA, 256 bp, Homo sapiens; identical to SEQ ID NO: 20109
  misc_feature: GYAE6OF02GSTYO.42.78.H01.1.454.CMB.1.raw
  modified_base (254)..(256): a, c, t, g, unknown or other
  misc_feature (254)..(256): n is a, c, g, or t

SEQ ID NO: 20152 - DNA, 219 bp, Homo sapiens
  misc_feature: GYAE6OF02HG4AN.42.78.H01.1.454.CMB.1.raw
  modified_base (217)..(219): a, c, t, g, unknown or other
  misc_feature (217)..(219): n is a, c, g, or t
tcagtgacgtatgtcacgaccggtgctcgatttagtgtgagtagtttgggtttggggaagaggaagactgacggtcctcccaggagttcaggtgctgggcaccttgggcacggggaggtgtgtcacaagatttgggctctgggcacagcggccctgggctgcctggtcaaggactacttccacatacgtcactgagcgggctggcaaggcgcatagnnn

SEQ ID NO: 20153 - DNA, 256 bp, Homo sapiens
  misc_feature: GYAE6OF02I1981.42.78.H01.1.454.CMB.1.raw
  modified_base (254)..(256): a, c, t, g, unknown or other
  misc_feature (254)..(256): n is a, c, g, or t
tcagtgacgtatgtcacgaccggtgctcgatttagtgtgagtagtttgggtttgggtaccggttgctaccggacgagtttgactcctgggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnn

SEQ ID NO: 20154 - DNA, 258 bp, Homo sapiens
  misc_feature: GYAE6OF02HAE0A.42.78.H01.1.454.CMB.1.raw
  modified_base (255)..(258): a, c, t, g, unknown or other
  misc_feature (255)..(258): n is a, c, g, or t
tcagtgacgtatgtcacgaccggtgctcgatttagtgtgagtagtttgggtttgggtaccgggttgctaccggacgagtttgactcctgggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnn

SEQ ID NO: 20155 - DNA, 257 bp, Homo sapiens; identical to SEQ ID NO: 20121
  misc_feature: GYAE6OF02ISNZD.42.78.H01.1.454.CMB.1.raw
  modified_base (255)..(257): a, c, t, g, unknown or other
  misc_feature (255)..(257): n is a, c, g, or t

SEQ ID NO: 20156 - DNA, 261 bp, Homo sapiens; identical to SEQ ID NO: 20144
  misc_feature: GYAE6OF02HUP20.42.78.H01.1.454.CMB.1.raw
  modified_base (255)..(261): a, c, t, g, unknown or other
  misc_feature (255)..(261): n is a, c, g, or t

SEQ ID NO: 20157 - DNA, 222 bp, Homo sapiens
  misc_feature: GYAE6OF02HV4I7.42.78.H01.1.454.CMB.1.raw
  modified_base (219)..(222): a, c, t, g, unknown or other
  misc_feature (219)..(222): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnnnn

SEQ ID NO: 20158 - DNA, 260 bp, Homo sapiens
  misc_feature: GYAE6OF02HTYJ6.42.78.H01.1.454.CMB.1.raw
  modified_base (255)..(260): a, c, t, g, unknown or other
  misc_feature (255)..(260): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnn

SEQ ID NO: 20159 - DNA, 256 bp, Homo sapiens; identical to SEQ ID NO: 20124
  misc_feature: GYAE6OF02HMWR2.42.78.H01.1.454.CMB.1.raw
  modified_base (255)..(256): a, c, t, g, unknown or other
  misc_feature (255)..(256): n is a, c, g, or t

SEQ ID NO: 20160 - DNA, 222 bp, Homo sapiens; identical to SEQ ID NO: 20157
  misc_feature: GYAE6OF02FWRIJ.42.78.H01.1.454.CMB.1.raw
  modified_base (219)..(222): a, c, t, g, unknown or other
  misc_feature (219)..(222): n is a, c, g, or t

SEQ ID NO: 20161 - DNA, 222 bp, Homo sapiens
  misc_feature: GYAE6OF02IBOCI.42.78.H01.1.454.CMB.1.raw
  modified_base (219)..(222): a, c, t, g, unknown or other
  misc_feature (219)..(222): n is a, c, g, or t
tcagtgacgtatgtcacgaccggtgctcgatttagtgtgagtagtttgggtttggggccaggaaccctggtcaccgtctcctcagcttccaccaagggcccatcggtcttccccctggcgccctgctccaggagcacctctggggcacagcggccctgggctgcctggtcaaggactacttccacatacgtcactgagcgggctggcaaggcgcatagnnnn

SEQ ID NO: 20162 - DNA, 256 bp, Homo sapiens; identical to SEQ ID NO: 20124
  misc_feature: GYAE6OF02GWF9Y.42.78.H01.1.454.CMB.1.raw
  modified_base (255)..(256): a, c, t, g, unknown or other
  misc_feature (255)..(256): n is a, c, g, or t

SEQ ID NO: 20163 - DNA, 221 bp, Homo sapiens
  misc_feature: GYAE6OF02FXLMA.42.78.H01.1.454.CMB.1.raw
  modified_base (218)..(221): a, c, t, g, unknown or other
  misc_feature (218)..(221): n is a, c, g, or t
tcagtgacgtatgtcacgaccggtgctcgatttagtgtgagtagtttgggtttgggccagggaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnnnn

SEQ ID NO: 20164 - DNA, 258 bp, Homo sapiens
  misc_feature: GYAE6OF02HGXEP.42.78.H01.1.454.CMB.1.raw
  modified_base (254)..(258): a, c, t, g, unknown or other
  misc_feature (254)..(258): n is a, c, g, or t
tcagtgacgtatgtcacgaccggtgctcgatttagtgtgagtagtttgggtttgggtaccggttgctaccggacgagtttgactcctgggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnn

SEQ ID NO: 20165 - DNA, 220 bp, Homo sapiens; identical to SEQ ID NO: 20111
  misc_feature: GYAE6OF02GE14M.42.78.H01.1.454.CMB.1.raw
  modified_base (218)..(220): a, c, t, g, unknown or other
  misc_feature (218)..(220): n is a, c, g, or t

SEQ ID NO: 20166 - DNA, 285 bp, Homo sapiens
  misc_feature: GYAE6OF02H3PGF.42.78.H01.1.454.CMB.1.raw
  modified_base (266)..(285): a, c, t, g, unknown or other
  misc_feature (266)..(285): n is a, c, g, or t
tcagtgacgtatgtcacgaccggtgctcgatttagtgtgagtagtttgggtttggggtaccggttgctaccggacgagtttgactcctggggccagggaaccctggtcaccggtctcctcagcttccaccaagggcccatcggtcttccccctggcgcctgctccaggagcacctcgtgggggcacaggcggccctgggctgcctggtcgaaggactacttccacgatacgtcacgtgaggccgggcgtggcgaaggcggcatagnnnnnnnnnnnnnnnnnnnn

SEQ ID NO: 20167 - DNA, 221 bp, Homo sapiens
  misc_feature: GYAE6OF02H284Z.42.78.H01.1.454.CMB.1.raw
  modified_base (219)..(221): a, c, t, g, unknown or other
  misc_feature (219)..(221): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnnn

SEQ ID NO: 20168 - DNA, 220 bp, Homo sapiens
  misc_feature: GYAE6OF02FR156.42.78.H01.1.454.CMB.1.raw
  modified_base (219)..(220): a, c, t, g, unknown or other
  misc_feature (219)..(220): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnn

SEQ ID NO: 20169 - DNA, 261 bp, Homo sapiens
  misc_feature: GYAE6OF02HZ07G.42.78.H01.1.454.CMB.1.raw
  modified_base (254)..(261): a, c, t, g, unknown or other
  misc_feature (254)..(261): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgcctgctccaggagcacctctgggggcacagcggccctgggctgcctggtcaaggactacttccacatacgtcactgagcgggctggcaaggcgcatagnnnnnnnn

SEQ ID NO: 20170 - DNA, 220 bp, Homo sapiens; identical to SEQ ID NO: 20168
  misc_feature: GYAE6OF02F6PCH.42.78.H01.1.454.CMB.1.raw
  modified_base (219)..(220): a, c, t, g, unknown or other
  misc_feature (219)..(220): n is a, c, g, or t

SEQ ID NO: 20171 - DNA, 257 bp, Homo sapiens; identical to SEQ ID NO: 20121
  misc_feature: GYAE6OF02IRILM.42.78.H01.1.454.CMB.1.raw
  modified_base (255)..(257): a, c, t, g, unknown or other
  misc_feature (255)..(257): n is a, c, g, or t

SEQ ID NO: 20172 - DNA, 221 bp, Homo sapiens; identical to SEQ ID NO: 20167
  misc_feature: GYAE6OF02GF2AI.42.78.H01.1.454.CMB.1.raw
  modified_base (219)..(221): a, c, t, g, unknown or other
  misc_feature (219)..(221): n is a, c, g, or t

SEQ ID NO: 20173 - DNA, 221 bp, Homo sapiens
  misc_feature: GYAE6OF02HSSI7.42.78.H01.1.454.CMB.1.raw
  modified_base (219)..(221): a, c, t, g, unknown or other
  misc_feature (219)..(221): n is a, c, g, or t
tcagtgacgtatgtcacgaccggtgctcgatttagtgtgagtagtttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatacgtcactgagcgggctggcaaggcgcatagnnn

SEQ ID NO: 20174 - DNA, 257 bp, Homo sapiens
  misc_feature: GYAE6OF02IFYYJ.42.78.H01.1.454.CMB.1.raw
  modified_base (254)..(257): a, c, t, g, unknown or other
  misc_feature (254)..(257): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggctacttccacatacgtcactgagcgggctggcaaggcgcatagnnnn

SEQ ID NO: 20175 - DNA, 251 bp, Homo sapiens
  misc_feature: GYAE6OF02FJAE0.42.78.H01.1.454.CMB.1.raw
  modified_base (251)..(251): a, c, t, g, unknown or other
  misc_feature (251)..(251): n is a, c, g, or t
tcagtgacgtatgtcacgaccggtgctcgatttagtgtgagtagtttgggtttgggtaccggttgctaccggacgagtttgactcctgggccagggaaccctggtcaccgtctcctcagcttccaccaaggcccatcggtcttccccctggcgccctgctccaggagcacctctggggcacagcggccctgggctgcctggtcaaggactacttccacatacgtcactgagcggctggcaaggcgcatagn

SEQ ID NO: 20176 - DNA, 552 bp, Homo sapiens
  misc_feature: GYAE6OF02GFHDW.42.78.H01.1.454.CMB.1.raw
  modified_base (283)..(284): a, c, t, g, unknown or other
  misc_feature (283)..(284): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (413)..(413): a, c, t, g, unknown or other
  misc_feature (413)..(413): n is a, c, g, or t
  modified_base (419)..(420): a, c, t, g, unknown or other
  misc_feature (419)..(420): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
tcagtgacgtatgtcacgaccggtgctcgattttagtgtgagtagtttgggtttggggggtaaccggttgctaccggacgtagtttgactcctgggggccagggaaccctggtcgaccgtctccgtcaagcttccaccaagggcccagtccgggtctttcccccctggccgccctgcctccaggagcacctctgggggcacgacgcgggcccctgggctgcctggtcaaggactacttcaccatacgtcactggaccggcgggctgggcaaggcgctattagnngngnactnanatgatatatgtatctgtatnanacacacagagacgaccactactcacncagagatatanacgcgcncgcggtcgacgacgtactctcgtcgctacacgtacgtcgacactcacgcctcncacacnngtcgcgtcgtcgngngngngntntatatatgtgcacgtacgacgacgacgacgagagagagatagtgtaggtcggtcggttaggtcggtacggtacggacggacgtacggtacggtacggtacgtacgtacg

SEQ ID NO: 20177 - DNA, 219 bp, Homo sapiens; identical to SEQ ID NO: 20110
  misc_feature: GYAE6OF02FJGC6.42.78.H01.1.454.CMB.1.raw
  modified_base (219)..(219): a, c, t, g, unknown or other
  misc_feature (219)..(219): n is a, c, g, or t

SEQ ID NO: 20178 - DNA, 220 bp, Homo sapiens
  misc_feature: GYAE6OF02IDFHM.42.78.H01.1.454.CMB.1.raw
  modified_base (219)..(220): a, c, t, g, unknown or other
  misc_feature (219)..(220): n is a, c, g, or t
tcagtgacgtatgtcacgaccggtgctcgatttagtgtgagtagtttgggtttgggccagggaaccctggtcaccgtctcctcagcttccaccaagggcccatcggtcttccccctggcgccctgctccaggagcacctctggggcacagcggccctgggctgcctggtcaaggactacttccacatacgtcactgagcgggctggcaaggcgcatagnn

SEQ ID NO: 20179 - DNA, 256 bp, Homo sapiens; identical to SEQ ID NO: 20124
  misc_feature: GYAE6OF02GMXUW.42.78.H01.1.454.CMB.1.raw
  modified_base (255)..(256): a, c, t, g, unknown or other
  misc_feature (255)..(256): n is a, c, g, or t

SEQ ID NO: 20180 - DNA, 252 bp, Homo sapiens
  misc_feature: GYAE6OF02G9B1N.42.78.H01.1.454.CMB.1.raw
  modified_base (224)..(252): a, c, t, g, unknown or other
  misc_feature (224)..(252): n is a, c, g, or t
tcagtgacgtatgtcacgaccggtgctcgatttagtgtgagtagtttgggtttgggggggaaaggagggaagactgacggtcctcccaggagttcaggtgctgggcaccttgggcacgggggagtgtgtccacaagatttgggctctgggcacagcggccctgggctgcctggtcaaggactacttccacatacgtcactgagcgggctggcaaggcgcatagnnnnnnnnnnnnnnnnnnnnnnnnnnnnn

SEQ ID NO: 20181 - DNA, 220 bp, Homo sapiens; identical to SEQ ID NO: 20168
  misc_feature: GYAE6OF02JDLGO.42.78.H01.1.454.CMB.1.raw
  modified_base (219)..(220): a, c, t, g, unknown or other
  misc_feature (219)..(220): n is a, c, g, or t

SEQ ID NO: 20182 - DNA, 221 bp, Homo sapiens
  misc_feature: GYAE6OF02JXLJ1.42.78.H01.1.454.CMB.1.raw
  modified_base (217)..(221): a, c, t, g, unknown or other
  misc_feature (217)..(221): n is a, c, g, or t
tcagtgacgtatgtcacgaccggtgctcgatttagtgtgagtagtttgggtttgggccagggaaccctggtcaccgtctcctcagcttccaccaaggcccatcggtcttcccctggcgccctgctccaggagcacctctggggcacagcggccctgggctgcctggtcaaggactacttccacatacgtcactgagcgggctggcaaggcgcatagnnnnn

SEQ ID NO: 20183 - DNA, 257 bp, Homo sapiens; identical to SEQ ID NO: 20121
  misc_feature: GYAE6OF02G27HH.42.78.H01.1.454.CMB.1.raw
  modified_base (255)..(257): a, c, t, g, unknown or other
  misc_feature (255)..(257): n is a, c, g, or t

SEQ ID NO: 20184 - DNA, 221 bp, Homo sapiens; identical to SEQ ID NO: 20167
  misc_feature: GYAE6OF02JR17D.42.78.H01.1.454.CMB.1.raw
  modified_base (219)..(221): a, c, t, g, unknown or other
  misc_feature (219)..(221): n is a, c, g, or t

SEQ ID NO: 20185 - DNA, 221 bp, Homo sapiens; identical to SEQ ID NO: 20167
  misc_feature: GYAE6OF02GECV9.42.78.H01.1.454.CMB.1.raw
  modified_base (219)..(221): a, c, t, g, unknown or other
  misc_feature (219)..(221): n is a, c, g, or t

SEQ ID NO: 20186 - DNA, 224 bp, Homo sapiens
  misc_feature: GYAE6OF02FZPNH.42.78.H01.1.454.CMB.1.raw
  modified_base (219)..(224): a, c, t, g, unknown or other
  misc_feature (219)..(224): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnnnnnn

SEQ ID NO: 20187 - DNA, 222 bp, Homo sapiens; identical to SEQ ID NO: 20157
  misc_feature: GYAE6OF02G0T37.42.78.H01.1.454.CMB.1.raw
  modified_base (219)..(222): a, c, t, g, unknown or other
  misc_feature (219)..(222): n is a, c, g, or t

SEQ ID NO: 20188 - DNA, 258 bp, Homo sapiens
  misc_feature: GYAE6OF02HVQKS.42.78.H01.1.454.CMB.1.raw
  modified_base (255)..(258): a, c, t, g, unknown or other
  misc_feature (255)..(258): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnn

SEQ ID NO: 20189 - DNA, 259 bp, Homo sapiens
  misc_feature: GYAE6OF02FFC8J.42.78.H01.1.454.CMB.1.raw
  modified_base (255)..(259): a, c, t, g, unknown or other
  misc_feature (255)..(259): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnn

SEQ ID NO: 20190 - DNA, 307 bp, Homo sapiens
  misc_feature: GYAE6OF02I2GG9.42.78.H01.1.454.CMB.1.raw
  modified_base (260)..(307): a, c, t, g, unknown or other
  misc_feature (260)..(307): n is a, c, g, or t
tcagtgacgtatgtcacgaccggtgctcgatttagtgtgagtagtttgggtttgggtaccggttgctaccggacgagtttgacgtccctggggccagggaaccctgggtaccaccgtctcctcagcttccaccaagggcccatcggtcttccccctggccgccctgctccaggagcacctctgggggcacagcggccctgggctgcctggtcaaggctacgttcacatacgtcactgagcgggctggcaaggcgcatagnnnnnnnnnnnnnnnnnnnnnnnnnnnnnnnnnnnnnnnnnnnnnnnn

SEQ ID NO: 20191 - DNA, 257 bp, Homo sapiens; identical to SEQ ID NO: 20121
  misc_feature: GYAE6OF02IU3QT.42.78.H01.1.454.CMB.1.raw
  modified_base (255)..(257): a, c, t, g, unknown or other
  misc_feature (255)..(257): n is a, c, g, or t

SEQ ID NO: 20192 - DNA, 219 bp, Homo sapiens
  misc_feature: GYAE6OF02HKL64.42.78.H01.1.454.CMB.1.raw
  modified_base (209)..(209): a, c, t, g, unknown or other
  misc_feature (209)..(209): n is a, c, g, or t
  modified_base (214)..(219): a, c, t, g, unknown or other
  misc_feature (214)..(219): n is a, c, g, or t
tcagtgacgtatgtcacgaccggtgctcgatttagtgtgagtagttgggttggggccaggaaccctggtcaccgtctcctcagcttccaccaagggcccatcggtcttcccctggcgccctgctccaggagcacctctggggcacagcggccctgggctgcctggtcaaggactacttccacatacgtcactgagcggctggcaaggcnatagnnnnnn

SEQ ID NO: 20193 - DNA, 222 bp, Homo sapiens
  misc_feature: GYAE6OF02I67LX.42.78.H01.1.454.CMB.1.raw
  modified_base (220)..(222): a, c, t, g, unknown or other
  misc_feature (220)..(222): n is a, c, g, or t
tcagtgacgtatgtcacgaccggtgctcgatttagtgtgagtagtttgggtttggggccagggaaccctggtcaccgtctcctcagcttccaccaagggcccatcggtcttccccctggcgccctgctccaggagcacctctggggcacagcggccctgggctgcctggtcaaggactacttccacatacgtcactgagcgggctggcaaggcgcatagnnn

SEQ ID NO: 20194 - DNA, 220 bp, Homo sapiens; identical to SEQ ID NO: 20168
  misc_feature: GYAE6OF02HWOM2.42.78.H01.1.454.CMB.1.raw
  modified_base (219)..(220): a, c, t, g, unknown or other
  misc_feature (219)..(220): n is a, c, g, or t

SEQ ID NO: 20195 - DNA, 222 bp, Homo sapiens
  misc_feature: GYAE6OF02JGO52.42.78.H01.1.454.CMB.1.raw
  modified_base (220)..(222): a, c, t, g, unknown or other
  misc_feature (220)..(222): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnn

SEQ ID NO: 20196 - DNA, 225 bp, Homo sapiens
  misc_feature: GYAE6OF02ICFFC.42.78.H01.1.454.CMB.1.raw
  modified_base (219)..(225): a, c, t, g, unknown or other
  misc_feature (219)..(225): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnnnnnnn

SEQ ID NO: 20197 - DNA, 258 bp, Homo sapiens; identical to SEQ ID NO: 20188
  misc_feature: GYAE6OF02F4BV9.42.78.H01.1.454.CMB.1.raw
  modified_base (255)..(258): a, c, t, g, unknown or other
  misc_feature (255)..(258): n is a, c, g, or t

SEQ ID NO: 20198 - DNA, 222 bp, Homo sapiens; identical to SEQ ID NO: 20157
  misc_feature: GYAE6OF02IF27V.42.78.H01.1.454.CMB.1.raw
  modified_base (219)..(222): a, c, t, g, unknown or other
  misc_feature (219)..(222): n is a, c, g, or t

SEQ ID NO: 20199 - DNA, 221 bp, Homo sapiens; identical to SEQ ID NO: 20167
  misc_feature: GYAE6OF02HE32R.42.78.H01.1.454.CMB.1.raw
  modified_base (219)..(221): a, c, t, g, unknown or other
  misc_feature (219)..(221): n is a, c, g, or t

SEQ ID NO: 20200 - DNA, 266 bp, Homo sapiens
  misc_feature: GYAE6OF02IJR0Q.42.78.H01.1.454.CMB.1.raw
  modified_base (256)..(266): a, c, t, g, unknown or other
  misc_feature (256)..(266): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttcccccctggcgccctgctccaggagcacctctgggggcacagcggccctgggctgcctggtcaaggactacttccacatacgtcactgagcgggctggcaaggcgcatagnnnnnnnnnnn

SEQ ID NO: 20201 - DNA, 270 bp, Homo sapiens
  misc_feature: GYAE6OF02IZDZ3.42.78.H01.1.454.CMB.1.raw
  modified_base (249)..(249): a, c, t, g, unknown or other
  misc_feature (249)..(249): n is a, c, g, or t
  modified_base (255)..(270): a, c, t, g, unknown or other
  misc_feature (255)..(270): n is a, c, g, or t
tcagtgacgtatgtcacgaccggtgctcgatttagtgtgagtagtttgggtttgggtaccggttgctaccggacgagtttgactcctggggccagggaaccctggtcaccgtctcctcagcttccaccaagggcccatcggtcttccccctggcgccctgctccaggagcacctcgtgggggcacagcggccctgggctgcctggtcaaggactacttccacatacgtcactgagcggctggcaaggcncatagnnnnnnnnnnnnnnnn

SEQ ID NO: 20202 - DNA, 232 bp, Homo sapiens
  misc_feature: GYAE6OF02HL1BD.42.78.H01.1.454.CMB.1.raw
  modified_base (221)..(232): a, c, t, g, unknown or other
  misc_feature (221)..(232): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggagcacctctgggggcacagcggccctgggctgcctggtcaaggctacttccactatacgttcactgagccgggctggcaaggcgcatgnnnnnnnnnnnn

SEQ ID NO: 20203 - DNA, 247 bp, Homo sapiens
  misc_feature: GYAE6OF02JQ7HW.42.78.H01.1.454.CMB.1.raw
  modified_base (226)..(247): a, c, t, g, unknown or other
  misc_feature (226)..(247): n is a, c, g, or t
tcagtgacgtatgtcacgaccggtgctcgatttagtgtgagtagtttgggtttggggccagggaaccctggtcaccgtctcctcagcttccaccaagggcccatcggtcttcccctggcgccctgctccaggacgcacctcgtgggggcacagcggcccctgggctgccgtggtcaacggactacttccacgatacgtcactgagcggctggcaggtcgcagtagnnnnnnnnnnnnnnnnnnnnnn

SEQ ID NO: 20204 - DNA, 277 bp, Homo sapiens
  misc_feature: GYAE6OF02F1QAK.42.78.H01.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
  modified_base (232)..(277): a, c, t, g, unknown or other
  misc_feature (232)..(277): n is a, c, g, or t
tcagtgacgtatgtcacgaccggtgctcgatttagtgtgagtagtttgggtttggggccagggaaccctggtcaccgtctcctcagcttccaccaagggcccatcggtcttccccctggcgaccctgctccaggagcacctctggggcacagcgggccctgggctgacctggtcaaggactacttccacatacgtnactgacgcgggctgctaaggcgctatagncngancnnnnnnnnnnnnnnnnnnnnnnnnnnnnnnnnnnnnnnnnnnnnnn

SEQ ID NO: 20205 - DNA, 291 bp, Homo sapiens
  misc_feature: GYAE6OF02HGJBF.42.78.H01.1.454.CMB.1.raw
  modified_base (267)..(291): a, c, t, g, unknown or other
  misc_feature (267)..(291): n is a, c, g, or t
tcagtgacgtatgtcacgaccggtgctcgatttagtgtgagtagtttgggtttgggtaccggttgctaccggacgagtttggctcctggggccagggaaccctggtcaccgtctcctcagcttccaccaagggcccatcggtcttccccctggccgccctgctccaggagcacctcgtgggggcacagcggccctgggctcgcctggtacaacggactacttccacacgtacgtcacgtggaggcgggctggacgaaggcgcatagnnnnnnnnnnnnnnnnnnnnnnnnn

SEQ ID NO: 20206 - DNA, 171 bp, Homo sapiens
  misc_feature: GYAE6OF01BPLQF.49.53.E09.1.454.CMB.1.raw
  modified_base (167)..(171): a, c, t, g, unknown or other
  misc_feature (167)..(171): n is a, c, g, or t
tcagagtcgagagacacgaccggtgctcgatttagagagagtgtgttggttgggaagaggaagactgacggtcccacggagttcaggtgctgggcacagcggcctgggctgcctggtcaaggactacttcctctctcgactctgagcgggctggcaaggcgcatagnnnnn

SEQ ID NO: 20207 - DNA, 165 bp, Homo sapiens
  misc_feature: GYAE6OF01DNBF2.49.53.E09.1.454.CMB.1.raw
  modified_base (165)..(165): a, c, t, g, unknown or other
  misc_feature (165)..(165): n is a, c, g, or t
tcagagtcgagagacacgaccggtgctcgatttagagagagtgtgttggttgggaagaggagactgacggtcccacggagttcaggtgctggcacagcggcctgggctgcctggtcaaggactacttcctctctcgactctgagcgggctggcaaggcgcatagn

SEQ ID NO: 20208 - DNA, 177 bp, Homo sapiens
  misc_feature: GYAE6OF01BO5UA.49.53.E09.1.454.CMB.1.raw
  modified_base (168)..(177): a, c, t, g, unknown or other
  misc_feature (168)..(177): n is a, c, g, or t
tcagagtcgagagacacgaccggtgctcgatttagagagagtgtgttgggttgggaagaggaagactgacggtcccaggagttcaggtgctgggcacagcggccctgggctgcctggtcaaggactacttcctctctcgactctgagcgggctggcaaggcgcatagnnnnnnnnnn

SEQ ID NO: 20209 - DNA, 167 bp, Homo sapiens
  misc_feature: GYAE6OF01BK5M4.49.53.E09.1.454.CMB.1.raw
tcagagtcgagagacacgaccggtgctcgatttagagagagtgtgttggttgggaagaggaagactgacggtcccacggagttcaggtgctgggcacagcggccctgggctgcctggtcaaggactacttcctctctcgactctgagcgggctggcaaggcgcatag

SEQ ID NO: 20210 - DNA, 171 bp, Homo sapiens
  misc_feature: GYAE6OF01CA52Q.49.53.E09.1.454.CMB.1.raw
  modified_base (171)..(171): a, c, t, g, unknown or other
  misc_feature (171)..(171): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagn

SEQ ID NO: 20211 - DNA, 170 bp, Homo sapiens
  misc_feature: GYAE6OF01DIRHN.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggtttgggaagaggaagactgacggtccccaggagttcaggtgctgggcacagcggccctgggctgcctggtcaaggactacttcctctctcgactctgagcgggctggcaaggcgcatagn

SEQ ID NO: 20212 - DNA, 191 bp, Homo sapiens
  misc_feature: GYAE6OF01CWDT2.49.53.E09.1.454.CMB.1.raw
  modified_base (165)..(191): a, c, t, g, unknown or other
  misc_feature (165)..(191): n is a, c, g, or t
tcagagtcgagagacacgaccggtgctcgatttagagagagtgtgttggttgggaagaggagactgacggtcccaggagttcgaggtgctggcacagcgcctggctgcctggtcaaggactacttcctcgtagcactctgagcgggctggcgaaggcgcatacgnnnnnnnnnnnnnnnnnnnnnnnnnnn

SEQ ID NO: 20213 - DNA, 172 bp, Homo sapiens
  misc_feature: GYAE6OF01EHJFM.49.53.E09.1.454.CMB.1.raw
  modified_base (166)..(172): a, c, t, g, unknown or other
  misc_feature (166)..(172): n is a, c, g, or t
tcagagtcgagagacacgaccggtgctcgatttagagagagtgtgttggttgggaagaggaagactgacggtcccaggagttcaggtgctgggcacagcggcctgggctgcctggtcaaggactacttcctctctcgactctgagcgggctggcaaggcgcatagnnnnnnn

SEQ ID NO: 20214 - DNA, 166 bp, Homo sapiens
  misc_feature: GYAE6OF01E1LCQ.49.53.E09.1.454.CMB.1.raw
  modified_base (166)..(166): a, c, t, g, unknown or other
  misc_feature (166)..(166): n is a, c, g, or t
tcagagtcgagagacacgaccggtgctcgatttagagagagtgtgttgggttgggaagaggaagactgacggtccccaggagttcaggtgctgggcacagcggcctggctgcctggtcaaggactacttccttctcgactctgagcgggctggcaaggcgcatagn

SEQ ID NO: 20215 - DNA, 170 bp, Homo sapiens
  misc_feature: GYAE6OF01C3H0D.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactcttcctctctcgactctgagcgggctggcaaggcgcatagn

SEQ ID NO: 20216 - DNA, 165 bp, Homo sapiens
  misc_feature: GYAE6OF01BG6AG.49.53.E09.1.454.CMB.1.raw
  modified_base (164)..(165): a, c, t, g, unknown or other
  misc_feature (164)..(165): n is a, c, g, or t
tcagagtcgagagacacgaccggtgctcgatttagagagagtgtgttgggttgggaagaggaagactgacggtcccaggagttcaggtgctggcacagcgcctggctgcctggtcaaggactacttcctctctcgactctgagcgggctggcaaggcgcatagnn

SEQ ID NO: 20217 - DNA, 168 bp, Homo sapiens
  misc_feature: GYAE6OF01DVFID.49.53.E09.1.454.CMB.1.raw
  modified_base (167)..(168): a, c, t, g, unknown or other
  misc_feature (167)..(168): n is a, c, g, or t
tcagagtcgagagacacgaccggtgctcgatttagagagagtgtgttgggttgggaagaggaagactgacggtccccaggagttcaggtgctgggcacagcggcctggctgcctggtcaaggactacttcctctctcgactctgagcgggctggcaaggcgcatagnn

SEQ ID NO: 20218 - DNA, 170 bp, Homo sapiens
  misc_feature: GYAE6OF01DVFQ8.49.53.E09.1.454.CMB.1.raw
  modified_base (169)..(170): a, c, t, g, unknown or other
  misc_feature (169)..(170): n is a, c, g, or t
tcagagtcgagagacacgaccggtgctcgatttagagagagtgtgttgggttgggaagaggaagactgacggtccccaggagttcaggtgctgggcacagcggccctgggctgcctggtcaaggactacttcctctctcgactctgagcgggctggcaaggcgcatagnn

SEQ ID NO: 20219 - DNA, 186 bp, Homo sapiens
  misc_feature: GYAE6OF01BRO6E.49.53.E09.1.454.CMB.1.raw
  modified_base (170)..(186): a, c, t, g, unknown or other
  misc_feature (170)..(186): n is a, c, g, or t
tcagagtcgagagacacgaccggtgctcgatttagagagagtgtgttgggttgggaagaggaagactgacggtcccaggagttcaggtgctgggcacagcggccctgggcctgcctggtcaacggactacttcctctctcgactctgagcgggctggcaaggcgcatagnnnnnnnnnnnnnnnnn

SEQ ID NO: 20220 - DNA, 171 bp, Homo sapiens; identical to SEQ ID NO: 20210
  misc_feature: GYAE6OF01AES64.49.53.E09.1.454.CMB.1.raw
  modified_base (171)..(171): a, c, t, g, unknown or other
  misc_feature (171)..(171): n is a, c, g, or t

SEQ ID NO: 20221 - DNA, 169 bp, Homo sapiens
  misc_feature: GYAE6OF01BZL9O.49.53.E09.1.454.CMB.1.raw
  modified_base (168)..(169): a, c, t, g, unknown or other
  misc_feature (168)..(169): n is a, c, g, or t
tcagagtcgagagacacgaccggtgctcgatttagagagagtgtgttggtttgggaagaggaagactgacggtccccaggagttcaggtgctggcacagcggccctgggctgcctggtcaaggactacttcctctctcgactctgagcgggctggcaaggcgcatagnn

SEQ ID NO: 20222 - DNA, 168 bp, Homo sapiens
  misc_feature: GYAE6OF01BUSSM.49.53.E09.1.454.CMB.1.raw
  modified_base (168)..(168): a, c, t, g, unknown or other
  misc_feature (168)..(168): n is a, c, g, or t
tcagagtcgagagacacgaccggtgctcgatttagagagagtgtgttgggttgggaagaggaagactgacggtcccaggagttcaggtgctgggcacagcggccctgggctgcctggtcaaggactacttcctctctcgactctgagcgggctggcaaggcgcatagn

SEQ ID NO: 20223 - DNA, 163 bp, Homo sapiens
  misc_feature: GYAE6OF01CNU5L.49.53.E09.1.454.CMB.1.raw
  modified_base (163)..(163): a, c, t, g, unknown or other
  misc_feature (163)..(163): n is a, c, g, or t
tcagagtcgagagacacgaccggtgctcgattagagagagtgtgttggttgggaagaggaagactgacggtcccaggagttcaggtgctggcacagcggcctggctgcctggtcaaggactacttcctctctcgactctgagcgggctggcaaggcgcatagn

SEQ ID NO: 20224 - DNA, 170 bp, Homo sapiens
  misc_feature: GYAE6OF01EBL8Z.49.53.E09.1.454.CMB.1.raw
  modified_base (169)..(170): a, c, t, g, unknown or other
  misc_feature (169)..(170): n is a, c, g, or t
tcagagtcgagagacacgaccggtgctcgatttagagagagtgtgttgggttggggaagaggaagactgacggtccccaggagttcaggtgctgggcacagcggcctgggctgcctggtcaaggactacttcctctctcgactctgagcgggctggcaaggcgcatagnn

SEQ ID NO: 20225 - DNA, 166 bp, Homo sapiens
  misc_feature: GYAE6OF01BAUE9.49.53.E09.1.454.CMB.1.raw
  modified_base (164)..(166): a, c, t, g, unknown or other
  misc_feature (164)..(166): n is a, c, g, or t
tcagagtcgagagacacgaccggtgctcgatttagagagagtgtgttggttgggaagaggaagactgacggtcccaggagttcaggtgctggcacagcggcctggctgcctggtcaaggactacttcctctctcgactctgagcgggctggcaaggcgcatagnnn

SEQ ID NO: 20226 - DNA, 170 bp, Homo sapiens
  misc_feature: GYAE6OF01DJ70Y.49.53.E09.1.454.CMB.1.raw
  modified_base (169)..(170): a, c, t, g, unknown or other
  misc_feature (169)..(170): n is a, c, g, or t
tcagagtcgagagacacgaccggtgctcgatttagagagagtgtgttgggttggggaagaggagactgacggtccccaggagttcaggtgctgggcacagcggccctggactgcctggtcaaggactacttcctctctcgactctgagcgggctggcaaggcgcatagnn

SEQ ID NO: 20227 - DNA, 162 bp, Homo sapiens
  misc_feature: GYAE6OF01D0NBE.49.53.E09.1.454.CMB.1.raw
  modified_base (162)..(162): a, c, t, g, unknown or other
  misc_feature (162)..(162): n is a, c, g, or t
tcagagtcgagagacacgaccggtgctcgatttagagagagtgtgttggttgggaagaggagactgacggtcccaggagttcaggtgctggcacagcggcctggctgcctggtcaaggactacttcctctctcgactctgagcggctggcaaggcgcatagn

SEQ ID NO: 20228 - DNA, 170 bp, Homo sapiens
  misc_feature: GYAE6OF01BATYI.49.53.E09.1.454.CMB.1.raw
  modified_base (169)..(170): a, c, t, g, unknown or other
  misc_feature (169)..(170): n is a, c, g, or t
tcagagtcgagagacacgaccggtgctcgatttagagagagtgtgtgggttggggaagaggaagactgacggtccccaggagttcaggtgctgggcacagcggccctgggctgcctggtcaaggactacttcctctctcgactctgagcgggctggcaaggcgcatagnn

SEQ ID NO: 20229 - DNA, 173 bp, Homo sapiens
  misc_feature: GYAE6OF01DMTFH.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 20230 - DNA, 172 bp, Homo sapiens
  misc_feature: GYAE6OF01DXA13.49.53.E09.1.454.CMB.1.raw
  modified_base (171)..(172): a, c, t, g, unknown or other
  misc_feature (171)..(172): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctcgtagcactctgagcgggctggcaaggcgcatagnn

SEQ ID NO: 20231 - DNA, 168 bp, Homo sapiens
  misc_feature: GYAE6OF01BNTQD.49.53.E09.1.454.CMB.1.raw
  modified_base (166)..(168): a, c, t, g, unknown or other
  misc_feature (166)..(168): n is a, c, g, or t
tcagagtcgagagacacgaccggtgctcgatttagagagagtgtgttggttgggaagaggaagactgacggtcccaggagttcaggtgctgggcacagcggccctggctgcctggtcaaggactacttcctctctcgactctgagcgggctggcaaggcgcatagnnn

SEQ ID NO: 20232 - DNA, 167 bp, Homo sapiens
  misc_feature: GYAE6OF01DYCFI.49.53.E09.1.454.CMB.1.raw
  modified_base (167)..(167): a, c, t, g, unknown or other
  misc_feature (167)..(167): n is a, c, g, or t
tcagagtcgagagacacgaccggtgctcgatttagagagagtgtgttgggttgggaagaggaagactgacggtcccaggagttcaggtgctgggcacagcggcctgggctgcctggtcaaggactacttcctctctcgactctgagcgggctggcaaggcgcatagn

SEQ ID NO: 20233 - DNA, 182 bp, Homo sapiens
  misc_feature: GYAE6OF01ELQV1.49.53.E09.1.454.CMB.1.raw
  modified_base (169)..(182): a, c, t, g, unknown or other
  misc_feature (169)..(182): n is a, c, g, or t
tcagagtcgagagacacgaccggtgctcgatttagagagagtgtgttgggttgggaagaggaagactgacggtccccaggagttcaggtgctgggcacagcggccctgggctgcctggtcaaggactacttcctctctcgactctgagcgggctggcaaggcgcatagnnnnnnnnnnnnnn

SEQ ID NO: 20234 - DNA, 165 bp, Homo sapiens
  misc_feature: GYAE6OF01AYWQC.49.53.E09.1.454.CMB.1.raw
  modified_base (165)..(165): a, c, t, g, unknown or other
  misc_feature (165)..(165): n is a, c, g, or t
tcagagtcgagagacacgaccggtgctcgatttagagagagtgtgttgggttgggaagaggaagactgacggtcccaggagttcaggtgctggcacagcggcctggctgcctggtcaaggactacttcctctctcgactctgagcgggctggcaaggcgcatagn

SEQ ID NO: 20235 - DNA, 184 bp, Homo sapiens
  misc_feature: GYAE6OF01D0N4W.49.53.E09.1.454.CMB.1.raw
  modified_base (175)..(184): a, c, t, g, unknown or other
  misc_feature (175)..(184): n is a, c, g, or t
tcagagtcgagagacacgaccggtgctcgatttagagagagtgtgttgggtttgggggaagaaggaagactgacggtcccccaggagttcaggtgctgggccacagcggccctgggctgcctggtcaaggactacttcctctctcgactctgagcgggctggcaaggcgcatagnnnnnnnnnn

SEQ ID NO: 20236 - DNA, 171 bp, Homo sapiens; identical to SEQ ID NO: 20210
  misc_feature: GYAE6OF01D1Y1L.49.53.E09.1.454.CMB.1.raw
  modified_base (171)..(171): a, c, t, g, unknown or other
  misc_feature (171)..(171): n is a, c, g, or t

SEQ ID NO: 20237 - DNA, 171 bp, Homo sapiens; identical to SEQ ID NO: 20210
  misc_feature: GYAE6OF01D3P4U.49.53.E09.1.454.CMB.1.raw
  modified_base (171)..(171): a, c, t, g, unknown or other
  misc_feature (171)..(171): n is a, c, g, or t

SEQ ID NO: 20238 - DNA, 172 bp, Homo sapiens
  misc_feature: GYAE6OF01D0995.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctctctcgactctgagcgggctggcaaggcgcatagn

SEQ ID NO: 20239 - DNA, 187 bp, Homo sapiens
  misc_feature: GYAE6OF01BN4Y5.49.53.E09.1.454.CMB.1.raw
  modified_base (171)..(187): a, c, t, g, unknown or other
  misc_feature (171)..(187): n is a, c, g, or t
tcagagtcgagagacacgaccggtgctcgatttagagagagtgtgttgggttggggaagaggaagactgacggtccccaggagttcaggtgctgggcacagcggccctgggcctgcctggtcaaggactacttcctctctcgactctgagcgggctggcaaggcgcatagnnnnnnnnnnnnnnnnn

SEQ ID NO: 20240 - DNA, 170 bp, Homo sapiens
  misc_feature: GYAE6OF01C3SII.49.53.E09.1.454.CMB.1.raw
  modified_base (169)..(170): a, c, t, g, unknown or other
  misc_feature (169)..(170): n is a, c, g, or t
tcagagtcgagagacacgaccggtgctcgatttagagagagtgtgttgggtttgggaagaggaagactgacggtccccaggagttcaggtgctggcacagcggccctgggctgcctggtcaaggactacttcctctctcgactctgagcgggctggcaaggcgcatagnn

SEQ ID NO: 20241 - DNA, 171 bp, Homo sapiens
  misc_feature: GYAE6OF01BMXDS.49.53.E09.1.454.CMB.1.raw
  modified_base (170)..(171): a, c, t, g, unknown or other
  misc_feature (170)..(171): n is a, c, g, or t
tcagagtcgagagacacgaccggtgctcgatttagagagagtgtgttgggtttggggaagaggaagactgacggtccccaggagttcaggtgctggcacagcggccctgggctgcctggtcaaggactacttcctctctcgactctgagcgggctggcaaggcgcatagnn

SEQ ID NO: 20242 - DNA, 171 bp, Homo sapiens; identical to SEQ ID NO: 20210
  misc_feature: GYAE6OF01DSHPD.49.53.E09.1.454.CMB.1.raw
  modified_base (171)..(171): a, c, t, g, unknown or other
  misc_feature (171)..(171): n is a, c, g, or t

SEQ ID NO: 20243 - DNA, 180 bp, Homo sapiens
  misc_feature: GYAE6OF01EK4J0.49.53.E09.1.454.CMB.1.raw
  modified_base (173)..(180): a, c, t, g, unknown or other
  misc_feature (173)..(180): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnn

SEQ ID NO: 20244 - DNA, 171 bp, Homo sapiens; identical to SEQ ID NO: 20210
  misc_feature: GYAE6OF01BZPZS.49.53.E09.1.454.CMB.1.raw
  modified_base (171)..(171): a, c, t, g, unknown or other
  misc_feature (171)..(171): n is a, c, g, or t

SEQ ID NO: 20245 - DNA, 169 bp, Homo sapiens
  misc_feature: GYAE6OF01BI9V4.49.53.E09.1.454.CMB.1.raw
  modified_base (169)..(169): a, c, t, g, unknown or other
  misc_feature (169)..(169): n is a, c, g, or t
tcagagtcgagagacacgaccggtgctcgatttagagagagtgtgttgggttgggaagaggaagactgacggtccccaggagttcaggtgctgggcacagcggccctgggctgcctggtcaaggactacttcctctctcgactctgagcgggctggcaaggcgcatagn

SEQ ID NO: 20246 - DNA, 170 bp, Homo sapiens
  misc_feature: GYAE6OF01B54JM.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggtttggggaagaggaagactgacggtccccaggagttcaggtgcgtggcacagccgcccgtggctgcctggtcaaggactacttcctctctcgactctgagcggctggcaaggcgcatagn

SEQ ID NO: 20247 - DNA, 170 bp, Homo sapiens
  misc_feature: GYAE6OF01CFTB3.49.53.E09.1.454.CMB.1.raw
  modified_base (168)..(170): a, c, t, g, unknown or other
  misc_feature (168)..(170): n is a, c, g, or t
tcagagtcgagagacacgaccggtgctcgatttagagagagtgtgttgggtttgggaagaggaagactgacggtccccaggagttcaggtgctggcacagcggcctgggctgcctggtcaaggactacttcctctctcgactctgagcgggctggcaaggcgcatagnnn

SEQ ID NO: 20248 - DNA, 171 bp, Homo sapiens; identical to SEQ ID NO: 20210
  misc_feature: GYAE6OF01EM7JX.49.53.E09.1.454.CMB.1.raw
  modified_base (171)..(171): a, c, t, g, unknown or other
  misc_feature (171)..(171): n is a, c, g, or t

SEQ ID NO: 20249 - DNA, 212 bp, Homo sapiens
  misc_feature: GYAE6OF01DNXYH.49.53.E09.1.454.CMB.1.raw
  modified_base (172)..(212): a, c, t, g, unknown or other
  misc_feature (172)..(212): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnnnnnnnnnnnnnnnnnnnnnn

SEQ ID NO: 20250 - DNA, 171 bp, Homo sapiens; identical to SEQ ID NO: 20210
  misc_feature: GYAE6OF01B6WB3.49.53.E09.1.454.CMB.1.raw
  modified_base (171)..(171): a, c, t, g, unknown or other
  misc_feature (171)..(171): n is a, c, g, or t

SEQ ID NO: 20251 - DNA, 170 bp, Homo sapiens
  misc_feature: GYAE6OF01BX588.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggttggggaagaggaagactgacggtccccaggagttcaggtgctgggcacagcggccctgggctgcctggtcaaggactacttcctctctcgactctgagcgggctggcaaggcgcatagn

SEQ ID NO: 20252 - DNA, 185 bp, Homo sapiens
  misc_feature: GYAE6OF01B5UB9.49.53.E09.1.454.CMB.1.raw
  modified_base (171)..(185): a, c, t, g, unknown or other
  misc_feature (171)..(185): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnnnnnnnnnnnnnnn

SEQ ID NO: 20253 - DNA, 170 bp, Homo sapiens; identical to SEQ ID NO: 20251
  misc_feature: GYAE6OF01BYPAO.49.53.E09.1.454.CMB.1.raw
  modified_base (170)..(170): a, c, t, g, unknown or other
  misc_feature (170)..(170): n is a, c, g, or t

SEQ ID NO: 20254 - DNA, 172 bp, Homo sapiens
  misc_feature: GYAE6OF01DATV7.49.53.E09.1.454.CMB.1.raw
  modified_base (171)..(172): a, c, t, g, unknown or other
  misc_feature (171)..(172): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnn

SEQ ID NO: 20255 - DNA, 173 bp, Homo sapiens; identical to SEQ ID NO: 20229
  misc_feature: GYAE6OF01EDPV7.49.53.E09.1.454.CMB.1.raw
  modified_base (173)..(173): a, c, t, g, unknown or other
  misc_feature (173)..(173): n is a, c, g, or t

SEQ ID NO: 20256 - DNA, 172 bp, Homo sapiens; identical to SEQ ID NO: 20254
  misc_feature: GYAE6OF01AZVRN.49.53.E09.1.454.CMB.1.raw
  modified_base (171)..(172): a, c, t, g, unknown or other
  misc_feature (171)..(172): n is a, c, g, or t

SEQ ID NO: 20257 - DNA, 172 bp, Homo sapiens
  misc_feature: GYAE6OF01D9SKP.49.53.E09.1.454.CMB.1.raw
  modified_base (170)..(172): a, c, t, g, unknown or other
  misc_feature (170)..(172): n is a, c, g, or t
tcagagtcgagagacacgaccggtgctcgatttagagagagtgtgttgggttggggaagaggaagactgacggtccccaggagttcaggtgctgggcacagcggccctgggctgcctggtcaaggactacttcctctctcgactctgagcgggctggcaaggcgcatagnnn

SEQ ID NO: 20258 - DNA, 173 bp, Homo sapiens
  misc_feature: GYAE6OF01EU3YT.49.53.E09.1.454.CMB.1.raw
  modified_base (172)..(173): a, c, t, g, unknown or other
  misc_feature (172)..(173): n is a, c, g, or t
tcagagtcgagagacacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagnn

SEQ ID NO: 20259 - DNA, 171 bp, Homo sapiens; identical to SEQ ID NO: 20210
  misc_feature: GYAE6OF01BTKN8.49.53.E09.1.454.CMB.1.raw
  modified_base (171)..(171): a, c, t, g, unknown or other
  misc_feature (171)..(171): n is a, c, g, or t

SEQ ID NO: 20260 - DNA, 166 bp, Homo sapiens
  misc_feature: GYAE6OF01CR3IF.49.53.E09.1.454.CMB.1.raw
  modified_base (166)..(166): a, c, t, g, unknown or other
  misc_feature (166)..(166): n is a, c, g, or t
tcagagtcgagagacacgaccggtgctcgatttagagagagtgtgttgggttgggaagaggaagactgaccggtccccaggagttcaggtgctggcacagcgcctggctgcctggtcaaggactacttcctctctcgactctgagcgggctggcaaggcgcatagn

SEQ ID NO: 20261 - DNA, 170 bp, Homo sapiens
  misc_feature: GYAE6OF01AL30Q.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggtttggggaagaggaagactgacggtccccaggagttcaggtgctgggcacagcggcctgggctgcctggtcaaggactacttcctctctcgactctgagcgggctggcaaggcgcatagn

SEQ ID NO: 20262 - DNA, 193 bp, Homo sapiens
  misc_feature: GYAE6OF01CGSNO.49.53.E09.1.454.CMB.1.raw
  modified_base (174)..(193): a, c, t, g, unknown or other
  misc_feature (174)..(193): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctctctacgactctgagcgggactggcaaggcgcatagnnnnnnnnnnnnnnnnnnnn

SEQ ID NO: 20263 - DNA, 187 bp, Homo sapiens
  misc_feature: GYAE6OF01DNXTU.49.53.E09.1.454.CMB.1.raw
  modified_base (172)..(187): a, c, t, g, unknown or other
  misc_feature (172)..(187): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctcgtagcactctgagcgggctggcaaggcgcatagnnnnnnnnnnnnnnnn

SEQ ID NO: 20264 - DNA, 171 bp, Homo sapiens; identical to SEQ ID NO: 20241
  misc_feature: GYAE6OF01CCQW9.49.53.E09.1.454.CMB.1.raw
  modified_base (170)..(171): a, c, t, g, unknown or other
  misc_feature (170)..(171): n is a, c, g, or t

SEQ ID NO: 20265 - DNA, 174 bp, Homo sapiens
  misc_feature: GYAE6OF01DI23Y.49.53.E09.1.454.CMB.1.raw
  modified_base (173)..(174): a, c, t, g, unknown or other
  misc_feature (173)..(174): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 20266 - DNA, 203 bp, Homo sapiens
  misc_feature: GYAE6OF01CSRV8.49.53.E09.1.454.CMB.1.raw
  modified_base (174)..(203): a, c, t, g, unknown or other
  misc_feature (174)..(203): n is a, c, g, or t
tcagagtcgagagacacgaccggtgctcgatttagagagagtgtggttgggttgggggaagaggaagactgacggtccccaggagttcgaggtgctgggcacagcggccctgggctgcctcggtcaaggactacttcctctctcgactctgagcgggctggcaaggcgcatagnnnnnnnnnnnnnnnnnnnnnnnnnnnnnn

SEQ ID NO: 20267 - DNA, 171 bp, Homo sapiens; identical to SEQ ID NO: 20210
  misc_feature: GYAE6OF01AMKG7.49.53.E09.1.454.CMB.1.raw
  modified_base (171)..(171): a, c, t, g, unknown or other
  misc_feature (171)..(171): n is a, c, g, or t

SEQ ID NO: 20268 - DNA, 171 bp, Homo sapiens
  misc_feature: GYAE6OF01AYJ3F.49.53.E09.1.454.CMB.1.raw
  modified_base (170)..(171): a, c, t, g, unknown or other
  misc_feature (170)..(171): n is a, c, g, or t
tcagagtcgagagacacgaccggtgctcgatttagagagagtgtgttgggttggggaagaggaagactgacggtccccaggagttcaggtgctgggcacagcggccctgggctgcctggtcaaggactacttcctctctcgactctgagcgggctggcaaggcgcatagnn

SEQ ID NO: 20269 - DNA, 182 bp, Homo sapiens
  misc_feature: GYAE6OF01CILCT.49.53.E09.1.454.CMB.1.raw
  modified_base (172)..(182): a, c, t, g, unknown or other
  misc_feature (172)..(182): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctcgtagcactctgagcgggcttggcaaggcgcatagnnnnnnnnnnn

SEQ ID NO: 20270 - DNA, 176 bp, Homo sapiens
  misc_feature: GYAE6OF01BDTMH.49.53.E09.1.454.CMB.1.raw
  modified_base (173)..(176): a, c, t, g, unknown or other
  misc_feature (173)..(176): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 20271 - DNA, 173 bp, Homo sapiens; identical to SEQ ID NO: 20229
  misc_feature: GYAE6OF01DW2X3.49.53.E09.1.454.CMB.1.raw
  modified_base (173)..(173): a, c, t, g, unknown or other
  misc_feature (173)..(173): n is a, c, g, or t

SEQ ID NO: 20272 - DNA, 171 bp, Homo sapiens
  misc_feature: GYAE6OF01BM5AV.49.53.E09.1.454.CMB.1.raw
  modified_base (171)..(171): a, c, t, g, unknown or other
  misc_feature (171)..(171): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctcgtagcactctgagcgggctggcaaggcgcatagn

SEQ ID NO: 20273 - DNA, 171 bp, Homo sapiens; identical to SEQ ID NO: 20272
  misc_feature: GYAE6OF01CXF1I.49.53.E09.1.454.CMB.1.raw
  modified_base (171)..(171): a, c, t, g, unknown or other
  misc_feature (171)..(171): n is a, c, g, or t

SEQ ID NO: 20274 - DNA, 173 bp, Homo sapiens; identical to SEQ ID NO: 20229
  misc_feature: GYAE6OF01A0DRW.49.53.E09.1.454.CMB.1.raw
  modified_base (173)..(173): a, c, t, g, unknown or other
  misc_feature (173)..(173): n is a, c, g, or t

SEQ ID NO: 20275 - DNA, 173 bp, Homo sapiens; identical to SEQ ID NO: 20229
  misc_feature: GYAE6OF01C10UM.49.53.E09.1.454.CMB.1.raw
  modified_base (173)..(173): a, c, t, g, unknown or other
  misc_feature (173)..(173): n is a, c, g, or t

SEQ ID NO: 20276 - DNA, 213 bp, Homo sapiens
  misc_feature: GYAE6OF01A2PHL.49.53.E09.1.454.CMB.1.raw
  modified_base (178)..(213): a, c, t, g, unknown or other
  misc_feature (178)..(213): n is a, c, g, or t
tcagagtcgagagacacgaccggtgctcgatttagagagagtgtggttgggtttgggggaagaggaagactgacggtcccccaggagttcaggtgctgggcacagcggccctgggctgcctggtcaaggactacttccctctctcgactcgtgagcgggctgggccaaggcgcatagnnnnnnnnnnnnnnnnnnnnnnnnnnnnnnnnnnnn

SEQ ID NO: 20277 - DNA, 173 bp, Homo sapiens; identical to SEQ ID NO: 20229
  misc_feature: GYAE6OF01DAO6I.49.53.E09.1.454.CMB.1.raw
  modified_base (173)..(173): a, c, t, g, unknown or other
  misc_feature (173)..(173): n is a, c, g, or t

SEQ ID NO: 20278 - DNA, 172 bp, Homo sapiens; identical to SEQ ID NO: 20254
  misc_feature: GYAE6OF01EING5.49.53.E09.1.454.CMB.1.raw
  modified_base (171)..(172): a, c, t, g, unknown or other
  misc_feature (171)..(172): n is a, c, g, or t

SEQ ID NO: 20279 - DNA, 173 bp, Homo sapiens; identical to SEQ ID NO: 20229
  misc_feature: GYAE6OF01D8S0G.49.53.E09.1.454.CMB.1.raw
  modified_base (173)..(173): a, c, t, g, unknown or other
  misc_feature (173)..(173): n is a, c, g, or t

SEQ ID NO: 20280 - DNA, 171 bp, Homo sapiens; identical to SEQ ID NO: 20210
  misc_feature: GYAE6OF01A3TOM.49.53.E09.1.454.CMB.1.raw
  modified_base (171)..(171): a, c, t, g, unknown or other
  misc_feature (171)..(171): n is a, c, g, or t

SEQ ID NO: 20281 - DNA, 172 bp, Homo sapiens
  misc_feature: GYAE6OF01BESO5.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctccgactctgagcgggctggcaaggcgcatagn

SEQ ID NO: 20282 - DNA, 171 bp, Homo sapiens; identical to SEQ ID NO: 20210
  misc_feature: GYAE6OF01C27DV.49.53.E09.1.454.CMB.1.raw
  modified_base (171)..(171): a, c, t, g, unknown or other
  misc_feature (171)..(171): n is a, c, g, or t

SEQ ID NO: 20283 - DNA, 172 bp, Homo sapiens; identical to SEQ ID NO: 20230
  misc_feature: GYAE6OF01EPQDU.49.53.E09.1.454.CMB.1.raw
  modified_base (171)..(172): a, c, t, g, unknown or other
  misc_feature (171)..(172): n is a, c, g, or t

SEQ ID NO: 20284 - DNA, 166 bp, Homo sapiens
  misc_feature: GYAE6OF01CRKNE.49.53.E09.1.454.CMB.1.raw
  modified_base (166)..(166): a, c, t, g, unknown or other
  misc_feature (166)..(166): n is a, c, g, or t
tcagagtcgagagacacgaccggtgctcgatttagagagagtgtgttggttgggaagaggaagactgacggtcccaggagttcaggtgctggcacagcggccctgggctgcctggtcaaggactacttcctctctcgactctgagcgggctggcaaggcgcatagn

SEQ ID NO: 20285 - DNA, 171 bp, Homo sapiens; identical to SEQ ID NO: 20210
  misc_feature: GYAE6OF01CMW44.49.53.E09.1.454.CMB.1.raw
  modified_base (171)..(171): a, c, t, g, unknown or other
  misc_feature (171)..(171): n is a, c, g, or t

SEQ ID NO: 20286 - DNA, 171 bp, Homo sapiens; identical to SEQ ID NO: 20210
  misc_feature: GYAE6OF01EJ1J4.49.53.E09.1.454.CMB.1.raw
  modified_base (171)..(171): a, c, t, g, unknown or other
  misc_feature (171)..(171): n is a, c, g, or t

SEQ ID NO: 20287 - DNA, 172 bp, Homo sapiens; identical to SEQ ID NO: 20238
  misc_feature: GYAE6OF01BUS0O.49.53.E09.1.454.CMB.1.raw
  modified_base (172)..(172): a, c, t, g, unknown or other
  misc_feature (172)..(172): n is a, c, g, or t

SEQ ID NO: 20288 - DNA, 176 bp, Homo sapiens
  misc_feature: GYAE6OF01BM4BT.49.53.E09.1.454.CMB.1.raw
  modified_base (171)..(176): a, c, t, g, unknown or other
  misc_feature (171)..(176): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnnnnnn

SEQ ID NO: 20289 - DNA, 179 bp, Homo sapiens
  misc_feature: GYAE6OF01BL43U.49.53.E09.1.454.CMB.1.raw
  modified_base (172)..(179): a, c, t, g, unknown or other
  misc_feature (172)..(179): n is a, c, g, or t
tcagagtcgagagacacgaccggtgctcgatttagagagagtgtggttgggtttggggaagaggaagactgacggtccccaggagttcaggtgctgggcacagcggccctgggctgcctggtcaaggactacttcctctctcgactctgagcgggctggcaaggcgcatagnnnnnnnn

SEQ ID NO: 20290 - DNA, 173 bp, Homo sapiens; identical to SEQ ID NO: 20229
  misc_feature: GYAE6OF01D8SZO.49.53.E09.1.454.CMB.1.raw
  modified_base (173)..(173): a, c, t, g, unknown or other
  misc_feature (173)..(173): n is a, c, g, or t

SEQ ID NO: 20291 - DNA, 172 bp, Homo sapiens
  misc_feature: GYAE6OF01D47RX.49.53.E09.1.454.CMB.1.raw
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatag

SEQ ID NO: 20292 - DNA, 173 bp, Homo sapiens; identical to SEQ ID NO: 20229
  misc_feature: GYAE6OF01CFFWX.49.53.E09.1.454.CMB.1.raw
  modified_base (173)..(173): a, c, t, g, unknown or other
  misc_feature (173)..(173): n is a, c, g, or t

SEQ ID NO: 20293 - DNA, 171 bp, Homo sapiens; identical to SEQ ID NO: 20210
  misc_feature: GYAE6OF01BQXVF.49.53.E09.1.454.CMB.1.raw
  modified_base (171)..(171): a, c, t, g, unknown or other
  misc_feature (171)..(171): n is a, c, g, or t

SEQ ID NO: 20294 - DNA, 171 bp, Homo sapiens; identical to SEQ ID NO: 20268
  misc_feature: GYAE6OF01BSNKG.49.53.E09.1.454.CMB.1.raw
  modified_base (170)..(171): a, c, t, g, unknown or other
  misc_feature (170)..(171): n is a, c, g, or t

SEQ ID NO: 20295 - DNA, 173 bp, Homo sapiens
  misc_feature: GYAE6OF01CGARC.49.53.E09.1.454.CMB.1.raw
  modified_base (172)..(173): a, c, t, g, unknown or other
  misc_feature (172)..(173): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctctctcgactctgagcgggctggcaaggcgcatagnn

SEQ ID NO: 20296 - DNA, 199 bp, Homo sapiens
  misc_feature: GYAE6OF01ECEKP.49.53.E09.1.454.CMB.1.raw
  modified_base (173)..(199): a, c, t, g, unknown or other
  misc_feature (173)..(199): n is a, c, g, or t
tcagagtcgagagacacgaccggtgctcgatttagagagagtgtgttagggtttgggggaagaggaagactgacggtcccccaggagttcaggtgctgggcacagcggccctggctgcctggtcaaggactacttcctctctcgactctgagcgggctggcaaggcgcatagnnnnnnnnnnnnnnnnnnnnnnnnnnn

SEQ ID NO: 20297 - DNA, 172 bp, Homo sapiens
  misc_feature: GYAE6OF01CSGBM.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttggtttgtgggaagaggaagactgacggtcccccaggagttcaggtgctgggcacagcggccctgggctgcctggtcaaggactacttcctctctcgactctgagcgggctggcaaggcgcatagn

SEQ ID NO: 20298 - DNA, 172 bp, Homo sapiens; identical to SEQ ID NO: 20254
  misc_feature: GYAE6OF01EI5SP.49.53.E09.1.454.CMB.1.raw
  modified_base (171)..(172): a, c, t, g, unknown or other
  misc_feature (171)..(172): n is a, c, g, or t

SEQ ID NO: 20299 - DNA, 172 bp, Homo sapiens
  misc_feature: GYAE6OF01BD980.49.53.E09.1.454.CMB.1.raw
  modified_base (168)..(172): a, c, t, g, unknown or other
  misc_feature (168)..(172): n is a, c, g, or t
tcagagtcgagagacacgaccggtgctcgatttagagagagtgtgttggttgggaagaggaagactgacggtccccaggagttcaggtgctgggcacagcggccctgggctgcctggtcaaggactacttcctctctcgactctgagcgggctggcaaggcgcatagnnnnn

SEQ ID NO: 20300 - DNA, 182 bp, Homo sapiens
  misc_feature: GYAE6OF01D1RJJ.49.53.E09.1.454.CMB.1.raw
  modified_base (173)..(182): a, c, t, g, unknown or other
  misc_feature (173)..(182): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnn

SEQ ID NO: 20301 - DNA, 172 bp, Homo sapiens; identical to SEQ ID NO: 20238
  misc_feature: GYAE6OF01AH8GH.49.53.E09.1.454.CMB.1.raw
  modified_base (172)..(172): a, c, t, g, unknown or other
  misc_feature (172)..(172): n is a, c, g, or t

SEQ ID NO: 20302 - DNA, 169 bp, Homo sapiens
  misc_feature: GYAE6OF01CGDQN.49.53.E09.1.454.CMB.1.raw
  modified_base (169)..(169): a, c, t, g, unknown or other
  misc_feature (169)..(169): n is a, c, g, or t
tcagagtcgagagacacgaccggtgctcgatttagagagagtgtgttgggttgggaagaggaagactgacggtccccaggagttcaggtgctgggcacagcggccctgggctgcctggtcaaggactacttcctcgtagcactctgagcgggctggcaaggcgcatagn

SEQ ID NO: 20303 - DNA, 171 bp, Homo sapiens; identical to SEQ ID NO: 20210
  misc_feature: GYAE6OF01B8UD2.49.53.E09.1.454.CMB.1.raw
  modified_base (171)..(171): a, c, t, g, unknown or other
  misc_feature (171)..(171): n is a, c, g, or t

SEQ ID NO: 20304 - DNA, 173 bp, Homo sapiens; identical to SEQ ID NO: 20229
  misc_feature: GYAE6OF01EGCTF.49.53.E09.1.454.CMB.1.raw
  modified_base (173)..(173): a, c, t, g, unknown or other
  misc_feature (173)..(173): n is a, c, g, or t

SEQ ID NO: 20305 - DNA, 173 bp, Homo sapiens; identical to SEQ ID NO: 20229
  misc_feature: GYAE6OF01DTT1F.49.53.E09.1.454.CMB.1.raw
  modified_base (173)..(173): a, c, t, g, unknown or other
  misc_feature (173)..(173): n is a, c, g, or t

SEQ ID NO: 20306 - DNA, 172 bp, Homo sapiens
  misc_feature: GYAE6OF01C4S7C.49.53.E09.1.454.CMB.1.raw
  modified_base (170)..(172): a, c, t, g, unknown or other
  misc_feature (170)..(172): n is a, c, g, or t
tcagagtcgagagacacgaccggtgctcgatttagagagagtgtgttgggtttggggaagaggaagactgacggtccccaggagttcaggtgctgggcacagcggcctgggctgcctggtcaaggactacttcctctctcgactctgagcgggctggcaaggcgcatagnnn

SEQ ID NO: 20307 - DNA, 173 bp, Homo sapiens; identical to SEQ ID NO: 20229
  misc_feature: GYAE6OF01AURHX.49.53.E09.1.454.CMB.1.raw
  modified_base (173)..(173): a, c, t, g, unknown or other
  misc_feature (173)..(173): n is a, c, g, or t

SEQ ID NO: 20308 - DNA, 167 bp, Homo sapiens
  misc_feature: GYAE6OF01DVZIP.49.53.E09.1.454.CMB.1.raw
  modified_base (167)..(167): a, c, t, g, unknown or other
  misc_feature (167)..(167): n is a, c, g, or t
tcagagtcgagagacacgaccggtgctcgatttagagagagtgtgttgggttgggaagaggaagactgacggtccccaggagttcaggtgctgggcacagcggcctggctgcctggtcaaggactacttcctctctcgactctgagcgggctggcaaggcgcatagn

SEQ ID NO: 20309 - DNA, 183 bp, Homo sapiens
  misc_feature: GYAE6OF01DK2HF.49.53.E09.1.454.CMB.1.raw
  modified_base (172)..(183): a, c, t, g, unknown or other
  misc_feature (172)..(183): n is a, c, g, or t
tcagagtcgagagacacgaccggtgctcgatttagagagagtgtgttgggtttggggaagaggaagactgacggtccccacggagttcaggtgctgggcacagcggccctgggctgcctggtcaaggactacttcctctctcgactctgagcgggctggcaaggcgcatagnnnnnnnnnnnn

SEQ ID NO: 20310 - DNA, 188 bp, Homo sapiens
  misc_feature: GYAE6OF01D98LS.49.53.E09.1.454.CMB.1.raw
  modified_base (175)..(188): a, c, t, g, unknown or other
  misc_feature (175)..(188): n is a, c, g, or t
tcagagtcgagagacacgaccggtgctcgatttagagagagtgtggttgggtttgggggaagaggaagactgacggtcccccaggagttcaggtgctgggccacagcggccctgggctgcctggtcaaggactacttcctctctcgactctgagcgggctggcaaggcgcatagnnnnnnnnnnnnnn

SEQ ID NO: 20311 - DNA, 173 bp, Homo sapiens; identical to SEQ ID NO: 20229
  misc_feature: GYAE6OF01EGV56.49.53.E09.1.454.CMB.1.raw
  modified_base (173)..(173): a, c, t, g, unknown or other
  misc_feature (173)..(173): n is a, c, g, or t

SEQ ID NO: 20312 - DNA, 170 bp, Homo sapiens; identical to SEQ ID NO: 20251
  misc_feature: GYAE6OF01EKP80.49.53.E09.1.454.CMB.1.raw
  modified_base (170)..(170): a, c, t, g, unknown or other
  misc_feature (170)..(170): n is a, c, g, or t

SEQ ID NO: 20313 - DNA, 171 bp, Homo sapiens; identical to SEQ ID NO: 20272
  misc_feature: GYAE6OF01DDQT9.49.53.E09.1.454.CMB.1.raw
  modified_base (171)..(171): a, c, t, g, unknown or other
  misc_feature (171)..(171): n is a, c, g, or t

SEQ ID NO: 20314 - DNA, 171 bp, Homo sapiens; identical to SEQ ID NO: 20210
  misc_feature: GYAE6OF01AVE6H.49.53.E09.1.454.CMB.1.raw
  modified_base (171)..(171): a, c, t, g, unknown or other
  misc_feature (171)..(171): n is a, c, g, or t

SEQ ID NO: 20315 - DNA, 172 bp, Homo sapiens; identical to SEQ ID NO: 20238
  misc_feature: GYAE6OF01CVHF2.49.53.E09.1.454.CMB.1.raw
  modified_base (172)..(172): a, c, t, g, unknown or other
  misc_feature (172)..(172): n is a, c, g, or t

SEQ ID NO: 20316 - DNA, 174 bp, Homo sapiens
  misc_feature: GYAE6OF01CUQZX.49.53.E09.1.454.CMB.1.raw
  modified_base (169)..(174): a, c, t, g, unknown or other
  misc_feature (169)..(174): n is a, c, g, or t
tcagagtcgagagacacgaccggtgctcgatttagagagagtgtgttgggtttggggaagaggaagactgacggtccccaggagttcaggtgctggcacagcggccctgggctgcctggtcaaggactacttcctctctcgactctgagcggctggcaaggcgcatagnnnnnn

SEQ ID NO: 20317 - DNA, 180 bp, Homo sapiens
  misc_feature: GYAE6OF01EK4EO.49.53.E09.1.454.CMB.1.raw
  modified_base (170)..(180): a, c, t, g, unknown or other
  misc_feature (170)..(180): n is a, c, g, or t
tcagagtcgagagacacgaccggtgctcgatttagagagagtgtgttgggttggggaagaggaagactgacggtccccaggagttcaggtgctgggcacagcggccctgggctgcctggtcaaggactacttcctctctcgactctgagcgggctggcaaggcgcatagnnnnnnnnnnn

SEQ ID NO: 20318 - DNA, 185 bp, Homo sapiens
  misc_feature: GYAE6OF01DV4VO.49.53.E09.1.454.CMB.1.raw
  modified_base (171)..(185): a, c, t, g, unknown or other
  misc_feature (171)..(185): n is a, c, g, or t
tcagagtcgagagacacgaccggtgctcgatttagagagagtgtgttgggttggggaagaggaagactgacggtcccccaggagttcaggtgctgggcacagcggccctgggctgcctggtcaaggactacttcctctctcgactctgagcgggctggcaaggcgcatagnnnnnnnnnnnnnnn

SEQ ID NO: 20319 - DNA, 173 bp, Homo sapiens; identical to SEQ ID NO: 20229
  misc_feature: GYAE6OF01EMRJB.49.53.E09.1.454.CMB.1.raw
  modified_base (173)..(173): a, c, t, g, unknown or other
  misc_feature (173)..(173): n is a, c, g, or t

SEQ ID NO: 20320 - DNA, 171 bp, Homo sapiens
  misc_feature: GYAE6OF01DOFAN.49.53.E09.1.454.CMB.1.raw
  modified_base (170)..(171): a, c, t, g, unknown or other
  misc_feature (170)..(171): n is a, c, g, or t
tcagagtcgagagacacgaccggtgctcgatttagagagagtgtgttgggtttggggaagaggaagactgacggtccccaggagttcaggtgctggcacagcggccctggctgcctggtcaaggaactacttccagtactctatctgagcgggctggcaaggcgcatagnn

SEQ ID NO: 20321 - DNA, 177 bp, Homo sapiens
  misc_feature: GYAE6OF01C4WU5.49.53.E09.1.454.CMB.1.raw
  modified_base (170)..(177): a, c, t, g, unknown or other
  misc_feature (170)..(177): n is a, c, g, or t
tcagagtcgagagacacgaccggtgctcgatttagagagagtgtgttgggtttggggaagaggaagactgacggtccccaggagttcaggtgctgggcacagcggcctgggctgcctggtcaaggactacttcctctctcgactctgagcgggctggcaaggcgcatagnnnnnnnn

SEQ ID NO: 20322 - DNA, 172 bp, Homo sapiens; identical to SEQ ID NO: 20254
  misc_feature: GYAE6OF01CZ749.49.53.E09.1.454.CMB.1.raw
  modified_base (171)..(172): a, c, t, g, unknown or other
  misc_feature (171)..(172): n is a, c, g, or t

SEQ ID NO: 20323 - DNA, 170 bp, Homo sapiens
  misc_feature: GYAE6OF01C55LL.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggtttggggaagaggaagactgacggtccccaggagttcaggtgctggcacagcggccctgggctgcctggtcaaggactacttcctctctcgactctgagcgggctggcaaggcgcatagn

SEQ ID NO: 20324 - DNA, 173 bp, Homo sapiens; identical to SEQ ID NO: 20295
  misc_feature: GYAE6OF01ANB9N.49.53.E09.1.454.CMB.1.raw
  modified_base (172)..(173): a, c, t, g, unknown or other
  misc_feature (172)..(173): n is a, c, g, or t

SEQ ID NO: 20325 - DNA, 171 bp, Homo sapiens; identical to SEQ ID NO: 20210
  misc_feature: GYAE6OF01DPOBL.49.53.E09.1.454.CMB.1.raw
  modified_base (171)..(171): a, c, t, g, unknown or other
  misc_feature (171)..(171): n is a, c, g, or t

SEQ ID NO: 20326 - DNA, 171 bp, Homo sapiens
  misc_feature: GYAE6OF01EDDRR.49.53.E09.1.454.CMB.1.raw
  modified_base (171)..(171): a, c, t, g, unknown or other
  misc_feature (171)..(171): n is a, c, g, or t
tcagagtcgagagacacgaccggtgctcgatttagagagagtgtgttgggttggggaagaggaagactgaccggtccccaggagttcaggtgctgggcacagcggccctgggctgcctggtcaaggactacttcctctctcgactctgagcgggctggcaaggcgcatagn

SEQ ID NO: 20327 - DNA, 172 bp, Homo sapiens; identical to SEQ ID NO: 20254
  misc_feature: GYAE6OF01A0XE4.49.53.E09.1.454.CMB.1.raw
  modified_base (171)..(172): a, c, t, g, unknown or other
  misc_feature (171)..(172): n is a, c, g, or t

SEQ ID NO: 20328 - DNA, 171 bp, Homo sapiens; identical to SEQ ID NO: 20268
  misc_feature: GYAE6OF01BMEHP.49.53.E09.1.454.CMB.1.raw
  modified_base (170)..(171): a, c, t, g, unknown or other
  misc_feature (170)..(171): n is a, c, g, or t

SEQ ID NO: 20329 - DNA, 173 bp, Homo sapiens; identical to SEQ ID NO: 20229
  misc_feature: GYAE6OF01BZTUQ.49.53.E09.1.454.CMB.1.raw
  modified_base (173)..(173): a, c, t, g, unknown or other
  misc_feature (173)..(173): n is a, c, g, or t

SEQ ID NO: 20330 - DNA, 171 bp, Homo sapiens; identical to SEQ ID NO: 20210
  misc_feature: GYAE6OF01D00AX.49.53.E09.1.454.CMB.1.raw
  modified_base (171)..(171): a, c, t, g, unknown or other
  misc_feature (171)..(171): n is a, c, g, or t

SEQ ID NO: 20331 - DNA, 172 bp, Homo sapiens; identical to SEQ ID NO: 20254
  misc_feature: GYAE6OF01AKR8L.49.53.E09.1.454.CMB.1.raw
  modified_base (171)..(172): a, c, t, g, unknown or other
  misc_feature (171)..(172): n is a, c, g, or t

SEQ ID NO: 20332 - DNA, 174 bp, Homo sapiens; identical to SEQ ID NO: 20265
  misc_feature: GYAE6OF01EB260.49.53.E09.1.454.CMB.1.raw
  modified_base (173)..(174): a, c, t, g, unknown or other
  misc_feature (173)..(174): n is a, c, g, or t

SEQ ID NO: 20333 - DNA, 170 bp, Homo sapiens
  misc_feature: GYAE6OF01EFD6S.49.53.E09.1.454.CMB.1.raw
  modified_base (168)..(170): a, c, t, g, unknown or other
  misc_feature (168)..(170): n is a, c, g, or t
tcagagtcgagagacacgaccggtgctcgatttagagagagtgtgttgggttggggaagaggaagactgacggtccccaggagttcaggtgctgggcacagcggccctgggctgcctggtcaaggactacttcctctctcgatctgagcggctggcaaggcgcatagnnn

SEQ ID NO: 20334 - DNA, 172 bp, Homo sapiens; identical to SEQ ID NO: 20254
  misc_feature: GYAE6OF01EKZPQ.49.53.E09.1.454.CMB.1.raw
  modified_base (171)..(172): a, c, t, g, unknown or other
  misc_feature (171)..(172): n is a, c, g, or t

SEQ ID NO: 20335 - DNA, 173 bp, Homo sapiens; identical to SEQ ID NO: 20229
  misc_feature: GYAE6OF01BZ7YS.49.53.E09.1.454.CMB.1.raw
  modified_base (173)..(173): a, c, t, g, unknown or other
  misc_feature (173)..(173): n is a, c, g, or t

SEQ ID NO: 20336 - DNA, 174 bp, Homo sapiens; identical to SEQ ID NO: 20265
  misc_feature: GYAE6OF01EA81V.49.53.E09.1.454.CMB.1.raw
  modified_base (173)..(174): a, c, t, g, unknown or other
  misc_feature (173)..(174): n is a, c, g, or t

SEQ ID NO: 20337 - DNA, 173 bp, Homo sapiens
  misc_feature: GYAE6OF01B0B4J.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagn

SEQ ID NO: 20338 - DNA, 172 bp, Homo sapiens; identical to SEQ ID NO: 20281
  misc_feature: GYAE6OF01D6GUW.49.53.E09.1.454.CMB.1.raw
  modified_base (172)..(172): a, c, t, g, unknown or other
  misc_feature (172)..(172): n is a, c, g, or t

SEQ ID NO: 20339 - DNA, 171 bp, Homo sapiens; identical to SEQ ID NO: 20210
  misc_feature: GYAE6OF01CZDYR.49.53.E09.1.454.CMB.1.raw
  modified_base (171)..(171): a, c, t, g, unknown or other
  misc_feature (171)..(171): n is a, c, g, or t

SEQ ID NO: 20340 - DNA, 173 bp, Homo sapiens; identical to SEQ ID NO: 20229
  misc_feature: GYAE6OF01DA1O7.49.53.E09.1.454.CMB.1.raw
  modified_base (173)..(173): a, c, t, g, unknown or other
  misc_feature (173)..(173): n is a, c, g, or t

SEQ ID NO: 20341 - DNA, 176 bp, Homo sapiens
  misc_feature: GYAE6OF01B334P.49.53.E09.1.454.CMB.1.raw
  modified_base (172)..(176): a, c, t, g, unknown or other
  misc_feature (172)..(176): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctctctcgactctgagcgggctggcaaggcgcatagnnnnn

SEQ ID NO: 20342 - DNA, 173 bp, Homo sapiens; identical to SEQ ID NO: 20229
  misc_feature: GYAE6OF01DUBOZ.49.53.E09.1.454.CMB.1.raw
  modified_base (173)..(173): a, c, t, g, unknown or other
  misc_feature (173)..(173): n is a, c, g, or t

SEQ ID NO: 20343 - DNA, 173 bp, Homo sapiens; identical to SEQ ID NO: 20337
  misc_feature: GYAE6OF01B01HW.49.53.E09.1.454.CMB.1.raw
  modified_base (173)..(173): a, c, t, g, unknown or other
  misc_feature (173)..(173): n is a, c, g, or t

SEQ ID NO: 20344 - DNA, 497 bp, Homo sapiens
  misc_feature: GYAE6OF01DTZ3Z.49.53.E09.1.454.CMB.1.raw
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagctttgagaggccctnagggacccctgagcgattctctggctccagctcagggacaacngtcaccttgaccatcagtgagtccggcagaggacgaggctgactattactgtcagtccgcagacagcagtggcagttatgtcgtattcggcggagggactacggctgaccgtctaggtcagcccaaggctcgcccctcggtcc

SEQ ID NO: 20345 - DNA, 176 bp, Homo sapiens; identical to SEQ ID NO: 20288
  misc_feature: GYAE6OF01AZOHM.49.53.E09.1.454.CMB.1.raw
  modified_base (171)..(176): a, c, t, g, unknown or other
  misc_feature (171)..(176): n is a, c, g, or t

SEQ ID NO: 20346 - DNA, 172 bp, Homo sapiens
  misc_feature: GYAE6OF01CY309.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctcgtagcactctgagcgggctggcaaggcgcatagn

SEQ ID NO: 20347 - DNA, 172 bp, Homo sapiens; identical to SEQ ID NO: 20254
  misc_feature: GYAE6OF01D8GXJ.49.53.E09.1.454.CMB.1.raw
  modified_base (171)..(172): a, c, t, g, unknown or other
  misc_feature (171)..(172): n is a, c, g, or t

SEQ ID NO: 20348 - DNA, 173 bp, Homo sapiens; identical to SEQ ID NO: 20229
  misc_feature: GYAE6OF01AJNHV.49.53.E09.1.454.CMB.1.raw
  modified_base (173)..(173): a, c, t, g, unknown or other
  misc_feature (173)..(173): n is a, c, g, or t

SEQ ID NO: 20349 - DNA, 213 bp, Homo sapiens
  misc_feature: GYAE6OF01AY1B0.49.53.E09.1.454.CMB.1.raw
  modified_base (173)..(178): a, c, t, g, unknown or other
  misc_feature (173)..(178): n is a, c, g, or t
  modified_base (180)..(213): a, c, t, g, unknown or other
  misc_feature (180)..(213): n is a, c, g, or t
tcagagtcgagagacacgaccggtgctcgatttagagagagtgtgttgggtttgggggaagaggaagactgacggtccccaggagttcaggtgctgggccacagcggccctgggctgcctggtcaaggactacttcctctctcgactctgagcgggctggcaaggcgcatagnnnnnntnnnnnnnnnnnnnnnnnnnnnnnnnnnnnnnnnn

SEQ ID NO: 20350 - DNA, 173 bp, Homo sapiens; identical to SEQ ID NO: 20229
  misc_feature: GYAE6OF01EFR39.49.53.E09.1.454.CMB.1.raw
  modified_base (173)..(173): a, c, t, g, unknown or other
  misc_feature (173)..(173): n is a, c, g, or t

SEQ ID NO: 20351 - DNA, 168 bp, Homo sapiens
  misc_feature: GYAE6OF01C1GA8.49.53.E09.1.454.CMB.1.raw
  modified_base (167)..(168): a, c, t, g, unknown or other
  misc_feature (167)..(168): n is a, c, g, or t
tcagagtcgagagacacgaccggtgctcgatttagagagagtgtgttgggttgggaagaggaagactgacggtcccaggagttcaggtgctggcacagcggccctgggctgcctggtcaaggactacttcctctctcgactctgagcgggctggcaaggcgcatagnn

SEQ ID NO: 20352 - DNA, 173 bp, Homo sapiens; identical to SEQ ID NO: 20295
  misc_feature: GYAE6OF01C31Q5.49.53.E09.1.454.CMB.1.raw
  modified_base (172)..(173): a, c, t, g, unknown or other
  misc_feature (172)..(173): n is a, c, g, or t

SEQ ID NO: 20353 - DNA, 173 bp, Homo sapiens; identical to SEQ ID NO: 20229
  misc_feature: GYAE6OF01DAR6R.49.53.E09.1.454.CMB.1.raw
  modified_base (173)..(173): a, c, t, g, unknown or other
  misc_feature (173)..(173): n is a, c, g, or t

SEQ ID NO: 20354 - DNA, 174 bp, Homo sapiens
  misc_feature: GYAE6OF01BNDPL.49.53.E09.1.454.CMB.1.raw
  modified_base (171)..(174): a, c, t, g, unknown or other
  misc_feature (171)..(174): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnnnn

SEQ ID NO: 20355 - DNA, 172 bp, Homo sapiens; identical to SEQ ID NO: 20291
  misc_feature: GYAE6OF01ETL77.49.53.E09.1.454.CMB.1.raw

SEQ ID NO: 20356 - DNA, 182 bp, Homo sapiens
  misc_feature: GYAE6OF01A80VQ.49.53.E09.1.454.CMB.1.raw
  modified_base (174)..(182): a, c, t, g, unknown or other
  misc_feature (174)..(182): n is a, c, g, or t
tcagagtcgagagacacgaccggtgctcgatttagagagagtgtgttgggtttgggggaagaggaagactggacggtcccccaggagttcaggtgctgggcacagcggccctgggctgcctggtcaaggactacttcctctctcgactctgagcgggctggcaaggcgcatagnnnnnnnnn

SEQ ID NO: 20357 - DNA, 172 bp, Homo sapiens; identical to SEQ ID NO: 20254
  misc_feature: GYAE6OF01AT80S.49.53.E09.1.454.CMB.1.raw
  modified_base (171)..(172): a, c, t, g, unknown or other
  misc_feature (171)..(172): n is a, c, g, or t

SEQ ID NO: 20358 - DNA, 188 bp, Homo sapiens
  misc_feature: GYAE6OF01EJ28W.49.53.E09.1.454.CMB.1.raw
  modified_base (171)..(188): a, c, t, g, unknown or other
  misc_feature (171)..(188): n is a, c, g, or t
tcagagtcgagagacacgaccggtgctcgatttagagagagtgtgttgggtttggggaagaggaagactgacggtccccaggagttcaggtgctgggcacagcggcctgggctgcctggtcaaggactacttcctctctcgactctgagcgggctgggcaaggcgcatagnnnnnnnnnnnnnnnnnn

SEQ ID NO: 20359 - DNA, 174 bp, Homo sapiens; identical to SEQ ID NO: 20265
  misc_feature: GYAE6OF01DEB5V.49.53.E09.1.454.CMB.1.raw
  modified_base (173)..(174): a, c, t, g, unknown or other
  misc_feature (173)..(174): n is a, c, g, or t

SEQ ID NO: 20360 - DNA, 177 bp, Homo sapiens
  misc_feature: GYAE6OF01CRI45.49.53.E09.1.454.CMB.1.raw
  modified_base (170)..(177): a, c, t, g, unknown or other
  misc_feature (170)..(177): n is a, c, g, or t
tcagagtcgagagacacgaccggtgctcgatttagagagagtgtgttgggttggggaagaggaagactgacggtccccaggagttcaggtgctgggcacagcggccctgggctgcctggtcaaggactacttcctctctcgactctgagcgggctggcaaggcgcatagnnnnnnnn

SEQ ID NO: 20361 - DNA, 170 bp, Homo sapiens
  misc_feature: GYAE6OF01AE28L.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaactacttcctctctcgactctgagcgggctggcaaggcgcatagn

SEQ ID NO: 20362 - DNA, 173 bp, Homo sapiens; identical to SEQ ID NO: 20229
  misc_feature: GYAE6OF01DTNGO.49.53.E09.1.454.CMB.1.raw
  modified_base (173)..(173): a, c, t, g, unknown or other
  misc_feature (173)..(173): n is a, c, g, or t

SEQ ID NO: 20363 - DNA, 173 bp, Homo sapiens; identical to SEQ ID NO: 20229
  misc_feature: GYAE6OF01DKOZ2.49.53.E09.1.454.CMB.1.raw
  modified_base (173)..(173): a, c, t, g, unknown or other
  misc_feature (173)..(173): n is a, c, g, or t

SEQ ID NO: 20364 - DNA, 173 bp, Homo sapiens; identical to SEQ ID NO: 20258
  misc_feature: GYAE6OF01DSAD3.49.53.E09.1.454.CMB.1.raw
  modified_base (172)..(173): a, c, t, g, unknown or other
  misc_feature (172)..(173): n is a, c, g, or t

SEQ ID NO: 20365 - DNA, 171 bp, Homo sapiens; identical to SEQ ID NO: 20210
  misc_feature: GYAE6OF01ENBUG.49.53.E09.1.454.CMB.1.raw
  modified_base (171)..(171): a, c, t, g, unknown or other
  misc_feature (171)..(171): n is a, c, g, or t

SEQ ID NO: 20366 - DNA, 200 bp, Homo sapiens
  misc_feature: GYAE6OF01C396Y.49.53.E09.1.454.CMB.1.raw
  modified_base (176)..(200): a, c, t, g, unknown or other
  misc_feature (176)..(200): n is a, c, g, or t
tcagagtcgagagacacgaccggtgctcgatttagagagagtgtgttgggttgggggaagaggaagactcgaccggtcccccaggagttcaggtgctgggcacagcggccctgggctgccctggtcaagggactacttcctctctcgactctgagcgggctggcaaggcgcatagnnnnnnnnnnnnnnnnnnnnnnnnn

SEQ ID NO: 20367 - DNA, 169 bp, Homo sapiens
  misc_feature: GYAE6OF01AED2M.49.53.E09.1.454.CMB.1.raw
  modified_base (169)..(169): a, c, t, g, unknown or other
  misc_feature (169)..(169): n is a, c, g, or t
tcagagtcgagagacacgaccggtgctcgatttagagagagtgtgttggtttggggaagaggaagactgacggtccccaggagttcaggtgctgggcacagcggcctgggctgcctggtcaaggactacttcctctctcgactctgagcgggctggcaaggcgcatagn

SEQ ID NO: 20368 - DNA, 197 bp, Homo sapiens
  misc_feature: GYAE6OF01D5ZJV.49.53.E09.1.454.CMB.1.raw
  modified_base (173)..(197): a, c, t, g, unknown or other
  misc_feature (173)..(197): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctctctcgactctgagcgggctggcaaggcgtcatagnnnnnnnnnnnnnnnnnnnnnnnnn

SEQ ID NO: 20369 - DNA, 171 bp, Homo sapiens; identical to SEQ ID NO: 20210
  misc_feature: GYAE6OF01EW5NV.49.53.E09.1.454.CMB.1.raw
  modified_base (171)..(171): a, c, t, g, unknown or other
  misc_feature (171)..(171): n is a, c, g, or t

SEQ ID NO: 20370 - DNA, 173 bp, Homo sapiens; identical to SEQ ID NO: 20258
  misc_feature: GYAE6OF01BD2RQ.49.53.E09.1.454.CMB.1.raw
  modified_base (172)..(173): a, c, t, g, unknown or other
  misc_feature (172)..(173): n is a, c, g, or t

SEQ ID NO: 20371 - DNA, 180 bp, Homo sapiens
  misc_feature: GYAE6OF01E146D.49.53.E09.1.454.CMB.1.raw
  modified_base (171)..(180): a, c, t, g, unknown or other
  misc_feature (171)..(180): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnnnnnnnnnn

SEQ ID NO: 20372 - DNA, 183 bp, Homo sapiens
  misc_feature: GYAE6OF01EOAQZ.49.53.E09.1.454.CMB.1.raw
  modified_base (174)..(183): a, c, t, g, unknown or other
  misc_feature (174)..(183): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggcttggcaaggcgcatagnnnnnnnnnn

SEQ ID NO: 20373 - DNA, 588 bp, Homo sapiens
  misc_feature: GYAE6OF01D0RBF.49.53.E09.1.454.CMB.1.raw
  modified_base (186)..(187): a, c, t, g, unknown or other
  misc_feature (186)..(187): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
  modified_base (552)..(552): a, c, t, g, unknown or other
  misc_feature (552)..(552): n is a, c, g, or t
tcagagtcgagagacacgaccggtgctcgatttagagagagtgtgttggggttgggggaagaggaagactggacggtcccccaggagttccaggtgtctgggtcacagtcggccctggctgcctggtcaaggctacgtcctctctcgactctcgagtcgggctgggcctaacggcggtcattacgnnggcagngcncatcactgcatcagcagntgttacangctcaagatacactctgcttgaccagcagaaccnggacagccctagtccntattcnggcngtcgtaccggntccggtcctgaccntcngagcagcgtcnggactgcttcactctcactntcactaacctgaccgaggcttacgaacgtcgtgtcggtaccttagggtttaactccgtaggttcaacggtactaacgttcctaagttaccggtcccttacgtaccccgttgtaaccgggtttccgacggttaaaccgccgttaaggcgtaacgtacgtacgtaaacgtcgtcgttaccggcttcggacctacggcttcgtcggttcttacngttcccgttacgacttagttacgcggttactaccgg

SEQ ID NO: 20374 - DNA, 173 bp, Homo sapiens; identical to SEQ ID NO: 20229
  misc_feature: GYAE6OF01C4GDK.49.53.E09.1.454.CMB.1.raw
  modified_base (173)..(173): a, c, t, g, unknown or other
  misc_feature (173)..(173): n is a, c, g, or t

SEQ ID NO: 20375 - DNA, 173 bp, Homo sapiens; identical to SEQ ID NO: 20229
  misc_feature: GYAE6OF01BNQWM.49.53.E09.1.454.CMB.1.raw
  modified_base (173)..(173): a, c, t, g, unknown or other
  misc_feature (173)..(173): n is a, c, g, or t

SEQ ID NO: 20376 - DNA, 173 bp, Homo sapiens; identical to SEQ ID NO: 20229
  misc_feature: GYAE6OF01EH3IV.49.53.E09.1.454.CMB.1.raw
  modified_base (173)..(173): a, c, t, g, unknown or other
  misc_feature (173)..(173): n is a, c, g, or t

SEQ ID NO: 20377 - DNA, 196 bp, Homo sapiens
  misc_feature: GYAE6OF01BKWZW.49.53.E09.1.454.CMB.1.raw
  modified_base (175)..(196): a, c, t, g, unknown or other
  misc_feature (175)..(196): n is a, c, g, or t
tcagagtcgagagacacgaccggtgctcgatttagagagagtgtgttgggtttggggggaagaggaagactgacggtcccccaggagttcgaggtgctgggcacagcggccctgggctgcctggtcaaggactacttcctctctcgactctgagcgggctggcaaggcgcatagnnnnnnnnnnnnnnnnnnnnnn

SEQ ID NO: 20378 - DNA, 172 bp, Homo sapiens
  misc_feature: GYAE6OF01D9UTV.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgacctgagcgggctggcaaggcgcatagn

SEQ ID NO: 20379 - DNA, 171 bp, Homo sapiens; identical to SEQ ID NO: 20210
  misc_feature: GYAE6OF01CF9G3.49.53.E09.1.454.CMB.1.raw
  modified_base (171)..(171): a, c, t, g, unknown or other
  misc_feature (171)..(171): n is a, c, g, or t

SEQ ID NO: 20380 - DNA, 173 bp, Homo sapiens; identical to SEQ ID NO: 20229
  misc_feature: GYAE6OF01ECB2B.49.53.E09.1.454.CMB.1.raw
  modified_base (173)..(173): a, c, t, g, unknown or other
  misc_feature (173)..(173): n is a, c, g, or t

SEQ ID NO: 20381 - DNA, 186 bp, Homo sapiens
  misc_feature: GYAE6OF01B00MQ.49.53.E09.1.454.CMB.1.raw
  modified_base (173)..(186): a, c, t, g, unknown or other
  misc_feature (173)..(186): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnn

SEQ ID NO: 20382 - DNA, 204 bp, Homo sapiens
  misc_feature: GYAE6OF01BENYX.49.53.E09.1.454.CMB.1.raw
  modified_base (175)..(204): a, c, t, g, unknown or other
  misc_feature (175)..(204): n is a, c, g, or t
tcagagtcgagagacacgaccggtgctcgatttagagagagtgtgttgggtttgggggaagaggaagactgacggtccccaggagttcaggtgctgggcacagcggccctgggcgtgcctggtcaaggacgtacttcctctctcgactctgagcgggctggcaaggcgtcatagnnnnnnnnnnnnnnnnnnnnnnnnnnnnnn

SEQ ID NO: 20383 - DNA, 173 bp, Homo sapiens; identical to SEQ ID NO: 20229
  misc_feature: GYAE6OF01AR54B.49.53.E09.1.454.CMB.1.raw
  modified_base (173)..(173): a, c, t, g, unknown or other
  misc_feature (173)..(173): n is a, c, g, or t

SEQ ID NO: 20384 - DNA, 182 bp, Homo sapiens; identical to SEQ ID NO: 20300
  misc_feature: GYAE6OF01BSMN8.49.53.E09.1.454.CMB.1.raw
  modified_base (173)..(182): a, c, t, g, unknown or other
  misc_feature (173)..(182): n is a, c, g, or t

SEQ ID NO: 20385 - DNA, 171 bp, Homo sapiens; identical to SEQ ID NO: 20210
  misc_feature: GYAE6OF01DRR08.49.53.E09.1.454.CMB.1.raw
  modified_base (171)..(171): a, c, t, g, unknown or other
  misc_feature (171)..(171): n is a, c, g, or t

SEQ ID NO: 20386 - DNA, 173 bp, Homo sapiens; identical to SEQ ID NO: 20229
  misc_feature: GYAE6OF01BPYTU.49.53.E09.1.454.CMB.1.raw
  modified_base (173)..(173): a, c, t, g, unknown or other
  misc_feature (173)..(173): n is a, c, g, or t

SEQ ID NO: 20387 - DNA, 191 bp, Homo sapiens
  misc_feature: GYAE6OF01E38XF.49.53.E09.1.454.CMB.1.raw
  modified_base (190)..(191): a, c, t, g, unknown or other
  misc_feature (190)..(191): n is a, c, g, or t
tcagagtcgagagacacgaccggtgctcgatttagagagagtgtgttgggtttgggggaagaggaagactgacggtcccccaggagttcaggtgctgggcacgaggccggccgtgggctcgccgtggtacgaaggtacttaccttcctctctcgactctgaggcgggtcgtggacgaaggcgcaagtagnn

SEQ ID NO: 20388 - DNA, 173 bp, Homo sapiens; identical to SEQ ID NO: 20229
  misc_feature: GYAE6OF01DQL6D.49.53.E09.1.454.CMB.1.raw
  modified_base (173)..(173): a, c, t, g, unknown or other
  misc_feature (173)..(173): n is a, c, g, or t

SEQ ID NO: 20389 - DNA, 243 bp, Homo sapiens
  misc_feature: GYAE6OF01B9AWH.49.53.E09.1.454.CMB.1.raw
  modified_base (179)..(180): a, c, t, g, unknown or other
  misc_feature (179)..(180): n is a, c, g, or t
  modified_base (182)..(183): a, c, t, g, unknown or other
  misc_feature (182)..(183): n is a, c, g, or t
  modified_base (185)..(243): a, c, t, g, unknown or other
  misc_feature (185)..(243): n is a, c, g, or t
tcagagtcgagagacacgaccggtgctcgatttagagagagtgtgttgggtttggggggaagaggaagactgacggtccccccaggagttcaggtgctgggcacagccggccctgggctgcctggtccaaggactacttcctctctcgacgtctgagcgggctggcaaggcgccatagnncnncnnnnnnnnnnnnnnnnnnnnnnnnnnnnnnnnnnnnnnnnnnnnnnnnnnnnnnnnnnn

SEQ ID NO: 20390 - DNA, 171 bp, Homo sapiens; identical to SEQ ID NO: 20272
  misc_feature: GYAE6OF01C5CHH.49.53.E09.1.454.CMB.1.raw
  modified_base (171)..(171): a, c, t, g, unknown or other
  misc_feature (171)..(171): n is a, c, g, or t

SEQ ID NO: 20391 - DNA, 172 bp, Homo sapiens
  misc_feature: GYAE6OF01BL8PJ.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgtgggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 20392 - DNA, 173 bp, Homo sapiens; identical to SEQ ID NO: 20229
  misc_feature: GYAE6OF01CBZSG.49.53.E09.1.454.CMB.1.raw
  modified_base (173)..(173): a, c, t, g, unknown or other
  misc_feature (173)..(173): n is a, c, g, or t

SEQ ID NO: 20393 - DNA, 173 bp, Homo sapiens; identical to SEQ ID NO: 20337
  misc_feature: GYAE6OF01DN0BM.49.53.E09.1.454.CMB.1.raw
  modified_base (173)..(173): a, c, t, g, unknown or other
  misc_feature (173)..(173): n is a, c, g, or t

SEQ ID NO: 20394 - DNA, 173 bp, Homo sapiens; identical to SEQ ID NO: 20229
  misc_feature: GYAE6OF01A7IQT.49.53.E09.1.454.CMB.1.raw
  modified_base (173)..(173): a, c, t, g, unknown or other
  misc_feature (173)..(173): n is a, c, g, or t

SEQ ID NO: 20395 - DNA, 173 bp, Homo sapiens; identical to SEQ ID NO: 20229
  misc_feature: GYAE6OF01DL5PO.49.53.E09.1.454.CMB.1.raw
  modified_base (173)..(173): a, c, t, g, unknown or other
  misc_feature (173)..(173): n is a, c, g, or t

SEQ ID NO: 20396 - DNA, 173 bp, Homo sapiens; identical to SEQ ID NO: 20229
  misc_feature: GYAE6OF01CVKXG.49.53.E09.1.454.CMB.1.raw
  modified_base (173)..(173): a, c, t, g, unknown or other
  misc_feature (173)..(173): n is a, c, g, or t

SEQ ID NO: 20397 - DNA, 179 bp, Homo sapiens
  misc_feature: GYAE6OF01CG17R.49.53.E09.1.454.CMB.1.raw
  modified_base (173)..(179): a, c, t, g, unknown or other
  misc_feature (173)..(179): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnn

SEQ ID NO: 20398 - DNA, 173 bp, Homo sapiens; identical to SEQ ID NO: 20229
  misc_feature: GYAE6OF01BTBKX.49.53.E09.1.454.CMB.1.raw
  modified_base (173)..(173): a, c, t, g, unknown or other
  misc_feature (173)..(173): n is a, c, g, or t

SEQ ID NO: 20399 - DNA, 173 bp, Homo sapiens; identical to SEQ ID NO: 20229
  misc_feature: GYAE6OF01DRURI.49.53.E09.1.454.CMB.1.raw
  modified_base (173)..(173): a, c, t, g, unknown or other
  misc_feature (173)..(173): n is a, c, g, or t

SEQ ID NO: 20400 - DNA, 172 bp, Homo sapiens
  misc_feature: GYAE6OF01B0JU9.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagn

SEQ ID NO: 20401 - DNA, 210 bp, Homo sapiens
  misc_feature: GYAE6OF01A2X90.49.53.E09.1.454.CMB.1.raw
  modified_base (172)..(210): a, c, t, g, unknown or other
  misc_feature (172)..(210): n is a, c, g, or t
tcagagtcgagagacacgaccggtgctcgatttagagagagtgtgttgggttggggaagaggaagactgacggtccccaggagttcaggtgcttcgggcacagcggccctgggctgcctggtcaaggactacttcctctctcgactctgagcgggctggcaaggcgcatagnnnnnnnnnnnnnnnnnnnnnnnnnnnnnnnnnnnnnnn

SEQ ID NO: 20402 - DNA, 170 bp, Homo sapiens
  misc_feature: GYAE6OF01EZ04A.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggtttggggaagaggaagactgaccggtccccaggagttcaggtgctgggcacagcggcctggctgcctggtcaaggactacttcctcgtagcactctgagcgggctggcaaggcgcatagn

SEQ ID NO: 20403 - DNA, 173 bp, Homo sapiens; identical to SEQ ID NO: 20229
  misc_feature: GYAE6OF01DB53I.49.53.E09.1.454.CMB.1.raw
  modified_base (173)..(173): a, c, t, g, unknown or other
  misc_feature (173)..(173): n is a, c, g, or t

SEQ ID NO: 20404 - DNA, 171 bp, Homo sapiens; identical to SEQ ID NO: 20268
  misc_feature: GYAE6OF01DNLZE.49.53.E09.1.454.CMB.1.raw
  modified_base (170)..(171): a, c, t, g, unknown or other
  misc_feature (170)..(171): n is a, c, g, or t

SEQ ID NO: 20405 - DNA, 182 bp, Homo sapiens
  misc_feature: GYAE6OF01BD0GL.49.53.E09.1.454.CMB.1.raw
  modified_base (170)..(182): a, c, t, g, unknown or other
  misc_feature (170)..(182): n is a, c, g, or t
tcagagtcgagagacacgaccggtgctcgatttagagagagtgtgttgggttggggaagaggaagactgacggtccccaggagttcaggtgctgggcacagcggccctgggctgcctggtcaaggactacttcctctctcgactctgagcgggctggcaaggcgcatagnnnnnnnnnnnnn

SEQ ID NO: 20406 - DNA, 171 bp, Homo sapiens; identical to SEQ ID NO: 20210
  misc_feature: GYAE6OF01CAO3S.49.53.E09.1.454.CMB.1.raw
  modified_base (171)..(171): a, c, t, g, unknown or other
  misc_feature (171)..(171): n is a, c, g, or t

SEQ ID NO: 20407 - DNA, 173 bp, Homo sapiens; identical to SEQ ID NO: 20229
  misc_feature: GYAE6OF01A1SZW.49.53.E09.1.454.CMB.1.raw
  modified_base (173)..(173): a, c, t, g, unknown or other
  misc_feature (173)..(173): n is a, c, g, or t

SEQ ID NO: 20408 - DNA, 174 bp, Homo sapiens; identical to SEQ ID NO: 20265
  misc_feature: GYAE6OF01BQXXH.49.53.E09.1.454.CMB.1.raw
  modified_base (173)..(174): a, c, t, g, unknown or other
  misc_feature (173)..(174): n is a, c, g, or t

SEQ ID NO: 20409 - DNA, 167 bp, Homo sapiens
  misc_feature: GYAE6OF01E53H3.49.53.E09.1.454.CMB.1.raw
tcagagtcgagagacacgaccggtgctcgatttagagagagtgtgttgggttggggaagaggaagactgacggtccccaggagttcaggtgctgggcacagcggcctggctgcctggtcaaggactacttcctctctcgactctgagcgggctggcaaggcgcatag

SEQ ID NO: 20410 - DNA, 172 bp, Homo sapiens; identical to SEQ ID NO: 20254
  misc_feature: GYAE6OF01CLUSL.49.53.E09.1.454.CMB.1.raw
  modified_base (171)..(172): a, c, t, g, unknown or other
  misc_feature (171)..(172): n is a, c, g, or t

SEQ ID NO: 20411 - DNA, 172 bp, Homo sapiens; identical to SEQ ID NO: 20254
  misc_feature: GYAE6OF01B5F83.49.53.E09.1.454.CMB.1.raw
  modified_base (171)..(172): a, c, t, g, unknown or other
  misc_feature (171)..(172): n is a, c, g, or t

SEQ ID NO: 20412 - DNA, 171 bp, Homo sapiens; identical to SEQ ID NO: 20210
  misc_feature: GYAE6OF01DSQZ8.49.53.E09.1.454.CMB.1.raw
  modified_base (171)..(171): a, c, t, g, unknown or other
  misc_feature (171)..(171): n is a, c, g, or t

SEQ ID NO: 20413 - DNA, 173 bp, Homo sapiens; identical to SEQ ID NO: 20337
  misc_feature: GYAE6OF01C69HK.49.53.E09.1.454.CMB.1.raw
  modified_base (173)..(173): a, c, t, g, unknown or other
  misc_feature (173)..(173): n is a, c, g, or t

SEQ ID NO: 20414 - DNA, 182 bp, Homo sapiens
  misc_feature: GYAE6OF01CAGGW.49.53.E09.1.454.CMB.1.raw
  modified_base (172)..(182): a, c, t, g, unknown or other
  misc_feature (172)..(182): n is a, c, g, or t
tcagagtcgagagacacgaccggtgctcgatttagagagagtgtgttgggtttgggggaagaggaagactgacggtcccccaggagttcaggtgctgggcacagcggcctgggctgcctggtcaaggactacttcctctctcgactctgagcgggctggcaaggcgcatagnnnnnnnnnnn

SEQ ID NO: 20415 - DNA, 171 bp, Homo sapiens; identical to SEQ ID NO: 20210
  misc_feature: GYAE6OF01A2GM8.49.53.E09.1.454.CMB.1.raw
  modified_base (171)..(171): a, c, t, g, unknown or other
  misc_feature (171)..(171): n is a, c, g, or t

SEQ ID NO: 20416 - DNA, 192 bp, Homo sapiens
  misc_feature: GYAE6OF01DYTNQ.49.53.E09.1.454.CMB.1.raw
  modified_base (173)..(192): a, c, t, g, unknown or other
  misc_feature (173)..(192): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnnnnnnn

SEQ ID NO: 20417 - DNA, 186 bp, Homo sapiens
  misc_feature: GYAE6OF01DRU4L.49.53.E09.1.454.CMB.1.raw
  modified_base (172)..(186): a, c, t, g, unknown or other
  misc_feature (172)..(186): n is a, c, g, or t
tcagagtcgagagacacgaccggtgctcgatttagagagagtgtgttggggtttgggggaagaggaagactgacggtccccaggagttcaggtgctgggcacagcggccctgggctgcctggtcaaggctacttcctcgtagcactctgagcgggctggcaaggcgcatagnnnnnnnnnnnnnnn

SEQ ID NO: 20418 - DNA, 175 bp, Homo sapiens
  misc_feature: GYAE6OF01EMMQE.49.53.E09.1.454.CMB.1.raw
  modified_base (173)..(175): a, c, t, g, unknown or other
  misc_feature (173)..(175): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 20419 - DNA, 173 bp, Homo sapiens; identical to SEQ ID NO: 20229
  misc_feature: GYAE6OF01DSOEQ.49.53.E09.1.454.CMB.1.raw
  modified_base (173)..(173): a, c, t, g, unknown or other
  misc_feature (173)..(173): n is a, c, g, or t

SEQ ID NO: 20420 - DNA, 172 bp, Homo sapiens
  misc_feature: GYAE6OF01D6YHL.49.53.E09.1.454.CMB.1.raw
  modified_base (171)..(172): a, c, t, g, unknown or other
  misc_feature (171)..(172): n is a, c, g, or t
tcagagtcgagagacacgaccggtgctcgatttagagagagtgtgttgggtttgggggaagaggagactgacggtccccaggagttcaggtgctgggcacagcggccctgggctgcctggtcaaggactacttcctctctcgactctgagcgggctggcaaggcgcatagnn

SEQ ID NO: 20421 - DNA, 184 bp, Homo sapiens
  misc_feature: GYAE6OF01ECYRT.49.53.E09.1.454.CMB.1.raw
  modified_base (153)..(153): a, c, t, g, unknown or other
  misc_feature (153)..(153): n is a, c, g, or t
  modified_base (174)..(184): a, c, t, g, unknown or other
  misc_feature (174)..(184): n is a, c, g, or t
tcagagtcgagagacacgaccggtgctcgatttagagagagtgtgttgggtttgggggaagaggaagactggacggtcccccaggagttcaggtgctgggcacagcggccctgggctgcctggtcaaggactacttcctctctcgactctgancgggctggcaaggcgcatagnnnnnnnnnnn

SEQ ID NO: 20422 - DNA, 172 bp, Homo sapiens
  misc_feature: GYAE6OF01CCNNJ.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtcccccaggagttcaggtgctggcacagcggccctgggctgcctggtcaaggactacttcctctctcgactctgagcgggctggcaaggcgcatagn

SEQ ID NO: 20423 - DNA, 174 bp, Homo sapiens; identical to SEQ ID NO: 20265
  misc_feature: GYAE6OF01C6DBQ.49.53.E09.1.454.CMB.1.raw
  modified_base (173)..(174): a, c, t, g, unknown or other
  misc_feature (173)..(174): n is a, c, g, or t

SEQ ID NO: 20424 - DNA, 172 bp, Homo sapiens
  misc_feature: GYAE6OF01COXZ9.49.53.E09.1.454.CMB.1.raw
  modified_base (171)..(172): a, c, t, g, unknown or other
  misc_feature (171)..(172): n is a, c, g, or t
tcagagtcgagagacacgaccggtgctcgatttagagagagtgtgttgggtttggggaagaggaagactgaccggtccccaggagttcaggtgctggcacagcggccctgggctgcctggtcaaggactacttcctctctcgactctgagcgggctggcaaggcgcatagnn

SEQ ID NO: 20425 - DNA, 171 bp, Homo sapiens; identical to SEQ ID NO: 20210
  misc_feature: GYAE6OF01B63BH.49.53.E09.1.454.CMB.1.raw
  modified_base (171)..(171): a, c, t, g, unknown or other
  misc_feature (171)..(171): n is a, c, g, or t

SEQ ID NO: 20426 - DNA, 177 bp, Homo sapiens; identical to SEQ ID NO: 20321
  misc_feature: GYAE6OF01CL4TX.49.53.E09.1.454.CMB.1.raw
  modified_base (170)..(177): a, c, t, g, unknown or other
  misc_feature (170)..(177): n is a, c, g, or t

SEQ ID NO: 20427 - DNA, 229 bp, Homo sapiens
  misc_feature: GYAE6OF01EAS37.49.53.E09.1.454.CMB.1.raw
  modified_base (137)..(137): a, c, t, g, unknown or other
  misc_feature (137)..(137): n is a, c, g, or t
  modified_base (172)..(229): a, c, t, g, unknown or other
  misc_feature (172)..(229): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggctacttccncgtagcactctgagcgggctggcaaggcgcatagnnnnnnnnnnnnnnnnnnnnnnnnnnnnnnnnnnnnnnnnnnnnnnnnnnnnnnnnnn

SEQ ID NO: 20428 - DNA, 173 bp, Homo sapiens; identical to SEQ ID NO: 20229
  misc_feature: GYAE6OF01C6PST.49.53.E09.1.454.CMB.1.raw
  modified_base (173)..(173): a, c, t, g, unknown or other
  misc_feature (173)..(173): n is a, c, g, or t

SEQ ID NO: 20429 - DNA, 172 bp, Homo sapiens; identical to SEQ ID NO: 20346
  misc_feature: GYAE6OF01AXXO6.49.53.E09.1.454.CMB.1.raw
  modified_base (172)..(172): a, c, t, g, unknown or other
  misc_feature (172)..(172): n is a, c, g, or t

SEQ ID NO: 20430 - DNA, 180 bp, Homo sapiens; identical to SEQ ID NO: 20243
  misc_feature: GYAE6OF01DEZYP.49.53.E09.1.454.CMB.1.raw
  modified_base (173)..(180): a, c, t, g, unknown or other
  misc_feature (173)..(180): n is a, c, g, or t

SEQ ID NO: 20431 - DNA, 170 bp, Homo sapiens; identical to SEQ ID NO: 20251
  misc_feature: GYAE6OF01BQGPR.49.53.E09.1.454.CMB.1.raw
  modified_base (170)..(170): a, c, t, g, unknown or other
  misc_feature (170)..(170): n is a, c, g, or t

SEQ ID NO: 20432 - DNA, 172 bp, Homo sapiens; identical to SEQ ID NO: 20257
  misc_feature: GYAE6OF01B7ANC.49.53.E09.1.454.CMB.1.raw
  modified_base (170)..(172): a, c, t, g, unknown or other
  misc_feature (170)..(172): n is a, c, g, or t

SEQ ID NO: 20433 - DNA, 172 bp, Homo sapiens
  misc_feature: GYAE6OF01E3QET.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactactcctctctcgactctgagcgggctggcaaggcgcatagn

SEQ ID NO: 20434 - DNA, 173 bp, Homo sapiens; identical to SEQ ID NO: 20229
  misc_feature: GYAE6OF01CJQAU.49.53.E09.1.454.CMB.1.raw
  modified_base (173)..(173): a, c, t, g, unknown or other
  misc_feature (173)..(173): n is a, c, g, or t

SEQ ID NO: 20435 - DNA, 173 bp, Homo sapiens; identical to SEQ ID NO: 20229
  misc_feature: GYAE6OF01EDTIK.49.53.E09.1.454.CMB.1.raw
  modified_base (173)..(173): a, c, t, g, unknown or other
  misc_feature (173)..(173): n is a, c, g, or t

SEQ ID NO: 20436 - DNA, 171 bp, Homo sapiens; identical to SEQ ID NO: 20210
  misc_feature: GYAE6OF01DLPCM.49.53.E09.1.454.CMB.1.raw
  modified_base (171)..(171): a, c, t, g, unknown or other
  misc_feature (171)..(171): n is a, c, g, or t

SEQ ID NO: 20437 - DNA, 171 bp, Homo sapiens; identical to SEQ ID NO: 20210
  misc_feature: GYAE6OF01AXY2V.49.53.E09.1.454.CMB.1.raw
  modified_base (171)..(171): a, c, t, g, unknown or other
  misc_feature (171)..(171): n is a, c, g, or t

SEQ ID NO: 20438 - DNA, 173 bp, Homo sapiens; identical to SEQ ID NO: 20295
  misc_feature: GYAE6OF01BHWFS.49.53.E09.1.454.CMB.1.raw
  modified_base (172)..(173): a, c, t, g, unknown or other
  misc_feature (172)..(173): n is a, c, g, or t

SEQ ID NO: 20439 - DNA, 186 bp, Homo sapiens
  misc_feature: GYAE6OF01BIUOI.49.53.E09.1.454.CMB.1.raw
  modified_base (174)..(186): a, c, t, g, unknown or other
  misc_feature (174)..(186): n is a, c, g, or t
tcagagtcgagagacacgaccggtgctcgatttagagagagtgtgttgggtttgggggaagaggaagactgacggtcccccaggagttcaggtgctgggcacacgcggccctgggctgcctggtcaaggactacttcctctctcgactctgagcgggctggcaaggcgcatagnnnnnnnnnnnnn

SEQ ID NO: 20440 - DNA, 172 bp, Homo sapiens; identical to SEQ ID NO: 20254
  misc_feature: GYAE6OF01BZ1GU.49.53.E09.1.454.CMB.1.raw
  modified_base (171)..(172): a, c, t, g, unknown or other
  misc_feature (171)..(172): n is a, c, g, or t

SEQ ID NO: 20441 - DNA, 173 bp, Homo sapiens; identical to SEQ ID NO: 20337
  misc_feature: GYAE6OF01BUBVH.49.53.E09.1.454.CMB.1.raw
  modified_base (173)..(173): a, c, t, g, unknown or other
  misc_feature (173)..(173): n is a, c, g, or t

SEQ ID NO: 20442 - DNA, 173 bp, Homo sapiens
  misc_feature: GYAE6OF01A2R7I.49.53.E09.1.454.CMB.1.raw
  modified_base (172)..(173): a, c, t, g, unknown or other
  misc_feature (172)..(173): n is a, c, g, or t
tcagagtcgagagacacgaccggtgctcgatttagagagagtgtgttgggtttgggggaagaggaagactgacggtcccccaggagttcaggtgctgggcacagcggcctgggctgcctggtcaaggactacttcctcgtagcactctgagcgggctggcaaggcgcatagnn

SEQ ID NO: 20443 - DNA, 174 bp, Homo sapiens
  misc_feature: GYAE6OF01CT514.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaaggactacttcctctctcgactctgagcgggctggcaaggcgcatagn

SEQ ID NO: 20444 - DNA, 171 bp, Homo sapiens; identical to SEQ ID NO: 20210
  misc_feature: GYAE6OF01E47TJ.49.53.E09.1.454.CMB.1.raw
  modified_base (171)..(171): a, c, t, g, unknown or other
  misc_feature (171)..(171): n is a, c, g, or t

SEQ ID NO: 20445 - DNA, 173 bp, Homo sapiens; identical to SEQ ID NO: 20229
  misc_feature: GYAE6OF01B4WXX.49.53.E09.1.454.CMB.1.raw
  modified_base (173)..(173): a, c, t, g, unknown or other
  misc_feature (173)..(173): n is a, c, g, or t

SEQ ID NO: 20446 - DNA, 173 bp, Homo sapiens; identical to SEQ ID NO: 20295
  misc_feature: GYAE6OF01BI4S4.49.53.E09.1.454.CMB.1.raw
  modified_base (172)..(173): a, c, t, g, unknown or other
  misc_feature (172)..(173): n is a, c, g, or t

SEQ ID NO: 20447 - DNA, 175 bp, Homo sapiens; identical to SEQ ID NO: 20418
  misc_feature: GYAE6OF01CCUB1.49.53.E09.1.454.CMB.1.raw
  modified_base (173)..(175): a, c, t, g, unknown or other
  misc_feature (173)..(175): n is a, c, g, or t

SEQ ID NO: 20448 - DNA, 194 bp, Homo sapiens
  misc_feature: GYAE6OF01EJI4F.49.53.E09.1.454.CMB.1.raw
  modified_base (175)..(194): a, c, t, g, unknown or other
  misc_feature (175)..(194): n is a, c, g, or t
tcagagtcgagagacacgaccggtgctcgatttagagagagtgtgttgggtttgggggaaggaggaagactgacggtcccccaggagttcaggtgctgggccacagcggccctgggctgcctggtcaaggactacttcctctctcgactctgagcgggctggcaaggcgcatagnnnnnnnnnnnnnnnnnnnn

SEQ ID NO: 20449 - DNA, 173 bp, Homo sapiens; identical to SEQ ID NO: 20229
  misc_feature: GYAE6OF01CNUQP.49.53.E09.1.454.CMB.1.raw
  modified_base (173)..(173): a, c, t, g, unknown or other
  misc_feature (173)..(173): n is a, c, g, or t

SEQ ID NO: 20450 - DNA, 248 bp, Homo sapiens
  misc_feature: GYAE6OF01C5GK6.49.53.E09.1.454.CMB.1.raw
  modified_base (140)..(140): a, c, t, g, unknown or other
  misc_feature (140)..(140): n is a, c, g, or t
  modified_base (174)..(174): a, c, t, g, unknown or other
  misc_feature (174)..(174): n is a, c, g, or t
  modified_base (176)..(176): a, c, t, g, unknown or other
  misc_feature (176)..(176): n is a, c, g, or t
  modified_base (178)..(248): a, c, t, g, unknown or other
  misc_feature (178)..(248): n is a, c, g, or t
tcagagtcgagagacacgaccggtgctcgatttagagagagtgtgttgggttgggggaagaggaagactgaccggtcccccaggagttcaggtggcctgggcacagccggcccgtggctgcctggtcaaggctactctcnctcgactctgagcgggctggcaaggccgcatagncncnnnnnnnnnnnnnnnnnnnnnnnnnnnnnnnnnnnnnnnnnnnnnnnnnnnnnnnnnnnnnnnnnnnnnnn

SEQ ID NO: 20451 - DNA, 193 bp, Homo sapiens
  misc_feature: GYAE6OF01CK0JV.49.53.E09.1.454.CMB.1.raw
  modified_base (171)..(193): a, c, t, g, unknown or other
  misc_feature (171)..(193): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnnnnnnnnnnnnnnnnnnnnnnn

SEQ ID NO: 20452 - DNA, 172 bp, Homo sapiens; identical to SEQ ID NO: 20238
  misc_feature: GYAE6OF01BJG5F.49.53.E09.1.454.CMB.1.raw
  modified_base (172)..(172): a, c, t, g, unknown or other
  misc_feature (172)..(172): n is a, c, g, or t

SEQ ID NO: 20453 - DNA, 175 bp, Homo sapiens; identical to SEQ ID NO: 20418
  misc_feature: GYAE6OF01DR2P6.49.53.E09.1.454.CMB.1.raw
  modified_base (173)..(175): a, c, t, g, unknown or other
  misc_feature (173)..(175): n is a, c, g, or t

SEQ ID NO: 20454 - DNA, 173 bp, Homo sapiens; identical to SEQ ID NO: 20337
  misc_feature: GYAE6OF01AC86S.49.53.E09.1.454.CMB.1.raw
  modified_base (173)..(173): a, c, t, g, unknown or other
  misc_feature (173)..(173): n is a, c, g, or t

SEQ ID NO: 20455 - DNA, 174 bp, Homo sapiens; identical to SEQ ID NO: 20265
  misc_feature: GYAE6OF01CBIRA.49.53.E09.1.454.CMB.1.raw
  modified_base (173)..(174): a, c, t, g, unknown or other
  misc_feature (173)..(174): n is a, c, g, or t

SEQ ID NO: 20456 - DNA, 174 bp, Homo sapiens; identical to SEQ ID NO: 20265
  misc_feature: GYAE6OF01DS7SM.49.53.E09.1.454.CMB.1.raw
  modified_base (173)..(174): a, c, t, g, unknown or other
  misc_feature (173)..(174): n is a, c, g, or t

SEQ ID NO: 20457 - DNA, 173 bp, Homo sapiens; identical to SEQ ID NO: 20229
  misc_feature: GYAE6OF01DVCYT.49.53.E09.1.454.CMB.1.raw
  modified_base (173)..(173): a, c, t, g, unknown or other
  misc_feature (173)..(173): n is a, c, g, or t

SEQ ID NO: 20458 - DNA, 175 bp, Homo sapiens
  misc_feature: GYAE6OF01CM4D9.49.53.E09.1.454.CMB.1.raw
  modified_base (173)..(175): a, c, t, g, unknown or other
  misc_feature (173)..(175): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnn

SEQ ID NO: 20459 - DNA, 171 bp, Homo sapiens; identical to SEQ ID NO: 20272
  misc_feature: GYAE6OF01B4KRN.49.53.E09.1.454.CMB.1.raw
  modified_base (171)..(171): a, c, t, g, unknown or other
  misc_feature (171)..(171): n is a, c, g, or t

SEQ ID NO: 20460 - DNA, 172 bp, Homo sapiens
  misc_feature: GYAE6OF01D0NKK.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcctcgactctgagcgggctggcaaggcgcatagn

SEQ ID NO: 20461 - DNA, 173 bp, Homo sapiens; identical to SEQ ID NO: 20229
  misc_feature: GYAE6OF01CE2AE.49.53.E09.1.454.CMB.1.raw
  modified_base (173)..(173): a, c, t, g, unknown or other
  misc_feature (173)..(173): n is a, c, g, or t

SEQ ID NO: 20462 - DNA, 173 bp, Homo sapiens; identical to SEQ ID NO: 20229
  misc_feature: GYAE6OF01CDQXJ.49.53.E09.1.454.CMB.1.raw
  modified_base (173)..(173): a, c, t, g, unknown or other
  misc_feature (173)..(173): n is a, c, g, or t

SEQ ID NO: 20463 - DNA, 174 bp, Homo sapiens; identical to SEQ ID NO: 20265
  misc_feature: GYAE6OF01B0COM.49.53.E09.1.454.CMB.1.raw
  modified_base (173)..(174): a, c, t, g, unknown or other
  misc_feature (173)..(174): n is a, c, g, or t

SEQ ID NO: 20464 - DNA, 173 bp, Homo sapiens; identical to SEQ ID NO: 20229
  misc_feature: GYAE6OF01B87NI.49.53.E09.1.454.CMB.1.raw
  modified_base (173)..(173): a, c, t, g, unknown or other
  misc_feature (173)..(173): n is a, c, g, or t

SEQ ID NO: 20465 - DNA, 178 bp, Homo sapiens
  misc_feature: GYAE6OF01EBGR0.49.53.E09.1.454.CMB.1.raw
  modified_base (173)..(178): a, c, t, g, unknown or other
  misc_feature (173)..(178): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 20466 - DNA, 173 bp, Homo sapiens; identical to SEQ ID NO: 20229
  misc_feature: GYAE6OF01CRK78.49.53.E09.1.454.CMB.1.raw
  modified_base (173)..(173): a, c, t, g, unknown or other
  misc_feature (173)..(173): n is a, c, g, or t

SEQ ID NO: 20467 - DNA, 173 bp, Homo sapiens; identical to SEQ ID NO: 20229
  misc_feature: GYAE6OF01DA3T8.49.53.E09.1.454.CMB.1.raw
  modified_base (173)..(173): a, c, t, g, unknown or other
  misc_feature (173)..(173): n is a, c, g, or t

SEQ ID NO: 20468 - DNA, 173 bp, Homo sapiens; identical to SEQ ID NO: 20229
  misc_feature: GYAE6OF01DLWFA.49.53.E09.1.454.CMB.1.raw
  modified_base (173)..(173): a, c, t, g, unknown or other
  misc_feature (173)..(173): n is a, c, g, or t

SEQ ID NO: 20469 - DNA, 173 bp, Homo sapiens; identical to SEQ ID NO: 20337
  misc_feature: GYAE6OF01CG1ZI.49.53.E09.1.454.CMB.1.raw
  modified_base (173)..(173): a, c, t, g, unknown or other
  misc_feature (173)..(173): n is a, c, g, or t

SEQ ID NO: 20470 - DNA, 642 bp, Homo sapiens
  misc_feature: GYAE6OF01ENI6U.49.53.E09.1.454.CMB.1.raw
  modified_base (188)..(188): a, c, t, g, unknown or other
  misc_feature (188)..(188): n is a, c, g, or t
  modified_base (206)..(207): a, c, t, g, unknown or other
  misc_feature (206)..(207): n is a, c, g, or t
  modified_base (209)..(209): a, c, t, g, unknown or other
  misc_feature (209)..(209): n is a, c, g, or t
  modified_base (211)..(212): a, c, t, g, unknown or other
  misc_feature (211)..(212): n is a, c, g, or t
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
tcagagtcgagagacacgaccggtgctcgattttagagagagtgtggtttggggttttggggggggaagaggaaggacgtgacggtccccccaggagtttccgaggttgcctcgggcacgacgcgggccccttgggctgccttcggtccaacggcctacttcctctcgtcgactcgtcgaggccgggntggcaacggcgcatagcnncncnncnggncngacngtcatcacatctccngcncngacacangngtgtatatatctntctctcgtacaacaactaccgacaactaccaactacatgtatcttgtagtcgagtgcgtcgccgcgtcggttctctactcgtctccgtccgtctacgtacgtcgtcgcgacgcgaccgccgtcccgtaccgacctactcgtcgtcgtccgtccgtacgcgtacggacggacggacggtacgtagttacttacgttacgtcgtacgtacgtactactaactaactaactaaactaactaacgtacgttacggttacggttaccgggtaccgggtaccggtaaccgtaaccgtaccgtacccgtaccgtaccgtaccgtaccgaccgtaccgtaccgtcccgtacccgtccgtacctacctccgttcccgtcccgtccc

SEQ ID NO: 20471 - DNA, 176 bp, Homo sapiens; identical to SEQ ID NO: 20270
  misc_feature: GYAE6OF01EK74X.49.53.E09.1.454.CMB.1.raw
  modified_base (173)..(176): a, c, t, g, unknown or other
  misc_feature (173)..(176): n is a, c, g, or t

SEQ ID NO: 20472 - DNA, 171 bp, Homo sapiens; identical to SEQ ID NO: 20268
  misc_feature: GYAE6OF01EIXZG.49.53.E09.1.454.CMB.1.raw
  modified_base (170)..(171): a, c, t, g, unknown or other
  misc_feature (170)..(171): n is a, c, g, or t

SEQ ID NO: 20473 - DNA, 173 bp, Homo sapiens; identical to SEQ ID NO: 20229
  misc_feature: GYAE6OF01AGZ83.49.53.E09.1.454.CMB.1.raw
  modified_base (173)..(173): a, c, t, g, unknown or other
  misc_feature (173)..(173): n is a, c, g, or t

SEQ ID NO: 20474 - DNA, 173 bp, Homo sapiens; identical to SEQ ID NO: 20229
  misc_feature: GYAE6OF01CXYAR.49.53.E09.1.454.CMB.1.raw
  modified_base (173)..(173): a, c, t, g, unknown or other
  misc_feature (173)..(173): n is a, c, g, or t

SEQ ID NO: 20475 - DNA, 178 bp, Homo sapiens; identical to SEQ ID NO: 20465
  misc_feature: GYAE6OF01CVXCV.49.53.E09.1.454.CMB.1.raw
  modified_base (173)..(178): a, c, t, g, unknown or other
  misc_feature (173)..(178): n is a, c, g, or t

SEQ ID NO: 20476 - DNA, 174 bp, Homo sapiens; identical to SEQ ID NO: 20265
  misc_feature: GYAE6OF01CY6J8.49.53.E09.1.454.CMB.1.raw
  modified_base (173)..(174): a, c, t, g, unknown or other
  misc_feature (173)..(174): n is a, c, g, or t

SEQ ID NO: 20477 - DNA, 173 bp, Homo sapiens; identical to SEQ ID NO: 20229
  misc_feature: GYAE6OF01DYW6D.49.53.E09.1.454.CMB.1.raw
  modified_base (173)..(173): a, c, t, g, unknown or other
  misc_feature (173)..(173): n is a, c, g, or t

SEQ ID NO: 20478 - DNA, 183 bp, Homo sapiens
  misc_feature: GYAE6OF01BSUNW.49.53.E09.1.454.CMB.1.raw
  modified_base (170)..(170): a, c, t, g, unknown or other
  misc_feature (170)..(170): n is a, c, g, or t
  modified_base (176)..(183): a, c, t, g, unknown or other
  misc_feature (176)..(183): n is a, c, g, or t
tcagagtcgagagacacgaccggtgctcgatttagagagagtgtggttggggtttgggggaagaggaagactgaccggtcccccaggagttcaggtgctgggcacagcggccctgggcctgcctggtcaagactacttcctctctcgactctgagcgggctggcaaggcncatagnnnnnnnn

SEQ ID NO: 20479 - DNA, 173 bp, Homo sapiens; identical to SEQ ID NO: 20229
  misc_feature: GYAE6OF01CVBK2.49.53.E09.1.454.CMB.1.raw
  modified_base (173)..(173): a, c, t, g, unknown or other
  misc_feature (173)..(173): n is a, c, g, or t

SEQ ID NO: 20480 - DNA, 201 bp, Homo sapiens
  misc_feature: GYAE6OF01A5YCT.49.53.E09.1.454.CMB.1.raw
  modified_base (172)..(201): a, c, t, g, unknown or other
  misc_feature (172)..(201): n is a, c, g, or t
tcagagtcgagagacacgaccggtgctcgatttagagagagtgtgttgggttggggaagaggaagactgacggtcccccagggagttcaggtgctgggcacagcggccctgggctgcctggtcaaggactacttcctctctcgactctgagcgggctggcaaggcgcatagnnnnnnnnnnnnnnnnnnnnnnnnnnnnnn

SEQ ID NO: 20481 - DNA, 548 bp, Homo sapiens
  misc_feature: GYAE6OF01C3F5C.49.53.E09.1.454.CMB.1.raw
  modified_base (185)..(185): a, c, t, g, unknown or other
  misc_feature (185)..(185): n is a, c, g, or t
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
tcagagtcgagagacacgaccggtgctcgatttagagagagtgtgtttggggtttgggggtgggtccgagggaggcgagaacgtcgtgggtgtctcaccatggcctggatccctctacttcctcccctcctcactctctgcacagactctgaggcctctatgagctgacacagccacccgtggtntctgtgtcctgaggacaggacggccagtatccacctgctgtagganatcgctattcgaccaaaagctaaatntgcttactggtaccagcagaagccaggccacggcccctgtcttgatcatttataaagactttgagagggcctcgacgggaccctgagcgtattcncgtcgctcagctcagcgacaacncgtacacgttacgacctatcgaaggtggacggtcggcaggaggacgagctagactattactgtactagtcatcaagactaagtgtggctacgttcgtgttacgtagttcgggacgggtacggacaaggtcgtacggaccgtcgtacggtcaacggcccaagggtcctccccgg

SEQ ID NO: 20482 - DNA, 177 bp, Homo sapiens
  misc_feature: GYAE6OF01DYC3M.49.53.E09.1.454.CMB.1.raw
  modified_base (173)..(177): a, c, t, g, unknown or other
  misc_feature (173)..(177): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnn

SEQ ID NO: 20483 - DNA, 173 bp, Homo sapiens; identical to SEQ ID NO: 20337
  misc_feature: GYAE6OF01C703O.49.53.E09.1.454.CMB.1.raw
  modified_base (173)..(173): a, c, t, g, unknown or other
  misc_feature (173)..(173): n is a, c, g, or t

SEQ ID NO: 20484 - DNA, 173 bp, Homo sapiens; identical to SEQ ID NO: 20229
  misc_feature: GYAE6OF01CM1MY.49.53.E09.1.454.CMB.1.raw
  modified_base (173)..(173): a, c, t, g, unknown or other
  misc_feature (173)..(173): n is a, c, g, or t

SEQ ID NO: 20485 - DNA, 173 bp, Homo sapiens; identical to SEQ ID NO: 20337
  misc_feature: GYAE6OF01CWI4C.49.53.E09.1.454.CMB.1.raw
  modified_base (173)..(173): a, c, t, g, unknown or other
  misc_feature (173)..(173): n is a, c, g, or t

SEQ ID NO: 20486 - DNA, 204 bp, Homo sapiens
  misc_feature: GYAE6OF01CR2ZH.49.53.E09.1.454.CMB.1.raw
  modified_base (174)..(204): a, c, t, g, unknown or other
  misc_feature (174)..(204): n is a, c, g, or t
tcagagtcgagagacacgaccggtgctcgatttagagagagtgtgttgggtttgggggaagaggaagactgacggtcccccaggagttcaggtgctcggcacagcggccctgggctgcctggtcaaggactacttcctctctcgactctgagtcgggctggcaaggcgcatagnnnnnnnnnnnnnnnnnnnnnnnnnnnnnnn

SEQ ID NO: 20487 - DNA, 174 bp, Homo sapiens; identical to SEQ ID NO: 20265
  misc_feature: GYAE6OF01ERPFL.49.53.E09.1.454.CMB.1.raw
  modified_base (173)..(174): a, c, t, g, unknown or other
  misc_feature (173)..(174): n is a, c, g, or t

SEQ ID NO: 20488 - DNA, 173 bp, Homo sapiens; identical to SEQ ID NO: 20229
  misc_feature: GYAE6OF01CFN53.49.53.E09.1.454.CMB.1.raw
  modified_base (173)..(173): a, c, t, g, unknown or other
  misc_feature (173)..(173): n is a, c, g, or t

SEQ ID NO: 20489 - DNA, 173 bp, Homo sapiens; identical to SEQ ID NO: 20229
  misc_feature: GYAE6OF01B877M.49.53.E09.1.454.CMB.1.raw
  modified_base (173)..(173): a, c, t, g, unknown or other
  misc_feature (173)..(173): n is a, c, g, or t

SEQ ID NO: 20490 - DNA, 183 bp, Homo sapiens
  misc_feature: GYAE6OF01CRHT4.49.53.E09.1.454.CMB.1.raw
  modified_base (171)..(183): a, c, t, g, unknown or other
  misc_feature (171)..(183): n is a, c, g, or t
tcagagtcgagagacacgaccggtgctcgatttagagagagtgtgttgggtttggggaagaggaagactgacggtccccaggagttcaggtgctggcacagccggccctgggctgcctgggtcaaggctacttcctctctcgactctgagcgggctggcaaggcgcatagnnnnnnnnnnnnn

SEQ ID NO: 20491 - DNA, 180 bp, Homo sapiens
  misc_feature: GYAE6OF01EWS1K.49.53.E09.1.454.CMB.1.raw
  modified_base (172)..(180): a, c, t, g, unknown or other
  misc_feature (172)..(180): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggctacttcctcgtagcactctgagcgggctggcaaggcgcatagnnnnnnnnn

SEQ ID NO: 20492 - DNA, 173 bp, Homo sapiens; identical to SEQ ID NO: 20229
  misc_feature: GYAE6OF01EVP14.49.53.E09.1.454.CMB.1.raw
  modified_base (173)..(173): a, c, t, g, unknown or other
  misc_feature (173)..(173): n is a, c, g, or t

SEQ ID NO: 20493 - DNA, 171 bp, Homo sapiens; identical to SEQ ID NO: 20210
  misc_feature: GYAE6OF01B107V.49.53.E09.1.454.CMB.1.raw
  modified_base (171)..(171): a, c, t, g, unknown or other
  misc_feature (171)..(171): n is a, c, g, or t

SEQ ID NO: 20494 - DNA, 173 bp, Homo sapiens; identical to SEQ ID NO: 20229
  misc_feature: GYAE6OF01EP03G.49.53.E09.1.454.CMB.1.raw
  modified_base (173)..(173): a, c, t, g, unknown or other
  misc_feature (173)..(173): n is a, c, g, or t

SEQ ID NO: 20495 - DNA, 173 bp, Homo sapiens; identical to SEQ ID NO: 20229
  misc_feature: GYAE6OF01D7YTP.49.53.E09.1.454.CMB.1.raw
  modified_base (173)..(173): a, c, t, g, unknown or other
  misc_feature (173)..(173): n is a, c, g, or t

SEQ ID NO: 20496 - DNA, 173 bp, Homo sapiens; identical to SEQ ID NO: 20229
  misc_feature: GYAE6OF01EQ2CE.49.53.E09.1.454.CMB.1.raw
  modified_base (173)..(173): a, c, t, g, unknown or other
  misc_feature (173)..(173): n is a, c, g, or t

SEQ ID NO: 20497 - DNA, 173 bp, Homo sapiens; identical to SEQ ID NO: 20337
  misc_feature: GYAE6OF01C2XPS.49.53.E09.1.454.CMB.1.raw
  modified_base (173)..(173): a, c, t, g, unknown or other
  misc_feature (173)..(173): n is a, c, g, or t

SEQ ID NO: 20498 - DNA, 171 bp, Homo sapiens; identical to SEQ ID NO: 20210
  misc_feature: GYAE6OF01DACYT.49.53.E09.1.454.CMB.1.raw
  modified_base (171)..(171): a, c, t, g, unknown or other
  misc_feature (171)..(171): n is a, c, g, or t

SEQ ID NO: 20499 - DNA, 175 bp, Homo sapiens
  misc_feature: GYAE6OF01DYIZF.49.53.E09.1.454.CMB.1.raw
  modified_base (174)..(175): a, c, t, g, unknown or other
  misc_feature (174)..(175): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcgcatagnn

SEQ ID NO: 20500 - DNA, 173 bp, Homo sapiens; identical to SEQ ID NO: 20229
  misc_feature: GYAE6OF01CDWKD.49.53.E09.1.454.CMB.1.raw
  modified_base (173)..(173): a, c, t, g, unknown or other
  misc_feature (173)..(173): n is a, c, g, or t

SEQ ID NO: 20501 - DNA, 183 bp, Homo sapiens
  misc_feature: GYAE6OF01DQWWJ.49.53.E09.1.454.CMB.1.raw
  modified_base (172)..(183): a, c, t, g, unknown or other
  misc_feature (172)..(183): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnnnnnnnnn

SEQ ID NO: 20502 - DNA, 173 bp, Homo sapiens; identical to SEQ ID NO: 20229
  misc_feature: GYAE6OF01AILYN.49.53.E09.1.454.CMB.1.raw
  modified_base (173)..(173): a, c, t, g, unknown or other
  misc_feature (173)..(173): n is a, c, g, or t

SEQ ID NO: 20503 - DNA, 199 bp, Homo sapiens
  misc_feature: GYAE6OF01E2IE0.49.53.E09.1.454.CMB.1.raw
  modified_base (177)..(199): a, c, t, g, unknown or other
  misc_feature (177)..(199): n is a, c, g, or t
tcagagtcgagagacacgaccggtgctcgatttagagagagtgtggttagggtttgggggaacgaggaagactggaccggtcccccaggagttcaggtgctgggcacagcggccctgggctgcctggtcaaggactacttcctctctcgactctgagcggctggcaaggcgcatagnnnnnnnnnnnnnnnnnnnnnnn

SEQ ID NO: 20504 - DNA, 171 bp, Homo sapiens; identical to SEQ ID NO: 20268
  misc_feature: GYAE6OF01BMO89.49.53.E09.1.454.CMB.1.raw
  modified_base (170)..(171): a, c, t, g, unknown or other
  misc_feature (170)..(171): n is a, c, g, or t

SEQ ID NO: 20505 - DNA, 173 bp, Homo sapiens; identical to SEQ ID NO: 20229
  misc_feature: GYAE6OF01A9XEE.49.53.E09.1.454.CMB.1.raw
  modified_base (173)..(173): a, c, t, g, unknown or other
  misc_feature (173)..(173): n is a, c, g, or t

SEQ ID NO: 20506 - DNA, 173 bp, Homo sapiens; identical to SEQ ID NO: 20229
  misc_feature: GYAE6OF01D4IIS.49.53.E09.1.454.CMB.1.raw
  modified_base (173)..(173): a, c, t, g, unknown or other
  misc_feature (173)..(173): n is a, c, g, or t

SEQ ID NO: 20507 - DNA, 174 bp, Homo sapiens; identical to SEQ ID NO: 20265
  misc_feature: GYAE6OF01COAXM.49.53.E09.1.454.CMB.1.raw
  modified_base (173)..(174): a, c, t, g, unknown or other
  misc_feature (173)..(174): n is a, c, g, or t

SEQ ID NO: 20508 - DNA, 184 bp, Homo sapiens
  misc_feature: GYAE6OF01EY73F.49.53.E09.1.454.CMB.1.raw
  modified_base (173)..(184): a, c, t, g, unknown or other
  misc_feature (173)..(184): n is a, c, g, or t
tcagagtcgagagacacgaccggtgctcgatttagagagagtgtgttgggttgggggaagaggaagactgacggtcccccaggagttcaggtgctgggccacagcggccctggactgcctggtcaaggactacttcttctctcgactctgagcgggctggcaaggcgcatagnnnnnnnnnnnn

SEQ ID NO: 20509 - DNA, 173 bp, Homo sapiens; identical to SEQ ID NO: 20229
  misc_feature: GYAE6OF01EXJ3O.49.53.E09.1.454.CMB.1.raw
  modified_base (173)..(173): a, c, t, g, unknown or other
  misc_feature (173)..(173): n is a, c, g, or t

SEQ ID NO: 20510 - DNA, 172 bp, Homo sapiens; identical to SEQ ID NO: 20346
  misc_feature: GYAE6OF01EFFJM.49.53.E09.1.454.CMB.1.raw
  modified_base (172)..(172): a, c, t, g, unknown or other
  misc_feature (172)..(172): n is a, c, g, or t

SEQ ID NO: 20511 - DNA, 173 bp, Homo sapiens; identical to SEQ ID NO: 20229
  misc_feature: GYAE6OF01BEOS5.49.53.E09.1.454.CMB.1.raw
  modified_base (173)..(173): a, c, t, g, unknown or other
  misc_feature (173)..(173): n is a, c, g, or t

SEQ ID NO: 20512 - DNA, 172 bp, Homo sapiens; identical to SEQ ID NO: 20254
  misc_feature: GYAE6OF01D06ND.49.53.E09.1.454.CMB.1.raw
  modified_base (171)..(172): a, c, t, g, unknown or other
  misc_feature (171)..(172): n is a, c, g, or t

SEQ ID NO: 20513 - DNA, 219 bp, Homo sapiens
  misc_feature: GYAE6OF01AUWJ5.49.53.E09.1.454.CMB.1.raw
  modified_base (175)..(177): a, c, t, g, unknown or other
  misc_feature (175)..(177): n is a, c, g, or t
  modified_base (179)..(219): a, c, t, g, unknown or other
  misc_feature (179)..(219): n is a, c, g, or t
tcagagtcgagagacacgaccggtgctcgatttagagagagtgtgttgggtttgggggaagaggaagactgacggtcccccaggagttcaggtgctgggcacaagcggccctgggctgccgtggtcaaggactacttcctctctcgactctgagcgggctggcaaggcgcatagnnntnnnnnnnnnnnnnnnnnnnnnnnnnnnnnnnnnnnnnnnnn

SEQ ID NO: 20514 - DNA, 172 bp, Homo sapiens
  misc_feature: GYAE6OF01A5E0F.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttccttctcgactctgagcgggctggcaaggcgcatagn

SEQ ID NO: 20515 - DNA, 175 bp, Homo sapiens; identical to SEQ ID NO: 20418
  misc_feature: GYAE6OF01EJ07T.49.53.E09.1.454.CMB.1.raw
  modified_base (173)..(175): a, c, t, g, unknown or other
  misc_feature (173)..(175): n is a, c, g, or t

SEQ ID NO: 20516 - DNA, 195 bp, Homo sapiens
  misc_feature: GYAE6OF01ELARI.49.53.E09.1.454.CMB.1.raw
  modified_base (174)..(178): a, c, t, g, unknown or other
  misc_feature (174)..(178): n is a, c, g, or t
  modified_base (180)..(195): a, c, t, g, unknown or other
  misc_feature (180)..(195): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnngnnnnnnnnnnnnnnnn

SEQ ID NO: 20517 - DNA, 174 bp, Homo sapiens; identical to SEQ ID NO: 20265
  misc_feature: GYAE6OF01B1R18.49.53.E09.1.454.CMB.1.raw
  modified_base (173)..(174): a, c, t, g, unknown or other
  misc_feature (173)..(174): n is a, c, g, or t

SEQ ID NO: 20518 - DNA, 180 bp, Homo sapiens
  misc_feature: GYAE6OF01BCX60.49.53.E09.1.454.CMB.1.raw
  modified_base (166)..(180): a, c, t, g, unknown or other
  misc_feature (166)..(180): n is a, c, g, or t
tcagagtcgagagacacgaccggtgctcgatttagagagagtgtgttgggttggggaagaggaagacgtgacggtccccaggagttcaggtgctgggcacagcgccctggctgcctgtcaaggctacttcctctctcgactctgagcggctggcaaggcgcatagnnnnnnnnnnnnnnn

SEQ ID NO: 20519 - DNA, 173 bp, Homo sapiens; identical to SEQ ID NO: 20229
  misc_feature: GYAE6OF01CLLMF.49.53.E09.1.454.CMB.1.raw
  modified_base (173)..(173): a, c, t, g, unknown or other
  misc_feature (173)..(173): n is a, c, g, or t

SEQ ID NO: 20520 - DNA, 173 bp, Homo sapiens; identical to SEQ ID NO: 20229
  misc_feature: GYAE6OF01CR02Q.49.53.E09.1.454.CMB.1.raw
  modified_base (173)..(173): a, c, t, g, unknown or other
  misc_feature (173)..(173): n is a, c, g, or t

SEQ ID NO: 20521 - DNA, 173 bp, Homo sapiens; identical to SEQ ID NO: 20337
  misc_feature: GYAE6OF01E3X9K.49.53.E09.1.454.CMB.1.raw
  modified_base (173)..(173): a, c, t, g, unknown or other
  misc_feature (173)..(173): n is a, c, g, or t

SEQ ID NO: 20522 - DNA, 174 bp, Homo sapiens; identical to SEQ ID NO: 20265
  misc_feature: GYAE6OF01DQ7QF.49.53.E09.1.454.CMB.1.raw
  modified_base (173)..(174): a, c, t, g, unknown or other
  misc_feature (173)..(174): n is a, c, g, or t

SEQ ID NO: 20523 - DNA, 174 bp, Homo sapiens
  misc_feature: GYAE6OF01B6GOX.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgtggggaagaggaagactgacggtcccccaggagttcaggtgctgggcacagcggccctgggctgcctggtcaaggactacttcctctctcgactctgagcgggctggcaaggcgcatagn

SEQ ID NO: 20524 - DNA, 218 bp, Homo sapiens
  misc_feature: GYAE6OF01DZQ18.49.53.E09.1.454.CMB.1.raw
  modified_base (178)..(218): a, c, t, g, unknown or other
  misc_feature (178)..(218): n is a, c, g, or t
tcagagtcgagagacacgaccggtgctcgatttagagagagtgtggttaggggtttgggggaagaggaacgactgacggtcccccaggagttcaggtgctgggcacgacgcggccctgggctgccgtggtcaaggctacttcctctctcgactctgagcggctggcaaggcgcatagnnnnnnnnnnnnnnnnnnnnnnnnnnnnnnnnnnnnnnnnn

SEQ ID NO: 20525 - DNA, 173 bp, Homo sapiens; identical to SEQ ID NO: 20229
  misc_feature: GYAE6OF01DKKJY.49.53.E09.1.454.CMB.1.raw
  modified_base (173)..(173): a, c, t, g, unknown or other
  misc_feature (173)..(173): n is a, c, g, or t

SEQ ID NO: 20526 - DNA, 186 bp, Homo sapiens
  misc_feature: GYAE6OF01EU0GY.49.53.E09.1.454.CMB.1.raw
  modified_base (171)..(186): a, c, t, g, unknown or other
  misc_feature (171)..(186): n is a, c, g, or t
tcagagtcgagagacacgaccggtgctcgatttagagagagtgtgttgggtttgggggaagaggaagactgacggtcccccaggagttcaggtgctgggcacagcggccctggctgcctggtcaaggctacttcctctctcgactctgagcgggctggcaaggcgcatagnnnnnnnnnnnnnnnn

SEQ ID NO: 20527 - DNA, 172 bp, Homo sapiens; identical to SEQ ID NO: 20291
  misc_feature: GYAE6OF01D9U5F.49.53.E09.1.454.CMB.1.raw

SEQ ID NO: 20528 - DNA, 272 bp, Homo sapiens
  misc_feature: GYAE6OF01DBVJC.49.53.E09.1.454.CMB.1.raw
  modified_base (269)..(272): a, c, t, g, unknown or other
  misc_feature (269)..(272): n is a, c, g, or t
tcagagtcgagagacacgaccggtgctcgatttagagagagtgtgttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggactacttcctctctcgactctgagcgggctggcaaggcgcatagnnnn

SEQ ID NO: 20529 - DNA, 172 bp, Homo sapiens; identical to SEQ ID NO: 20291
  misc_feature: GYAE6OF01BGNRU.49.53.E09.1.454.CMB.1.raw

SEQ ID NO: 20530 - DNA, 173 bp, Homo sapiens; identical to SEQ ID NO: 20229
  misc_feature: GYAE6OF01CTHP9.49.53.E09.1.454.CMB.1.raw
  modified_base (173)..(173): a, c, t, g, unknown or other
  misc_feature (173)..(173): n is a, c, g, or t

SEQ ID NO: 20531 - DNA, 175 bp, Homo sapiens; identical to SEQ ID NO: 20418
  misc_feature: GYAE6OF01DJ0TN.49.53.E09.1.454.CMB.1.raw
  modified_base (173)..(175): a, c, t, g, unknown or other
  misc_feature (173)..(175): n is a, c, g, or t

SEQ ID NO: 20532 - DNA, 174 bp, Homo sapiens; identical to SEQ ID NO: 20265
  misc_feature: GYAE6OF01AKO67.49.53.E09.1.454.CMB.1.raw
  modified_base (173)..(174): a, c, t, g, unknown or other
  misc_feature (173)..(174): n is a, c, g, or t

SEQ ID NO: 20533 - DNA, 176 bp, Homo sapiens; identical to SEQ ID NO: 20270
  misc_feature: GYAE6OF01BB5CU.49.53.E09.1.454.CMB.1.raw
  modified_base (173)..(176): a, c, t, g, unknown or other
  misc_feature (173)..(176): n is a, c, g, or t

SEQ ID NO: 20534 - DNA, 174 bp, Homo sapiens; identical to SEQ ID NO: 20265
  misc_feature: GYAE6OF01C51T0.49.53.E09.1.454.CMB.1.raw
  modified_base (173)..(174): a, c, t, g, unknown or other
  misc_feature (173)..(174): n is a, c, g, or t

SEQ ID NO: 20535 - DNA, 198 bp, Homo sapiens
  misc_feature: GYAE6OF01ALBLM.49.53.E09.1.454.CMB.1.raw
  modified_base (176)..(198): a, c, t, g, unknown or other
  misc_feature (176)..(198): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggtctggcaaggcgtacatagnnnnnnnnnnnnnnnnnnnnnnn

SEQ ID NO: 20536 - DNA, 177 bp, Homo sapiens
  misc_feature: GYAE6OF01DL5WY.49.53.E09.1.454.CMB.1.raw
  modified_base (173)..(177): a, c, t, g, unknown or other
  misc_feature (173)..(177): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnnnn

SEQ ID NO: 20537 - DNA, 177 bp, Homo sapiens; identical to SEQ ID NO: 20482
  misc_feature: GYAE6OF01CI91K.49.53.E09.1.454.CMB.1.raw
  modified_base (173)..(177): a, c, t, g, unknown or other
  misc_feature (173)..(177): n is a, c, g, or t

SEQ ID NO: 20538 - DNA, 173 bp, Homo sapiens; identical to SEQ ID NO: 20229
  misc_feature: GYAE6OF01A7JC0.49.53.E09.1.454.CMB.1.raw
  modified_base (173)..(173): a, c, t, g, unknown or other
  misc_feature (173)..(173): n is a, c, g, or t

SEQ ID NO: 20539 - DNA, 181 bp, Homo sapiens
  misc_feature: GYAE6OF01DHVBZ.49.53.E09.1.454.CMB.1.raw
  modified_base (173)..(181): a, c, t, g, unknown or other
  misc_feature (173)..(181): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnn

SEQ ID NO: 20540 - DNA, 214 bp, Homo sapiens
  misc_feature: GYAE6OF01BXD20.49.53.E09.1.454.CMB.1.raw
  modified_base (173)..(173): a, c, t, g, unknown or other
  misc_feature (173)..(173): n is a, c, g, or t
  modified_base (179)..(214): a, c, t, g, unknown or other
  misc_feature (179)..(214): n is a, c, g, or t
tcagagtcgagagacacgaccggtgctcgatttagagagagtgtggttgggtttgggggaagaggaagacctgacggtcccccaggagttcaggtgcgtgggcacaggccggccctgggctgcctgggtcaaggctacttcctctctcgactctggagcgggctggcaaggcncatgcnnnnnnnnnnnnnnnnnnnnnnnnnnnnnnnnnnnn

SEQ ID NO: 20541 - DNA, 173 bp, Homo sapiens; identical to SEQ ID NO: 20229
  misc_feature: GYAE6OF01AXI79.49.53.E09.1.454.CMB.1.raw
  modified_base (173)..(173): a, c, t, g, unknown or other
  misc_feature (173)..(173): n is a, c, g, or t

SEQ ID NO: 20542 - DNA, 173 bp, Homo sapiens; identical to SEQ ID NO: 20229
  misc_feature: GYAE6OF01BKP0W.49.53.E09.1.454.CMB.1.raw
  modified_base (173)..(173): a, c, t, g, unknown or other
  misc_feature (173)..(173): n is a, c, g, or t

SEQ ID NO: 20543 - DNA, 171 bp, Homo sapiens; identical to SEQ ID NO: 20210
  misc_feature: GYAE6OF01DK8MM.49.53.E09.1.454.CMB.1.raw
  modified_base (171)..(171): a, c, t, g, unknown or other
  misc_feature (171)..(171): n is a, c, g, or t

SEQ ID NO: 20544 - DNA, 174 bp, Homo sapiens
  misc_feature: GYAE6OF01CFDZE.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcgcatagn

SEQ ID NO: 20545 - DNA, 174 bp, Homo sapiens; identical to SEQ ID NO: 20265
  misc_feature: GYAE6OF01AWVLE.49.53.E09.1.454.CMB.1.raw
  modified_base (173)..(174): a, c, t, g, unknown or other
  misc_feature (173)..(174): n is a, c, g, or t

SEQ ID NO: 20546 - DNA, 173 bp, Homo sapiens; identical to SEQ ID NO: 20229
  misc_feature: GYAE6OF01ALOKZ.49.53.E09.1.454.CMB.1.raw
  modified_base (173)..(173): a, c, t, g, unknown or other
  misc_feature (173)..(173): n is a, c, g, or t

SEQ ID NO: 20547 - DNA, 232 bp, Homo sapiens
  misc_feature: GYAE6OF01C8GPV.49.53.E09.1.454.CMB.1.raw
  modified_base (177)..(232): a, c, t, g, unknown or other
  misc_feature (177)..(232): n is a, c, g, or t
tcagagtcgagagacacgaccggtgctcgatttagagagagtgtgttggggtttgggggaagaggaagactgacggtcccccaggagttcaggtgctgggctacagcggccctgggctgcctggtcaaggactacttcctctctcgatctggagcgggctggctaaggcgcatagtnnnnnnnnnnnnnnnnnnnnnnnnnnnnnnnnnnnnnnnnnnnnnnnnnnnnnnnn

SEQ ID NO: 20548 - DNA, 173 bp, Homo sapiens
  misc_feature: GYAE6OF01B6BWJ.49.53.E09.1.454.CMB.1.raw
tcagagtcgagagacacgaccggtgctcgatttagagagagtgtgttgggtttgggggaagaggaagactgacggtcccccaggagttcaggtgctgggcacagcggccctgggctgcctggtcaaaggactacttcctctctcgactctgagcgggctggcaaggcgcatag

SEQ ID NO: 20549 - DNA, 174 bp, Homo sapiens; identical to SEQ ID NO: 20265
  misc_feature: GYAE6OF01D9T5J.49.53.E09.1.454.CMB.1.raw
  modified_base (173)..(174): a, c, t, g, unknown or other
  misc_feature (173)..(174): n is a, c, g, or t

SEQ ID NO: 20550 - DNA, 173 bp, Homo sapiens; identical to SEQ ID NO: 20229
  misc_feature: GYAE6OF01DPF4H.49.53.E09.1.454.CMB.1.raw
  modified_base (173)..(173): a, c, t, g, unknown or other
  misc_feature (173)..(173): n is a, c, g, or t

SEQ ID NO: 20551 - DNA, 173 bp, Homo sapiens; identical to SEQ ID NO: 20229
  misc_feature: GYAE6OF01A4WEQ.49.53.E09.1.454.CMB.1.raw
  modified_base (173)..(173): a, c, t, g, unknown or other
  misc_feature (173)..(173): n is a, c, g, or t

SEQ ID NO: 20552 - DNA, 174 bp, Homo sapiens; identical to SEQ ID NO: 20265
  misc_feature: GYAE6OF01AZDRS.49.53.E09.1.454.CMB.1.raw
  modified_base (173)..(174): a, c, t, g, unknown or other
  misc_feature (173)..(174): n is a, c, g, or t

SEQ ID NO: 20553 - DNA, 172 bp, Homo sapiens; identical to SEQ ID NO: 20254
  misc_feature: GYAE6OF01BBQEC.49.53.E09.1.454.CMB.1.raw
  modified_base (171)..(172): a, c, t, g, unknown or other
  misc_feature (171)..(172): n is a, c, g, or t

SEQ ID NO: 20554 - DNA, 173 bp, Homo sapiens; identical to SEQ ID NO: 20229
  misc_feature: GYAE6OF01BSOK7.49.53.E09.1.454.CMB.1.raw
  modified_base (173)..(173): a, c, t, g, unknown or other
  misc_feature (173)..(173): n is a, c, g, or t

SEQ ID NO: 20555 - DNA, 173 bp, Homo sapiens; identical to SEQ ID NO: 20229
  misc_feature: GYAE6OF01BMNJ9.49.53.E09.1.454.CMB.1.raw
  modified_base (173)..(173): a, c, t, g, unknown or other
  misc_feature (173)..(173): n is a, c, g, or t

SEQ ID NO: 20556 - DNA, 173 bp, Homo sapiens; identical to SEQ ID NO: 20229
  misc_feature: GYAE6OF01B21HL.49.53.E09.1.454.CMB.1.raw
  modified_base (173)..(173): a, c, t, g, unknown or other
  misc_feature (173)..(173): n is a, c, g, or t

SEQ ID NO: 20557 - DNA, 172 bp, Homo sapiens
  misc_feature: GYAE6OF01CSC2B.49.53.E09.1.454.CMB.1.raw
  modified_base (170)..(172): a, c, t, g, unknown or other
  misc_feature (170)..(172): n is a, c, g, or t
tcagagtcgagagacacgaccggtgctcgatttagagagagtgtgttgggtttgggggaagaggaagactgacggtccccaggagttcaggtgctgggcacagcggcctgggctgcctggtcaaggactacttcctctctcgactctgagcggctggcaaggcgcatagnnn

SEQ ID NO: 20558 - DNA, 194 bp, Homo sapiens
  misc_feature: GYAE6OF01BFLPP.49.53.E09.1.454.CMB.1.raw
  modified_base (174)..(194): a, c, t, g, unknown or other
  misc_feature (174)..(194): n is a, c, g, or t
tcagagtcgagagacacgaccggtgctcgatttagagagagtgtgttgggtttgggggaagaggaagactgacggtcccccaggagttcaggtgctgggcacagcggccctggctgcctggtcaaggaactacttccagtactctatctgagcgggctggacaaggcgcatagnnnnnnnnnnnnnnnnnnnnn

SEQ ID NO: 20559 - DNA, 193 bp, Homo sapiens
  misc_feature: GYAE6OF01D6PWX.49.53.E09.1.454.CMB.1.raw
  modified_base (176)..(193): a, c, t, g, unknown or other
  misc_feature (176)..(193): n is a, c, g, or t
tcagagtcgagagacacgaccggtgctcgatttagagagagtgtgttgggtttggggggaagaggaagactggacggtcccccaggagttcaggtgctgggcacagcggccctgggctgcctggtcaaggactacttcctctctcgactctgagcgggctggcaaggtcgcatagnnnnnnnnnnnnnnnnnn

SEQ ID NO: 20560 - DNA, 173 bp, Homo sapiens; identical to SEQ ID NO: 20229
  misc_feature: GYAE6OF01CPLNK.49.53.E09.1.454.CMB.1.raw
  modified_base (173)..(173): a, c, t, g, unknown or other
  misc_feature (173)..(173): n is a, c, g, or t

SEQ ID NO: 20561 - DNA, 173 bp, Homo sapiens; identical to SEQ ID NO: 20229
  misc_feature: GYAE6OF01DKNUF.49.53.E09.1.454.CMB.1.raw
  modified_base (173)..(173): a, c, t, g, unknown or other
  misc_feature (173)..(173): n is a, c, g, or t

SEQ ID NO: 20562 - DNA, 195 bp, Homo sapiens
  misc_feature: GYAE6OF01B09JP.49.53.E09.1.454.CMB.1.raw
  modified_base (170)..(195): a, c, t, g, unknown or other
  misc_feature (170)..(195): n is a, c, g, or t
tcagagtcgagagacacgaccggtgctcgatttagagagagtgtgtgggtttgggggaagaggaagactgacggtccccaggagttcaggtgctgggcacagcggccctgggctgcctggtcaaggctacttcctctctcgactctgagcgggctggcaaggcgcatagnnnnnnnnnnnnnnnnnnnnnnnnnn

SEQ ID NO: 20563 - DNA, 173 bp, Homo sapiens; identical to SEQ ID NO: 20229
  misc_feature: GYAE6OF01BUYGM.49.53.E09.1.454.CMB.1.raw
  modified_base (173)..(173): a, c, t, g, unknown or other
  misc_feature (173)..(173): n is a, c, g, or t

SEQ ID NO: 20564 - DNA, 174 bp, Homo sapiens; identical to SEQ ID NO: 20265
  misc_feature: GYAE6OF01C71HY.49.53.E09.1.454.CMB.1.raw
  modified_base (173)..(174): a, c, t, g, unknown or other
  misc_feature (173)..(174): n is a, c, g, or t

SEQ ID NO: 20565 - DNA, 179 bp, Homo sapiens
  misc_feature: GYAE6OF01CWQ0L.49.53.E09.1.454.CMB.1.raw
  modified_base (174)..(179): a, c, t, g, unknown or other
  misc_feature (174)..(179): n is a, c, g, or t
tcagagtcgagagacacgaccggtgctcgatttagagagagtgtgttgggtttgggggaaggaggaagactgacggtcccccaggagttcaggtgctgggcacagcggccctgggctgcctggtcaaggactacttcctctctcgactctgagcgggctggcaaggcgcatagnnnnnn

SEQ ID NO: 20566 - DNA, 514 bp, Homo sapiens
  misc_feature: GYAE6OF01DI2TZ.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggccctgtcttgatcatttataaagtacttttgagagggcctcgagggacccctgagcgattctctggcctccagctcagcgacaacagtcacgttgaccatcagtggagtccggagagaggacgaggctgactattactgtactagtcatcagactagtagtgctacttctgtcgtagttcgggcggaacgggacaaggtcgtacgtacccggtcgtacggtacagcccaaggtcctcccgg

SEQ ID NO: 20567 - DNA, 183 bp, Homo sapiens
  misc_feature: GYAE6OF01E6CUH.49.53.E09.1.454.CMB.1.raw
  modified_base (176)..(183): a, c, t, g, unknown or other
  misc_feature (176)..(183): n is a, c, g, or t
tcagagtcgagagacacgaccggtgctcgatttagagagagtgtggttgggttagggggaagaggaagactgaccggtccccaggagttcaggtgctgggcacagccggcctgggctgcctggtcaaggtacctacttcctctctcgactctgagcgggctggcaaggcgcatagnnnnnnnn

SEQ ID NO: 20568 - DNA, 173 bp, Homo sapiens; identical to SEQ ID NO: 20229
  misc_feature: GYAE6OF01BJQ99.49.53.E09.1.454.CMB.1.raw
  modified_base (173)..(173): a, c, t, g, unknown or other
  misc_feature (173)..(173): n is a, c, g, or t

SEQ ID NO: 20569 - DNA, 174 bp, Homo sapiens; identical to SEQ ID NO: 20265
  misc_feature: GYAE6OF01DAYXZ.49.53.E09.1.454.CMB.1.raw
  modified_base (173)..(174): a, c, t, g, unknown or other
  misc_feature (173)..(174): n is a, c, g, or t

SEQ ID NO: 20570 - DNA, 175 bp, Homo sapiens
  misc_feature: GYAE6OF01BE0WI.49.53.E09.1.454.CMB.1.raw
  modified_base (169)..(175): a, c, t, g, unknown or other
  misc_feature (169)..(175): n is a, c, g, or t
tcagagtcgagagacacgaccggtgctcgatttagagagagtgtgttgggtttggggaagaggaagactgacggtccccaggagttcaggtgctggcacagcggccctggctgcctggtcaaggactacttcctctctcgactctgagcgggctggcaaggcgcatagnnnnnnn

SEQ ID NO: 20571 - DNA, 173 bp, Homo sapiens; identical to SEQ ID NO: 20229
  misc_feature: GYAE6OF01EAJIX.49.53.E09.1.454.CMB.1.raw
  modified_base (173)..(173): a, c, t, g, unknown or other
  misc_feature (173)..(173): n is a, c, g, or t

SEQ ID NO: 20572 - DNA, 173 bp, Homo sapiens; identical to SEQ ID NO: 20229
  misc_feature: GYAE6OF01D5E5S.49.53.E09.1.454.CMB.1.raw
  modified_base (173)..(173): a, c, t, g, unknown or other
  misc_feature (173)..(173): n is a, c, g, or t

SEQ ID NO: 20573 - DNA, 184 bp, Homo sapiens
  misc_feature: GYAE6OF01BNHGI.49.53.E09.1.454.CMB.1.raw
  modified_base (173)..(184): a, c, t, g, unknown or other
  misc_feature (173)..(184): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnn

SEQ ID NO: 20574 - DNA, 511 bp, Homo sapiens
  misc_feature: GYAE6OF01D57G4.49.53.E09.1.454.CMB.1.raw
tcagagtcgagagacacgaccggtgctcgatttagagagagtgtgttgggtttggggtgtgttgggtttgggttgagaacctatgaaaattctgcaggggccactgtcttctccacggtgctcccttcatgcgtgacctggcagctgtagcttctgtgggacttccactgctcaggcgtcaggctcagatagctgctggccgcgtacttgttgttgctttgttggagggtgtggtggtctccactcccgccttgacgggctgctatctgccttccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggctacttctgtcgtattcgggcggagggaccagcgtcgaccgtctaggcagcccaaggctcgccccctggtctaccg

SEQ ID NO: 20575 - DNA, 173 bp, Homo sapiens; identical to SEQ ID NO: 20229
  misc_feature: GYAE6OF01AOPZH.49.53.E09.1.454.CMB.1.raw
  modified_base (173)..(173): a, c, t, g, unknown or other
  misc_feature (173)..(173): n is a, c, g, or t

SEQ ID NO: 20576 - DNA, 173 bp, Homo sapiens
  misc_feature: GYAE6OF01B84UY.49.53.E09.1.454.CMB.1.raw
  modified_base (172)..(173): a, c, t, g, unknown or other
  misc_feature (172)..(173): n is a, c, g, or t
tcagagtcgagagacacgaccggtgctcgatttagagagagtgtgttgggtttggggaagaggaagactgacggtcccccaggagttcaggtgctgggcacagcggccctgggctgcctggtcaaggactacttcctcgtagcactctgagcgggctggcaaggcgcatagnn

SEQ ID NO: 20577 - DNA, 173 bp, Homo sapiens; identical to SEQ ID NO: 20229
  misc_feature: GYAE6OF01B210Y.49.53.E09.1.454.CMB.1.raw
  modified_base (173)..(173): a, c, t, g, unknown or other
  misc_feature (173)..(173): n is a, c, g, or t

SEQ ID NO: 20578 - DNA, 173 bp, Homo sapiens; identical to SEQ ID NO: 20229
  misc_feature: GYAE6OF01E43QY.49.53.E09.1.454.CMB.1.raw
  modified_base (173)..(173): a, c, t, g, unknown or other
  misc_feature (173)..(173): n is a, c, g, or t

SEQ ID NO: 20579 - DNA, 173 bp, Homo sapiens; identical to SEQ ID NO: 20229
  misc_feature: GYAE6OF01DMX17.49.53.E09.1.454.CMB.1.raw
  modified_base (173)..(173): a, c, t, g, unknown or other
  misc_feature (173)..(173): n is a, c, g, or t

SEQ ID NO: 20580 - DNA, 173 bp, Homo sapiens; identical to SEQ ID NO: 20229
  misc_feature: GYAE6OF01B4ZUI.49.53.E09.1.454.CMB.1.raw
  modified_base (173)..(173): a, c, t, g, unknown or other
  misc_feature (173)..(173): n is a, c, g, or t

SEQ ID NO: 20581 - DNA, 180 bp, Homo sapiens
  misc_feature: GYAE6OF01A92BQ.49.53.E09.1.454.CMB.1.raw
  modified_base (172)..(180): a, c, t, g, unknown or other
  misc_feature (172)..(180): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctctctcgactctgagcgggctggcaaggcgcatagnnnnnnnnn

SEQ ID NO: 20582 - DNA, 173 bp, Homo sapiens; identical to SEQ ID NO: 20229
  misc_feature: GYAE6OF01EJGSZ.49.53.E09.1.454.CMB.1.raw
  modified_base (173)..(173): a, c, t, g, unknown or other
  misc_feature (173)..(173): n is a, c, g, or t

SEQ ID NO: 20583 - DNA, 179 bp, Homo sapiens; identical to SEQ ID NO: 20397
  misc_feature: GYAE6OF01A9NWU.49.53.E09.1.454.CMB.1.raw
  modified_base (173)..(179): a, c, t, g, unknown or other
  misc_feature (173)..(179): n is a, c, g, or t

SEQ ID NO: 20584 - DNA, 173 bp, Homo sapiens; identical to SEQ ID NO: 20229
  misc_feature: GYAE6OF01DF1CS.49.53.E09.1.454.CMB.1.raw
  modified_base (173)..(173): a, c, t, g, unknown or other
  misc_feature (173)..(173): n is a, c, g, or t

SEQ ID NO: 20585 - DNA, 172 bp, Homo sapiens; identical to SEQ ID NO: 20291
  misc_feature: GYAE6OF01BK43R.49.53.E09.1.454.CMB.1.raw

SEQ ID NO: 20586 - DNA, 173 bp, Homo sapiens; identical to SEQ ID NO: 20229
  misc_feature: GYAE6OF01EDQKP.49.53.E09.1.454.CMB.1.raw
  modified_base (173)..(173): a, c, t, g, unknown or other
  misc_feature (173)..(173): n is a, c, g, or t

SEQ ID NO: 20587 - DNA, 173 bp, Homo sapiens; identical to SEQ ID NO: 20337
  misc_feature: GYAE6OF01A8Z42.49.53.E09.1.454.CMB.1.raw
  modified_base (173)..(173): a, c, t, g, unknown or other
  misc_feature (173)..(173): n is a, c, g, or t

SEQ ID NO: 20588 - DNA, 175 bp, Homo sapiens
  misc_feature: GYAE6OF01CB6V7.49.53.E09.1.454.CMB.1.raw
  modified_base (172)..(175): a, c, t, g, unknown or other
  misc_feature (172)..(175): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctctctcgactctgagcgggctggcaaggcgcatagnnnn

SEQ ID NO: 20589 - DNA, 173 bp, Homo sapiens; identical to SEQ ID NO: 20337
  misc_feature: GYAE6OF01DHZFA.49.53.E09.1.454.CMB.1.raw
  modified_base (173)..(173): a, c, t, g, unknown or other
  misc_feature (173)..(173): n is a, c, g, or t

SEQ ID NO: 20590 - DNA, 176 bp, Homo sapiens; identical to SEQ ID NO: 20270
  misc_feature: GYAE6OF01A9AK6.49.53.E09.1.454.CMB.1.raw
  modified_base (173)..(176): a, c, t, g, unknown or other
  misc_feature (173)..(176): n is a, c, g, or t

SEQ ID NO: 20591 - DNA, 173 bp, Homo sapiens; identical to SEQ ID NO: 20229
  misc_feature: GYAE6OF01BIXTA.49.53.E09.1.454.CMB.1.raw
  modified_base (173)..(173): a, c, t, g, unknown or other
  misc_feature (173)..(173): n is a, c, g, or t

SEQ ID NO: 20592 - DNA, 173 bp, Homo sapiens; identical to SEQ ID NO: 20229
  misc_feature: GYAE6OF01AQCEG.49.53.E09.1.454.CMB.1.raw
  modified_base (173)..(173): a, c, t, g, unknown or other
  misc_feature (173)..(173): n is a, c, g, or t

SEQ ID NO: 20593 - DNA, 173 bp, Homo sapiens
  misc_feature: GYAE6OF01BEQN5.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaggaagactgacggtcccccaggagttcaggtgctgggcacagcggccctgggatgcctggtcaaggactacttcctctctcgactctgagcgggctggcaaggcgcatagn

SEQ ID NO: 20594 - DNA, 178 bp, Homo sapiens; identical to SEQ ID NO: 20465
  misc_feature: GYAE6OF01CF1TM.49.53.E09.1.454.CMB.1.raw
  modified_base (173)..(178): a, c, t, g, unknown or other
  misc_feature (173)..(178): n is a, c, g, or t

SEQ ID NO: 20595 - DNA, 173 bp, Homo sapiens; identical to SEQ ID NO: 20229
  misc_feature: GYAE6OF01CZ0LZ.49.53.E09.1.454.CMB.1.raw
  modified_base (173)..(173): a, c, t, g, unknown or other
  misc_feature (173)..(173): n is a, c, g, or t

SEQ ID NO: 20596 - DNA, 186 bp, Homo sapiens
  misc_feature: GYAE6OF01EI0CK.49.53.E09.1.454.CMB.1.raw
  modified_base (173)..(186): a, c, t, g, unknown or other
  misc_feature (173)..(186): n is a, c, g, or t
tcagagtcgagagacacgaccggtgctcgatttagagagagtgtgttggggtttgggggaagaggaagactgacggtcccccaggagttcaggtgctgggcacagcggccctggctgcctggtcaaggactacttcctctctcgactctgagcgggctggcaaggcgcatagnnnnnnnnnnnnnn

SEQ ID NO: 20597 - DNA, 173 bp, Homo sapiens; identical to SEQ ID NO: 20229
  misc_feature: GYAE6OF01BCJMG.49.53.E09.1.454.CMB.1.raw
  modified_base (173)..(173): a, c, t, g, unknown or other
  misc_feature (173)..(173): n is a, c, g, or t

SEQ ID NO: 20598 - DNA, 173 bp, Homo sapiens; identical to SEQ ID NO: 20229
  misc_feature: GYAE6OF01CT4SY.49.53.E09.1.454.CMB.1.raw
  modified_base (173)..(173): a, c, t, g, unknown or other
  misc_feature (173)..(173): n is a, c, g, or t

SEQ ID NO: 20599 - DNA, 168 bp, Homo sapiens
  misc_feature: GYAE6OF01CJ6AN.49.53.E09.1.454.CMB.1.raw
  modified_base (168)..(168): a, c, t, g, unknown or other
  misc_feature (168)..(168): n is a, c, g, or t
tcagagtcgagagacacgaccggtgctcgatttagagagagtgtgttgggttggggaagaggaagactgacggtccccaggagttcaggtgctgggcacagcggccctgggctgcctggtcaaggactacttcctctctcgactgagcgggctggcaaggcgcatagn

SEQ ID NO: 20600 - DNA, 175 bp, Homo sapiens; identical to SEQ ID NO: 20418
  misc_feature: GYAE6OF01DAHM0.49.53.E09.1.454.CMB.1.raw
  modified_base (173)..(175): a, c, t, g, unknown or other
  misc_feature (173)..(175): n is a, c, g, or t

SEQ ID NO: 20601 - DNA, 180 bp, Homo sapiens; identical to SEQ ID NO: 20243
  misc_feature: GYAE6OF01EN69H.49.53.E09.1.454.CMB.1.raw
  modified_base (173)..(180): a, c, t, g, unknown or other
  misc_feature (173)..(180): n is a, c, g, or t

SEQ ID NO: 20602 - DNA, 175 bp, Homo sapiens; identical to SEQ ID NO: 20418
  misc_feature: GYAE6OF01BNAFU.49.53.E09.1.454.CMB.1.raw
  modified_base (173)..(175): a, c, t, g, unknown or other
  misc_feature (173)..(175): n is a, c, g, or t

SEQ ID NO: 20603 - DNA, 180 bp, Homo sapiens
  misc_feature: GYAE6OF01DC7Z6.49.53.E09.1.454.CMB.1.raw
  modified_base (174)..(180): a, c, t, g, unknown or other
  misc_feature (174)..(180): n is a, c, g, or t
tcagagtcgagagacacgaccggtgctcgatttagagagagtgtgttgggtttgggggaaggaggaagactgacggtcccccaggagttcaggtgctgggcacagcggccctgggctgcctggtcaaggactacttcctctctcgactctgagcgggctggcaaggcgcatagnnnnnnn

SEQ ID NO: 20604 - DNA, 173 bp, Homo sapiens; identical to SEQ ID NO: 20229
  misc_feature: GYAE6OF01DVUK0.49.53.E09.1.454.CMB.1.raw
  modified_base (173)..(173): a, c, t, g, unknown or other
  misc_feature (173)..(173): n is a, c, g, or t

SEQ ID NO: 20605 - DNA, 175 bp, Homo sapiens; identical to SEQ ID NO: 20499
  misc_feature: GYAE6OF01DQIES.49.53.E09.1.454.CMB.1.raw
  modified_base (174)..(175): a, c, t, g, unknown or other
  misc_feature (174)..(175): n is a, c, g, or t

SEQ ID NO: 20606 - DNA, 173 bp, Homo sapiens; identical to SEQ ID NO: 20229
  misc_feature: GYAE6OF01C2JZ6.49.53.E09.1.454.CMB.1.raw
  modified_base (173)..(173): a, c, t, g, unknown or other
  misc_feature (173)..(173): n is a, c, g, or t

SEQ ID NO: 20607 - DNA, 195 bp, Homo sapiens
  misc_feature: GYAE6OF01EZHVL.49.53.E09.1.454.CMB.1.raw
  modified_base (171)..(195): a, c, t, g, unknown or other
  misc_feature (171)..(195): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggctacttcctctctcgactctgagcgggctggcaaggcgcatagnnnnnnnnnnnnnnnnnnnnnnnnn

SEQ ID NO: 20608 - DNA, 173 bp, Homo sapiens; identical to SEQ ID NO: 20229
  misc_feature: GYAE6OF01DLNE6.49.53.E09.1.454.CMB.1.raw
  modified_base (173)..(173): a, c, t, g, unknown or other
  misc_feature (173)..(173): n is a, c, g, or t

SEQ ID NO: 20609 - DNA, 173 bp, Homo sapiens; identical to SEQ ID NO: 20229
  misc_feature: GYAE6OF01B88ED.49.53.E09.1.454.CMB.1.raw
  modified_base (173)..(173): a, c, t, g, unknown or other
  misc_feature (173)..(173): n is a, c, g, or t

SEQ ID NO: 20610 - DNA, 173 bp, Homo sapiens; identical to SEQ ID NO: 20229
  misc_feature: GYAE6OF01DQT3K.49.53.E09.1.454.CMB.1.raw
  modified_base (173)..(173): a, c, t, g, unknown or other
  misc_feature (173)..(173): n is a, c, g, or t

SEQ ID NO: 20611 - DNA, 173 bp, Homo sapiens; identical to SEQ ID NO: 20229
  misc_feature: GYAE6OF01DBZXO.49.53.E09.1.454.CMB.1.raw
  modified_base (173)..(173): a, c, t, g, unknown or other
  misc_feature (173)..(173): n is a, c, g, or t

SEQ ID NO: 20612 - DNA, 174 bp, Homo sapiens; identical to SEQ ID NO: 20265
  misc_feature: GYAE6OF01BQPQW.49.53.E09.1.454.CMB.1.raw
  modified_base (173)..(174): a, c, t, g, unknown or other
  misc_feature (173)..(174): n is a, c, g, or t

SEQ ID NO: 20613 - DNA, 500 bp, Homo sapiens
  misc_feature: GYAE6OF01DO204.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttggagagggcctcacgggacccctgagcgattctctggctcagctcagcgacaacagtcacgttgaccatcagtggagtcggacaggaggacgaggctgactattactgtcagtcatcagactagtagtgcacttctgtcgtattcgggcggagggaccaggctcgacgtaccgtaggtacagcccaaggcctacccgg

SEQ ID NO: 20614 - DNA, 253 bp, Homo sapiens
  misc_feature: GYAE6OF01AGLE8.49.53.E09.1.454.CMB.1.raw
  modified_base (162)..(162): a, c, t, g, unknown or other
  misc_feature (162)..(162): n is a, c, g, or t
  modified_base (179)..(180): a, c, t, g, unknown or other
  misc_feature (179)..(180): n is a, c, g, or t
  modified_base (182)..(184): a, c, t, g, unknown or other
  misc_feature (182)..(184): n is a, c, g, or t
  modified_base (187)..(187): a, c, t, g, unknown or other
  misc_feature (187)..(187): n is a, c, g, or t
  modified_base (189)..(253): a, c, t, g, unknown or other
  misc_feature (189)..(253): n is a, c, g, or t
tcagagtcgagagacacgaccggtgctcgatttagagagagtgtggttagggggtttggggggaagaggaagactgacggtcccccaggagttcaggtgctagggcacagcggccctgggctgcctggtcaaggctacttcctcgtagcactctgagcgggntggcaaggcgcataganntnnngancnnnnnnnnnnnnnnnnnnnnnnnnnnnnnnnnnnnnnnnnnnnnnnnnnnnnnnnnnnnnnnnnn

SEQ ID NO: 20615 - DNA, 174 bp, Homo sapiens; identical to SEQ ID NO: 20265
  misc_feature: GYAE6OF01CAOKZ.49.53.E09.1.454.CMB.1.raw
  modified_base (173)..(174): a, c, t, g, unknown or other
  misc_feature (173)..(174): n is a, c, g, or t

SEQ ID NO: 20616 - DNA, 184 bp, Homo sapiens
  misc_feature: GYAE6OF01BBXLF.49.53.E09.1.454.CMB.1.raw
  modified_base (173)..(184): a, c, t, g, unknown or other
  misc_feature (173)..(184): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnnnnnnnnnnn

SEQ ID NO: 20617 - DNA, 173 bp, Homo sapiens; identical to SEQ ID NO: 20229
  misc_feature: GYAE6OF01E5JHF.49.53.E09.1.454.CMB.1.raw
  modified_base (173)..(173): a, c, t, g, unknown or other
  misc_feature (173)..(173): n is a, c, g, or t

SEQ ID NO: 20618 - DNA, 185 bp, Homo sapiens
  misc_feature: GYAE6OF01AOWYB.49.53.E09.1.454.CMB.1.raw
  modified_base (166)..(166): a, c, t, g, unknown or other
  misc_feature (166)..(166): n is a, c, g, or t
  modified_base (172)..(185): a, c, t, g, unknown or other
  misc_feature (172)..(185): n is a, c, g, or t
tcagagtcgagagacacgaccggtgctcgatttagagagagtgtggttgggtttagggggaagaggaagactgacggtccccaggagttcaggtgctgggcacagcggcctgggctgcctggtcaaggactacttcctctctcgactctgagcgggctggcaggcncatagnnnnnnnnnnnnnn

SEQ ID NO: 20619 - DNA, 173 bp, Homo sapiens; identical to SEQ ID NO: 20229
  misc_feature: GYAE6OF01DA5EX.49.53.E09.1.454.CMB.1.raw
  modified_base (173)..(173): a, c, t, g, unknown or other
  misc_feature (173)..(173): n is a, c, g, or t

SEQ ID NO: 20620 - DNA, 173 bp, Homo sapiens
  misc_feature: GYAE6OF01AO10U.49.53.E09.1.454.CMB.1.raw
  modified_base (171)..(173): a, c, t, g, unknown or other
  misc_feature (171)..(173): n is a, c, g, or t
tcagagtcgagagacacgaccggtgctcgatttagagagagtgtgttgggtttgggggaagaggaagactgacggtccccaggagttcaggtgctgggcacagcggcctgggctgcctggtcaaggactacttcctctctcgactctgagcgggctggcaaggcgcatagnnn

SEQ ID NO: 20621 - DNA, 231 bp, Homo sapiens
  misc_feature: GYAE6OF01DE2IR.49.53.E09.1.454.CMB.1.raw
  modified_base (178)..(179): a, c, t, g, unknown or other
  misc_feature (178)..(179): n is a, c, g, or t
  modified_base (181)..(231): a, c, t, g, unknown or other
  misc_feature (181)..(231): n is a, c, g, or t
tcagagtcgagagacacgaccggtgctcgatttagagagagtgtgttggggtttggggggaagtaggaagactgacggtacccccaggagttcaggtgctgggcactagcggccctgggctgcctggtcaaggctacttcctctgtcgactctgagcgggctggcaagggcgcatagnntnnnnnnnnnnnnnnnnnnnnnnnnnnnnnnnnnnnnnnnnnnnnnnnnnnn

SEQ ID NO: 20622 - DNA, 173 bp, Homo sapiens; identical to SEQ ID NO: 20229
  misc_feature: GYAE6OF01D793M.49.53.E09.1.454.CMB.1.raw
  modified_base (173)..(173): a, c, t, g, unknown or other
  misc_feature (173)..(173): n is a, c, g, or t

SEQ ID NO: 20623 - DNA, 173 bp, Homo sapiens; identical to SEQ ID NO: 20229
  misc_feature: GYAE6OF01EKR0J.49.53.E09.1.454.CMB.1.raw
  modified_base (173)..(173): a, c, t, g, unknown or other
  misc_feature (173)..(173): n is a, c, g, or t

SEQ ID NO: 20624 - DNA, 173 bp, Homo sapiens; identical to SEQ ID NO: 20229
  misc_feature: GYAE6OF01DCD4I.49.53.E09.1.454.CMB.1.raw
  modified_base (173)..(173): a, c, t, g, unknown or other
  misc_feature (173)..(173): n is a, c, g, or t

SEQ ID NO: 20625 - DNA, 174 bp, Homo sapiens
  misc_feature: GYAE6OF01B45C4.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggaactacttccagtactctatctgagcgggctggcaaggcgcatagn

SEQ ID NO: 20626 - DNA, 187 bp, Homo sapiens
  misc_feature: GYAE6OF01CRG9D.49.53.E09.1.454.CMB.1.raw
  modified_base (173)..(187): a, c, t, g, unknown or other
  misc_feature (173)..(187): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnnnnnnnnnnnnnn

SEQ ID NO: 20627 - DNA, 181 bp, Homo sapiens
  misc_feature: GYAE6OF01DY0M4.49.53.E09.1.454.CMB.1.raw
  modified_base (174)..(181): a, c, t, g, unknown or other
  misc_feature (174)..(181): n is a, c, g, or t
tcagagtcgagagacacgaccggtgctcgatttagagagagtgtgttggggtttgggggaagaggaagactgacggtcccccaggagttcaggtgctgggcacagcggccctgggctgcctggtcaaggactacttcctctctcgactctgagcgggctggcaaggcgcatagnnnnnnnn

SEQ ID NO: 20628 - DNA, 174 bp, Homo sapiens; identical to SEQ ID NO: 20265
  misc_feature: GYAE6OF01BJLGP.49.53.E09.1.454.CMB.1.raw
  modified_base (173)..(174): a, c, t, g, unknown or other
  misc_feature (173)..(174): n is a, c, g, or t

SEQ ID NO: 20629 - DNA, 173 bp, Homo sapiens; identical to SEQ ID NO: 20229
  misc_feature: GYAE6OF01DGTM8.49.53.E09.1.454.CMB.1.raw
  modified_base (173)..(173): a, c, t, g, unknown or other
  misc_feature (173)..(173): n is a, c, g, or t

SEQ ID NO: 20630 - DNA, 174 bp, Homo sapiens
  misc_feature: GYAE6OF01BXWYC.49.53.E09.1.454.CMB.1.raw
  modified_base (173)..(174): a, c, t, g, unknown or other
  misc_feature (173)..(174): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnn

SEQ ID NO: 20631 - DNA, 172 bp, Homo sapiens
  misc_feature: GYAE6OF01AQH56.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcttcgactctgagcgggctggcaaggcgcatagn

SEQ ID NO: 20632 - DNA, 172 bp, Homo sapiens; identical to SEQ ID NO: 20238
  misc_feature: GYAE6OF01BIMDD.49.53.E09.1.454.CMB.1.raw
  modified_base (172)..(172): a, c, t, g, unknown or other
  misc_feature (172)..(172): n is a, c, g, or t

SEQ ID NO: 20633 - DNA, 175 bp, Homo sapiens; identical to SEQ ID NO: 20418
  misc_feature: GYAE6OF01EHO2K.49.53.E09.1.454.CMB.1.raw
  modified_base (173)..(175): a, c, t, g, unknown or other
  misc_feature (173)..(175): n is a, c, g, or t

SEQ ID NO: 20634 - DNA, 170 bp, Homo sapiens
  misc_feature: GYAE6OF01B0UCB.49.53.E09.1.454.CMB.1.raw
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatag

SEQ ID NO: 20635 - DNA, 174 bp, Homo sapiens; identical to SEQ ID NO: 20265
  misc_feature: GYAE6OF01C2LC6.49.53.E09.1.454.CMB.1.raw
  modified_base (173)..(174): a, c, t, g, unknown or other
  misc_feature (173)..(174): n is a, c, g, or t

SEQ ID NO: 20636 - DNA, 172 bp, Homo sapiens; identical to SEQ ID NO: 20291
  misc_feature: GYAE6OF01CVSV4.49.53.E09.1.454.CMB.1.raw

SEQ ID NO: 20637 - DNA, 174 bp, Homo sapiens; identical to SEQ ID NO: 20265
  misc_feature: GYAE6OF01B0631.49.53.E09.1.454.CMB.1.raw
  modified_base (173)..(174): a, c, t, g, unknown or other
  misc_feature (173)..(174): n is a, c, g, or t

SEQ ID NO: 20638 - DNA, 173 bp, Homo sapiens; identical to SEQ ID NO: 20229
  misc_feature: GYAE6OF01B3UEA.49.53.E09.1.454.CMB.1.raw
  modified_base (173)..(173): a, c, t, g, unknown or other
  misc_feature (173)..(173): n is a, c, g, or t

SEQ ID NO: 20639 - DNA, 536 bp, Homo sapiens
  misc_feature: GYAE6OF01AY9CX.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaaatatgcttactggtaccagcagaagccaggccaggcccctgtcttgatcatttataaagtactttgagagggcctcgacgggacccctgacgcgattctctggctccagctcagcgaacaacagtcacgttgaccatcagtggagtccggacgagaggacgaggctgactattactgtcagtcatcaagactagtagtgctacttcgtgtcgtagttcgggacgggaacgggaccgaaggtcctaggtacccgttccgtaacggccaacggccccgaaagggtcccgtaccccggg

SEQ ID NO: 20640 - DNA, 174 bp, Homo sapiens; identical to SEQ ID NO: 20265
  misc_feature: GYAE6OF01EOACM.49.53.E09.1.454.CMB.1.raw
  modified_base (173)..(174): a, c, t, g, unknown or other
  misc_feature (173)..(174): n is a, c, g, or t

SEQ ID NO: 20641 - DNA, 173 bp, Homo sapiens; identical to SEQ ID NO: 20229
  misc_feature: GYAE6OF01EZX86.49.53.E09.1.454.CMB.1.raw
  modified_base (173)..(173): a, c, t, g, unknown or other
  misc_feature (173)..(173): n is a, c, g, or t

SEQ ID NO: 20642 - DNA, 181 bp, Homo sapiens
  misc_feature: GYAE6OF01CG4V4.49.53.E09.1.454.CMB.1.raw
  modified_base (173)..(181): a, c, t, g, unknown or other
  misc_feature (173)..(181): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnnnnnnnn

SEQ ID NO: 20643 - DNA, 207 bp, Homo sapiens
  misc_feature: GYAE6OF01B5D7S.49.53.E09.1.454.CMB.1.raw
  modified_base (176)..(207): a, c, t, g, unknown or other
  misc_feature (176)..(207): n is a, c, g, or t
tcagagtcgagagacacgaccggtgctcgatttagagagagtgtgttggggtttggggggaagaggaagactgacggtcccccaggagttcgaggtgctgggcacagcggccctgggctgcctggtcaaggactacttcctctctcgactctgagcgggctggcaaggcgcatagnnnnnnnnnnnnnnnnnnnnnnnnnnnnnnnn

SEQ ID NO: 20644 - DNA, 173 bp, Homo sapiens; identical to SEQ ID NO: 20229
  misc_feature: GYAE6OF01C6L5T.49.53.E09.1.454.CMB.1.raw
  modified_base (173)..(173): a, c, t, g, unknown or other
  misc_feature (173)..(173): n is a, c, g, or t

SEQ ID NO: 20645 - DNA, 174 bp, Homo sapiens; identical to SEQ ID NO: 20630
  misc_feature: GYAE6OF01CX424.49.53.E09.1.454.CMB.1.raw
  modified_base (173)..(174): a, c, t, g, unknown or other
  misc_feature (173)..(174): n is a, c, g, or t

SEQ ID NO: 20646 - DNA, 498 bp, Homo sapiens
  misc_feature: GYAE6OF01E15I5.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggctacttctgtcgtagttcgggcggacgggaccaaggctgaccgtcctaggtcagcccaaggcctccgg

SEQ ID NO: 20647 - DNA, 195 bp, Homo sapiens
  misc_feature: GYAE6OF01B6SM3.49.53.E09.1.454.CMB.1.raw
  modified_base (173)..(195): a, c, t, g, unknown or other
  misc_feature (173)..(195): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnnnn

SEQ ID NO: 20648 - DNA, 173 bp, Homo sapiens; identical to SEQ ID NO: 20229
  misc_feature: GYAE6OF01AXXM3.49.53.E09.1.454.CMB.1.raw
  modified_base (173)..(173): a, c, t, g, unknown or other
  misc_feature (173)..(173): n is a, c, g, or t

SEQ ID NO: 20649 - DNA, 197 bp, Homo sapiens
  misc_feature: GYAE6OF01E2U04.49.53.E09.1.454.CMB.1.raw
  modified_base (175)..(197): a, c, t, g, unknown or other
  misc_feature (175)..(197): n is a, c, g, or t
tcagagtcgagagacacgaccggtgctcgatttagagagagtgtggttgggtttgggggaagaggaagactgacggtcccccaggagttcaggtgctgggccacagcggccctgggctgcctggtcaaggactacttcctctctcgactctgagcgggctggcaaggcgcatagnnnnnnnnnnnnnnnnnnnnnnn

SEQ ID NO: 20650 - DNA, 173 bp, Homo sapiens; identical to SEQ ID NO: 20337
  misc_feature: GYAE6OF01C4CQX.49.53.E09.1.454.CMB.1.raw
  modified_base (173)..(173): a, c, t, g, unknown or other
  misc_feature (173)..(173): n is a, c, g, or t

SEQ ID NO: 20651 - DNA, 187 bp, Homo sapiens
  misc_feature: GYAE6OF01EQ5PK.49.53.E09.1.454.CMB.1.raw
  modified_base (173)..(187): a, c, t, g, unknown or other
  misc_feature (173)..(187): n is a, c, g, or t
tcagagtcgagagacacgaccggtgctcgatttagagagagtgtggttgggtttgggggaagaggaagactgacggtcccccaggagttcaggtgctgggcacagcggcctgggctgcctggtcaaggactacttcctctctcgactctgagcgggctggcaaggcgcatagnnnnnnnnnnnnnnn

SEQ ID NO: 20652 - DNA, 174 bp, Homo sapiens; identical to SEQ ID NO: 20265
  misc_feature: GYAE6OF01ADX2Y.49.53.E09.1.454.CMB.1.raw
  modified_base (173)..(174): a, c, t, g, unknown or other
  misc_feature (173)..(174): n is a, c, g, or t

SEQ ID NO: 20653 - DNA, 173 bp, Homo sapiens; identical to SEQ ID NO: 20229
  misc_feature: GYAE6OF01EBTH4.49.53.E09.1.454.CMB.1.raw
  modified_base (173)..(173): a, c, t, g, unknown or other
  misc_feature (173)..(173): n is a, c, g, or t

SEQ ID NO: 20654 - DNA, 194 bp, Homo sapiens
  misc_feature: GYAE6OF01E023R.49.53.E09.1.454.CMB.1.raw
  modified_base (177)..(194): a, c, t, g, unknown or other
  misc_feature (177)..(194): n is a, c, g, or t
tcagagtcgagagacacgaccggtgctcgatttagagagagtgtggttgggtttgggggaagaggaagactgaccggtcccccaggagttcaggtgctgggcacagccggccctgggctgcctgggtcaaggactacttcctcgtagcactctgagcgggctggcaaggcgcatagnnnnnnnnnnnnnnnnnn

SEQ ID NO: 20655 - DNA, 174 bp, Homo sapiens; identical to SEQ ID NO: 20265
  misc_feature: GYAE6OF01BOTGB.49.53.E09.1.454.CMB.1.raw
  modified_base (173)..(174): a, c, t, g, unknown or other
  misc_feature (173)..(174): n is a, c, g, or t

SEQ ID NO: 20656 - DNA, 173 bp, Homo sapiens; identical to SEQ ID NO: 20229
  misc_feature: GYAE6OF01BTZB3.49.53.E09.1.454.CMB.1.raw
  modified_base (173)..(173): a, c, t, g, unknown or other
  misc_feature (173)..(173): n is a, c, g, or t

SEQ ID NO: 20657 - DNA, 174 bp, Homo sapiens; identical to SEQ ID NO: 20265
  misc_feature: GYAE6OF01A3K5W.49.53.E09.1.454.CMB.1.raw
  modified_base (173)..(174): a, c, t, g, unknown or other
  misc_feature (173)..(174): n is a, c, g, or t

SEQ ID NO: 20658 - DNA, 173 bp, Homo sapiens; identical to SEQ ID NO: 20229
  misc_feature: GYAE6OF01E2UE9.49.53.E09.1.454.CMB.1.raw
  modified_base (173)..(173): a, c, t, g, unknown or other
  misc_feature (173)..(173): n is a, c, g, or t

SEQ ID NO: 20659 - DNA, 175 bp, Homo sapiens
  misc_feature: GYAE6OF01B1IG8.49.53.E09.1.454.CMB.1.raw
  modified_base (173)..(175): a, c, t, g, unknown or other
  misc_feature (173)..(175): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttactctctcgactctgagcgggctggcaaggcgcatagnnn

SEQ ID NO: 20660 - DNA, 182 bp, Homo sapiens
  misc_feature: GYAE6OF01ESHSQ.49.53.E09.1.454.CMB.1.raw
  modified_base (173)..(182): a, c, t, g, unknown or other
  misc_feature (173)..(182): n is a, c, g, or t
tcagagtcgagagacacgaccggtgctcgatttagagagagtgtgttgggttgggggaagaggaagactggacggtcccccaggagttcaggtgctgggcacagcggccctgggctgcctggtcaaggactacttcctctctcgactctgagcgggctggcaaggcgcatagnnnnnnnnnn

SEQ ID NO: 20661 - DNA, 498 bp, Homo sapiens
  misc_feature: GYAE6OF01BN4X2.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaaatatgcttactggtaccagcagaagccaggccaggccccctgtcttgatcatttaataaaagactttgagagggcctcagggacccctgagcgattctctggctccagctcagcgacaaacagtcacgttgaccatcagtggagtccgggcagagacgagctgactattactgtcagtcatcagacagtagtggcacttctgtcgtattcgggcggagggaccaaggcagaccgtcctaggtcagcccaaggctccgg

SEQ ID NO: 20662 - DNA, 204 bp, Homo sapiens
  misc_feature: GYAE6OF01CTBI6.49.53.E09.1.454.CMB.1.raw
  modified_base (173)..(204): a, c, t, g, unknown or other
  misc_feature (173)..(204): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnnnnnnnnnnnnn

SEQ ID NO: 20663 - DNA, 178 bp, Homo sapiens; identical to SEQ ID NO: 20465
  misc_feature: GYAE6OF01EKY7O.49.53.E09.1.454.CMB.1.raw
  modified_base (173)..(178): a, c, t, g, unknown or other
  misc_feature (173)..(178): n is a, c, g, or t

SEQ ID NO: 20664 - DNA, 212 bp, Homo sapiens
  misc_feature: GYAE6OF01C0KMU.49.53.E09.1.454.CMB.1.raw
  modified_base (180)..(212): a, c, t, g, unknown or other
  misc_feature (180)..(212): n is a, c, g, or t
tcagagtcgagagacacgaccggtgctcgatttagagagagtgtgttgggtttgggggaagaggaagactgacggttcccccaggagttcaggtgctcgggcacaggcggccctgggctgcctggtcaagggacgaccttcctctctcgactcgtgacgcgggctggcaaggcgcatagnnnnnnnnnnnnnnnnnnnnnnnnnnnnnnnnn

SEQ ID NO: 20665 - DNA, 495 bp, Homo sapiens
  misc_feature: GYAE6OF01EVB5W.49.53.E09.1.454.CMB.1.raw
  modified_base (385)..(385): a, c, t, g, unknown or other
  misc_feature (385)..(385): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggnaggaggacgaggctgactattactgtcagtcatcagacagtagtggcacttctgttcgtagttcggcggagggaccaaggctgaccgtctaggtcagcccaagctcccgg

SEQ ID NO: 20666 - DNA, 175 bp, Homo sapiens
  misc_feature: GYAE6OF01A7EB9.49.53.E09.1.454.CMB.1.raw
  modified_base (173)..(175): a, c, t, g, unknown or other
  misc_feature (173)..(175): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttccttctcgactctgagcgggcttggcaaggcgcatagnnn

SEQ ID NO: 20667 - DNA, 187 bp, Homo sapiens
  misc_feature: GYAE6OF01C0OUU.49.53.E09.1.454.CMB.1.raw
  modified_base (171)..(187): a, c, t, g, unknown or other
  misc_feature (171)..(187): n is a, c, g, or t
tcagagtcgagagacacgaccggtgctcgatttagagagagtgtgttgggtttgggggaagaggagactgacggtccccaggagttcaggtgctgggcacagcggccctgggctgcctggtcaaggactacttcctctctcgactctgagcgggctggcaaggcgcatagnnnnnnnnnnnnnnnnn

SEQ ID NO: 20668 - DNA, 173 bp, Homo sapiens; identical to SEQ ID NO: 20229
  misc_feature: GYAE6OF01DLQMH.49.53.E09.1.454.CMB.1.raw
  modified_base (173)..(173): a, c, t, g, unknown or other
  misc_feature (173)..(173): n is a, c, g, or t

SEQ ID NO: 20669 - DNA, 174 bp, Homo sapiens; identical to SEQ ID NO: 20265
  misc_feature: GYAE6OF01BU1KK.49.53.E09.1.454.CMB.1.raw
  modified_base (173)..(174): a, c, t, g, unknown or other
  misc_feature (173)..(174): n is a, c, g, or t

SEQ ID NO: 20670 - DNA, 195 bp, Homo sapiens
  misc_feature: GYAE6OF01ERIZT.49.53.E09.1.454.CMB.1.raw
  modified_base (174)..(195): a, c, t, g, unknown or other
  misc_feature (174)..(195): n is a, c, g, or t
tcagagtcgagagacacgaccggtgctcgatttagagagagtgtgttgggtttgggggaagaggaagactgacggtcccccaggagttcaggtgctgggcacagccggccctgggctgcctgggtcaaggctacttcctctctcgactctgagcgggctggcaaggcgcatagnnnnnnnnnnnnnnnnnnnnnn

SEQ ID NO: 20671 - DNA, 172 bp, Homo sapiens; identical to SEQ ID NO: 20291
  misc_feature: GYAE6OF01D9TAO.49.53.E09.1.454.CMB.1.raw

SEQ ID NO: 20672 - DNA, 173 bp, Homo sapiens; identical to SEQ ID NO: 20229
  misc_feature: GYAE6OF01CNVT8.49.53.E09.1.454.CMB.1.raw
  modified_base (173)..(173): a, c, t, g, unknown or other
  misc_feature (173)..(173): n is a, c, g, or t

SEQ ID NO: 20673 - DNA, 174 bp, Homo sapiens; identical to SEQ ID NO: 20265
  misc_feature: GYAE6OF01C7RSR.49.53.E09.1.454.CMB.1.raw
  modified_base (173)..(174): a, c, t, g, unknown or other
  misc_feature (173)..(174): n is a, c, g, or t

SEQ ID NO: 20674 - DNA, 174 bp, Homo sapiens; identical to SEQ ID NO: 20265
  misc_feature: GYAE6OF01BFAM8.49.53.E09.1.454.CMB.1.raw
  modified_base (173)..(174): a, c, t, g, unknown or other
  misc_feature (173)..(174): n is a, c, g, or t

SEQ ID NO: 20675 - DNA, 178 bp, Homo sapiens; identical to SEQ ID NO: 20465
  misc_feature: GYAE6OF01C8GJ4.49.53.E09.1.454.CMB.1.raw
  modified_base (173)..(178): a, c, t, g, unknown or other
  misc_feature (173)..(178): n is a, c, g, or t

SEQ ID NO: 20676 - DNA, 174 bp, Homo sapiens; identical to SEQ ID NO: 20265
  misc_feature: GYAE6OF01EQ8YM.49.53.E09.1.454.CMB.1.raw
  modified_base (173)..(174): a, c, t, g, unknown or other
  misc_feature (173)..(174): n is a, c, g, or t

SEQ ID NO: 20677 - DNA, 173 bp, Homo sapiens; identical to SEQ ID NO: 20229
  misc_feature: GYAE6OF01CG0ET.49.53.E09.1.454.CMB.1.raw
  modified_base (173)..(173): a, c, t, g, unknown or other
  misc_feature (173)..(173): n is a, c, g, or t

SEQ ID NO: 20678 - DNA, 173 bp, Homo sapiens
  misc_feature: GYAE6OF01C74GO.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgtgggaagaggaagactgacggtcccccaggagttcaggtgctgggcacagcggccctgggctgcctggtcaaggactacttcctctctcgactctgagcgggctggcaaggcgcatagn

SEQ ID NO: 20679 - DNA, 173 bp, Homo sapiens; identical to SEQ ID NO: 20229
  misc_feature: GYAE6OF01DKC8S.49.53.E09.1.454.CMB.1.raw
  modified_base (173)..(173): a, c, t, g, unknown or other
  misc_feature (173)..(173): n is a, c, g, or t

SEQ ID NO: 20680 - DNA, 174 bp, Homo sapiens
  misc_feature: GYAE6OF01EWK7F.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggttaaggactacttcctctctcgactctgagcgggctggcaaggcgcatagn

SEQ ID NO: 20681 - DNA, 174 bp, Homo sapiens; identical to SEQ ID NO: 20265
  misc_feature: GYAE6OF01CN0P0.49.53.E09.1.454.CMB.1.raw
  modified_base (173)..(174): a, c, t, g, unknown or other
  misc_feature (173)..(174): n is a, c, g, or t

SEQ ID NO: 20682 - DNA, 172 bp, Homo sapiens
  misc_feature: GYAE6OF01AH2NF.49.53.E09.1.454.CMB.1.raw
tcagagtcgagagacacgaccggtgctcgatttagagagagtgtgttgggtttgggggaagaggaagactgaccggtcccccaggagttcaggtgctgggcacagcggcctgggctgcctggtcaaggactacttcctctctcgactctgagcgggctggcaaggcgcatag

SEQ ID NO: 20683 - DNA, 173 bp, Homo sapiens; identical to SEQ ID NO: 20229
  misc_feature: GYAE6OF01C03U2.49.53.E09.1.454.CMB.1.raw
  modified_base (173)..(173): a, c, t, g, unknown or other
  misc_feature (173)..(173): n is a, c, g, or t

SEQ ID NO: 20684 - DNA, 173 bp, Homo sapiens; identical to SEQ ID NO: 20229
  misc_feature: GYAE6OF01CGE6W.49.53.E09.1.454.CMB.1.raw
  modified_base (173)..(173): a, c, t, g, unknown or other
  misc_feature (173)..(173): n is a, c, g, or t

SEQ ID NO: 20685 - DNA, 173 bp, Homo sapiens; identical to SEQ ID NO: 20229
  misc_feature: GYAE6OF01EPWNK.49.53.E09.1.454.CMB.1.raw
  modified_base (173)..(173): a, c, t, g, unknown or other
  misc_feature (173)..(173): n is a, c, g, or t

SEQ ID NO: 20686 - DNA, 179 bp, Homo sapiens; identical to SEQ ID NO: 20397
  misc_feature: GYAE6OF01CHTZ9.49.53.E09.1.454.CMB.1.raw
  modified_base (173)..(179): a, c, t, g, unknown or other
  misc_feature (173)..(179): n is a, c, g, or t

SEQ ID NO: 20687 - DNA, 173 bp, Homo sapiens; identical to SEQ ID NO: 20229
  misc_feature: GYAE6OF01BKO4C.49.53.E09.1.454.CMB.1.raw
  modified_base (173)..(173): a, c, t, g, unknown or other
  misc_feature (173)..(173): n is a, c, g, or t

SEQ ID NO: 20688 - DNA, 180 bp, Homo sapiens; identical to SEQ ID NO: 20603
  misc_feature: GYAE6OF01AN6FY.49.53.E09.1.454.CMB.1.raw
  modified_base (174)..(180): a, c, t, g, unknown or other
  misc_feature (174)..(180): n is a, c, g, or t

SEQ ID NO: 20689 - DNA, 173 bp, Homo sapiens; identical to SEQ ID NO: 20229
  misc_feature: GYAE6OF01DY6SR.49.53.E09.1.454.CMB.1.raw
  modified_base (173)..(173): a, c, t, g, unknown or other
  misc_feature (173)..(173): n is a, c, g, or t

SEQ ID NO: 20690 - DNA, 276 bp, Homo sapiens
  misc_feature: GYAE6OF01ATQCH.49.53.E09.1.454.CMB.1.raw
  modified_base (179)..(181): a, c, t, g, unknown or other
  misc_feature (179)..(181): n is a, c, g, or t
  modified_base (183)..(189): a, c, t, g, unknown or other
  misc_feature (183)..(189): n is a, c, g, or t
  modified_base (192)..(276): a, c, t, g, unknown or other
  misc_feature (192)..(276): n is a, c, g, or t
tcagagtcgagagacacgaccggtgctcgatttagagagagtgtgttgggggtttggggggaagaggaagactgacggtccccccaggagttcaggtgctcgggcacagcggccctgggctgcctggtcaaggctacttcctctctcgactctggagcgggctgggcaaggcgcatagnnncnnnnnnngannnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20691 - DNA, 173 bp, Homo sapiens; identical to SEQ ID NO: 20337
  misc_feature: GYAE6OF01EBRMW.49.53.E09.1.454.CMB.1.raw
  modified_base (173)..(173): a, c, t, g, unknown or other
  misc_feature (173)..(173): n is a, c, g, or t

SEQ ID NO: 20692 - DNA, 175 bp, Homo sapiens; identical to SEQ ID NO: 20418
  misc_feature: GYAE6OF01CUKBV.49.53.E09.1.454.CMB.1.raw
  modified_base (173)..(175): a, c, t, g, unknown or other
  misc_feature (173)..(175): n is a, c, g, or t

SEQ ID NO: 20693 - DNA, 223 bp, Homo sapiens
  misc_feature: GYAE6OF01C4VM6.49.53.E09.1.454.CMB.1.raw
  modified_base (137)..(137): a, c, t, g, unknown or other
  misc_feature (137)..(137): n is a, c, g, or t
  modified_base (172)..(178): a, c, t, g, unknown or other
  misc_feature (172)..(178): n is a, c, g, or t
  modified_base (180)..(183): a, c, t, g, unknown or other
  misc_feature (180)..(183): n is a, c, g, or t
  modified_base (185)..(223): a, c, t, g, unknown or other
  misc_feature (185)..(223): n is a, c, g, or t
tcagagtcgagagacacgaccggtgctcgatttagagagagtgtgttggggttgggggaagaggaagactgacggtcccccaggagttcaggtgctgggcacagcggccctgggctgcctggtcaaggctactcctntctcgactctgagtcgggctggcaaggcgcatagnnnnnnngnnnngnnnnnnnnnnnnnnnnnnnnnnnnnnnnnnnnnnnnnnn

SEQ ID NO: 20694 - DNA, 173 bp, Homo sapiens; identical to SEQ ID NO: 20229
  misc_feature: GYAE6OF01BSGXF.49.53.E09.1.454.CMB.1.raw
  modified_base (173)..(173): a, c, t, g, unknown or other
  misc_feature (173)..(173): n is a, c, g, or t

SEQ ID NO: 20695 - DNA, 173 bp, Homo sapiens; identical to SEQ ID NO: 20229
  misc_feature: GYAE6OF01BF71M.49.53.E09.1.454.CMB.1.raw
  modified_base (173)..(173): a, c, t, g, unknown or other
  misc_feature (173)..(173): n is a, c, g, or t

SEQ ID NO: 20696 - DNA, 493 bp, Homo sapiens
  misc_feature: GYAE6OF01CT96W.49.53.E09.1.454.CMB.1.raw
  modified_base (384)..(384): a, c, t, g, unknown or other
  misc_feature (384)..(384): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgaccaaaagcaatatgcttactggtaccagcagaagccaggccaggcccctgtcttgatcatttataaagactttgagagggcctcagggacccctgagcgattctctggctcagctcagcgacaacagtcacgttgacatcagtggagtccgggnaggaggacgaggctgactattactgtcagtcatcagacagtagtgctacttcgtgtcgtattcgggcggagggaccaagctgaccgtctaggtcagcccaaggctcccg

SEQ ID NO: 20697 - DNA, 489 bp, Homo sapiens
  misc_feature: GYAE6OF01EQ2XR.49.53.E09.1.454.CMB.1.raw
  modified_base (383)..(383): a, c, t, g, unknown or other
  misc_feature (383)..(383): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtctgatcatttataaagactttgagagggcctcagggacccctgagcgattctctggctccagctcagcgacaacagtcacgttgaccatcagtggagtccgggnagaggacgaggctgactattactgtcagtcatcagacagtagtggctacttctgtcgttatcggcggagggaccaggctgaccgtctaggtcagcccaagctcccg

SEQ ID NO: 20698 - DNA, 174 bp, Homo sapiens; identical to SEQ ID NO: 20265
  misc_feature: GYAE6OF01CG564.49.53.E09.1.454.CMB.1.raw
  modified_base (173)..(174): a, c, t, g, unknown or other
  misc_feature (173)..(174): n is a, c, g, or t

SEQ ID NO: 20699 - DNA, 179 bp, Homo sapiens
  misc_feature: GYAE6OF01EOTO1.49.53.E09.1.454.CMB.1.raw
  modified_base (137)..(137): a, c, t, g, unknown or other
  misc_feature (137)..(137): n is a, c, g, or t
  modified_base (172)..(179): a, c, t, g, unknown or other
  misc_feature (172)..(179): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggctacttccnctctcgactctgagcgggctggcaaggcgcatagnnnnnnnn

SEQ ID NO: 20700 - DNA, 188 bp, Homo sapiens
  misc_feature: GYAE6OF01EP2VS.49.53.E09.1.454.CMB.1.raw
  modified_base (173)..(188): a, c, t, g, unknown or other
  misc_feature (173)..(188): n is a, c, g, or t
tcagagtcgagagacacgaccggtgctcgatttagagagagtgtgttgggtttggggggaagaggaagactgacggtcccccaggagttcaggtgctgggcacagcggccctggctgcctggtcaaggactacttcctcgtagcactctgagcgggctggcaaggcgcatagnnnnnnnnnnnnnnnn

SEQ ID NO: 20701 - DNA, 173 bp, Homo sapiens; identical to SEQ ID NO: 20229
  misc_feature: GYAE6OF01A6JWN.49.53.E09.1.454.CMB.1.raw
  modified_base (173)..(173): a, c, t, g, unknown or other
  misc_feature (173)..(173): n is a, c, g, or t

SEQ ID NO: 20702 - DNA, 173 bp, Homo sapiens; identical to SEQ ID NO: 20229
  misc_feature: GYAE6OF01DG5ED.49.53.E09.1.454.CMB.1.raw
  modified_base (173)..(173): a, c, t, g, unknown or other
  misc_feature (173)..(173): n is a, c, g, or t

SEQ ID NO: 20703 - DNA, 173 bp, Homo sapiens; identical to SEQ ID NO: 20229
  misc_feature: GYAE6OF01E168R.49.53.E09.1.454.CMB.1.raw
  modified_base (173)..(173): a, c, t, g, unknown or other
  misc_feature (173)..(173): n is a, c, g, or t

SEQ ID NO: 20704 - DNA, 185 bp, Homo sapiens
  misc_feature: GYAE6OF01CX06M.49.53.E09.1.454.CMB.1.raw
  modified_base (172)..(185): a, c, t, g, unknown or other
  misc_feature (172)..(185): n is a, c, g, or t
tcagagtcgagagacacgaccggtgctcgatttagagagagtgtgttgggtttgggggaagaggaagactgacggtcccccaggagttcaggtgctgggcacagcggccctggctgcctggtcaaggactacttcctcgtagcactctgagcgggctggcaaggcgcatagnnnnnnnnnnnnnn

SEQ ID NO: 20705 - DNA, 183 bp, Homo sapiens
  misc_feature: GYAE6OF01DLNAP.49.53.E09.1.454.CMB.1.raw
  modified_base (173)..(183): a, c, t, g, unknown or other
  misc_feature (173)..(183): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaaggactacttcctctctcgactctgagcgggctggcaaggcgcatagnnnnnnnnnnn

SEQ ID NO: 20706 - DNA, 170 bp, Homo sapiens
  misc_feature: GYAE6OF01EDA7X.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctcactctgagcgggctggcaaggcgcatagn

SEQ ID NO: 20707 - DNA, 173 bp, Homo sapiens; identical to SEQ ID NO: 20229
  misc_feature: GYAE6OF01CNUKU.49.53.E09.1.454.CMB.1.raw
  modified_base (173)..(173): a, c, t, g, unknown or other
  misc_feature (173)..(173): n is a, c, g, or t

SEQ ID NO: 20708 - DNA, 204 bp, Homo sapiens
  misc_feature: GYAE6OF01CHOCM.49.53.E09.1.454.CMB.1.raw
  modified_base (142)..(142): a, c, t, g, unknown or other
  misc_feature (142)..(142): n is a, c, g, or t
  modified_base (176)..(204): a, c, t, g, unknown or other
  misc_feature (176)..(204): n is a, c, g, or t
tcagagtcgagagacacgaccggtgctcgatttagagagagtgtgttggggtttggtggggaagaggaagactgacggtcccccaggagttcaggtgctgggcacagcggccctgggctgcctggtcaaggactacttcctntctcgactctgagcgggctggcaaggcgcatagnnnnnnnnnnnnnnnnnnnnnnnnnnnnn

SEQ ID NO: 20709 - DNA, 175 bp, Homo sapiens; identical to SEQ ID NO: 20418
  misc_feature: GYAE6OF01BHDXU.49.53.E09.1.454.CMB.1.raw
  modified_base (173)..(175): a, c, t, g, unknown or other
  misc_feature (173)..(175): n is a, c, g, or t

SEQ ID NO: 20710 - DNA, 173 bp, Homo sapiens; identical to SEQ ID NO: 20229
  misc_feature: GYAE6OF01DBFYD.49.53.E09.1.454.CMB.1.raw
  modified_base (173)..(173): a, c, t, g, unknown or other
  misc_feature (173)..(173): n is a, c, g, or t

SEQ ID NO: 20711 - DNA, 201 bp, Homo sapiens
  misc_feature: GYAE6OF01AORNA.49.53.E09.1.454.CMB.1.raw
  modified_base (176)..(201): a, c, t, g, unknown or other
  misc_feature (176)..(201): n is a, c, g, or t
tcagagtcgagagacacgaccggtgctcgatttagagagagtgtgttgggtttgggggaagaggaagactgaccggtcccccaggagttcaggtgctgggcacagcggccctgggcctgcctggtcaaggactacttcctctctcgactctgagcgggctgggcaaggcgcatagnnnnnnnnnnnnnnnnnnnnnnnnnn

SEQ ID NO: 20712 - DNA, 273 bp, Homo sapiens
  misc_feature: GYAE6OF01DHI21.49.53.E09.1.454.CMB.1.raw
  modified_base (267)..(273): a, c, t, g, unknown or other
  misc_feature (267)..(273): n is a, c, g, or t
tcagagtcgagagacacgaccggtgctcgatttagagagagtgtgttgggtttggggtgctcgatttagtatctgatagttgggtttgggggaggtgtgtcacaagatttgggccctggtcaccgtctcctcagcttccaccaaggcccatcggtcttcccctggcgccctgctccaggagcacctctgggggcacagcggccctgggctgcctggtcaaggactacttcctctctcgactctgagcgggctggcaaggcgcatagnnnnnnn

SEQ ID NO: 20713 - DNA, 173 bp, Homo sapiens; identical to SEQ ID NO: 20229
  misc_feature: GYAE6OF01D4YXV.49.53.E09.1.454.CMB.1.raw
  modified_base (173)..(173): a, c, t, g, unknown or other
  misc_feature (173)..(173): n is a, c, g, or t

SEQ ID NO: 20714 - DNA, 656 bp, Homo sapiens
  misc_feature: GYAE6OF01CT4LP.49.53.E09.1.454.CMB.1.raw
  modified_base (303)..(303): a, c, t, g, unknown or other
  misc_feature (303)..(303): n is a, c, g, or t
tcagagtcgagagacacgaccggtgctcgatttagagagagtgtgttgggtttggggtgggtccaggaggcagaactctgggtgtctcaccatggcctggatccctctacttcctcccctcctcactctctgcacagactctgacggcctcctatgagctgacacacgccacccgtcggtgtctgtgtcctcgaggacagacggccagtatcacctgctctggagatgcattcgaaccaaagcaaatatgtcttactggtaccagcaagaagccgagccgacggcctgtctgatctatttaanaaagtactttagaggacggcctcgacggaccccgtgacgcgtacttctcgtcggctaccagctacgacgacgaaccaaacgtacgtacctaacggttacgaccgtaagtaccgtagggtcgggacgggtcccgggacgaacgggaacgggaacggagggtacgtacggtaacttacgttaacgtgtacacgttacaacgttacgaagaaccgtaggtacggtacggtacctaacgttcgtagggttcctacgggtttaccgggacgggtaacgggtaaccgaacggtccggtacggtaaccccgttcgtaaccgggttaccaaccggtaccccgaacggtcccgtacccccgg

SEQ ID NO: 20715 - DNA, 173 bp, Homo sapiens; identical to SEQ ID NO: 20229
  misc_feature: GYAE6OF01AVKXJ.49.53.E09.1.454.CMB.1.raw
  modified_base (173)..(173): a, c, t, g, unknown or other
  misc_feature (173)..(173): n is a, c, g, or t

SEQ ID NO: 20716 - DNA, 173 bp, Homo sapiens; identical to SEQ ID NO: 20229
  misc_feature: GYAE6OF01BS0V1.49.53.E09.1.454.CMB.1.raw
  modified_base (173)..(173): a, c, t, g, unknown or other
  misc_feature (173)..(173): n is a, c, g, or t

SEQ ID NO: 20717 - DNA, 174 bp, Homo sapiens
  misc_feature: GYAE6OF01B31Q5.49.53.E09.1.454.CMB.1.raw
  modified_base (172)..(174): a, c, t, g, unknown or other
  misc_feature (172)..(174): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgacctgagcgggctggcaaggcgcatagnnn

SEQ ID NO: 20718 - DNA, 172 bp, Homo sapiens; identical to SEQ ID NO: 20291
  misc_feature: GYAE6OF01D7EOE.49.53.E09.1.454.CMB.1.raw

SEQ ID NO: 20719 - DNA, 193 bp, Homo sapiens
  misc_feature: GYAE6OF01BKWJO.49.53.E09.1.454.CMB.1.raw
  modified_base (173)..(193): a, c, t, g, unknown or other
  misc_feature (173)..(193): n is a, c, g, or t
tcagagtcgagagacacgaccggtgctcgatttagagagagtgtgttggggtttgggggaagaggaagactgacggtcccccaggagttcaggtgctgggcacagcggcctgggctgcctggtcaaggctacttcctcgtagcacgtctgagcgggctggcaaggcgcatagnnnnnnnnnnnnnnnnnnnnn

SEQ ID NO: 20720 - DNA, 185 bp, Homo sapiens
  misc_feature: GYAE6OF01D8SIR.49.53.E09.1.454.CMB.1.raw
  modified_base (172)..(185): a, c, t, g, unknown or other
  misc_feature (172)..(185): n is a, c, g, or t
tcagagtcgagagacacgaccggtgctcgatttagagagagtgtgttgggtttgggggaagaggaagactgacggtccccaggagttcaggtgcgtgggcacagcggccctgggctgcctggtcaaggactacttcctctctcgactctgagcggctggcaaggcgcatagnnnnnnnnnnnnnn

SEQ ID NO: 20721 - DNA, 173 bp, Homo sapiens
  misc_feature: GYAE6OF01A2ADR.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaggaagactgacggtcccccaggagttcaggtgctgggcacagcggcctgggcgtgcctggtcaaggactacttcctcgtagcactctgagcgggctggcaaggcgcatagn

SEQ ID NO: 20722 - DNA, 173 bp, Homo sapiens
  misc_feature: GYAE6OF01DSD8W.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttccttctcgactctgagcgggctggcaaggcgcatagn

SEQ ID NO: 20723 - DNA, 173 bp, Homo sapiens; identical to SEQ ID NO: 20229
  misc_feature: GYAE6OF01DPXKQ.49.53.E09.1.454.CMB.1.raw
  modified_base (173)..(173): a, c, t, g, unknown or other
  misc_feature (173)..(173): n is a, c, g, or t

SEQ ID NO: 20724 - DNA, 173 bp, Homo sapiens; identical to SEQ ID NO: 20229
  misc_feature: GYAE6OF01BMFZK.49.53.E09.1.454.CMB.1.raw
  modified_base (173)..(173): a, c, t, g, unknown or other
  misc_feature (173)..(173): n is a, c, g, or t

SEQ ID NO: 20725 - DNA, 578 bp, Homo sapiens
  misc_feature: GYAE6OF01BTI1O.49.53.E09.1.454.CMB.1.raw
tcagagtcgagagacacgaccggtgctcgatttagagagagtgtgttggggtttgggggtcgggtaccaggacggcaggaactctcgggtgtctcaccatcggcctggatccctctacttctcccctcctcactcttctgcacagactctgaggcctcctactgacgctgacacaggccaccctcggtgtctgtgtcctcaggacacgacgggccaggtatcgaccttgctctgggacgatggcatttcgacctaaaagcaatatgtcttactggtaccagcctagaagccgaggtccaggcccctgtcgttgagtctatttataaagacgtttagagagggcctcgacgggacccctggacgtcgagttctctaggtcctcacgctcagtcgacaacagtacacgttagacctatcgagtggacggtcccggagaaggaacggacggaggactacgactattactgtactagtcatcgagacgtagtagtgactacttctacgttcgtagttccgggacggtacgggaccaggtccgtagaccgtaccgtacggtcacgcccaaggtcgtaccccgg

SEQ ID NO: 20726 - DNA, 172 bp, Homo sapiens; identical to SEQ ID NO: 20291
  misc_feature: GYAE6OF01BF0EL.49.53.E09.1.454.CMB.1.raw

SEQ ID NO: 20727 - DNA, 172 bp, Homo sapiens; identical to SEQ ID NO: 20291
  misc_feature: GYAE6OF01BJ3SJ.49.53.E09.1.454.CMB.1.raw

SEQ ID NO: 20728 - DNA, 242 bp, Homo sapiens
  misc_feature: GYAE6OF01D9E7C.49.53.E09.1.454.CMB.1.raw
  modified_base (188)..(242): a, c, t, g, unknown or other
  misc_feature (188)..(242): n is a, c, g, or t
tcagagtcgagagacacgaccggtgctcgatttagagagagtgtgttggggtttggggggtaaggaggaacgactgacgggtccccccacggagttcaggtggctgggcacgacgcggccctgggctgccgtggtcaaggactacttcctctctccgactcctgagcgggctggcaaggcgcatacgnnnnnnnnnnnnnnnnnnnnnnnnnnnnnnnnnnnnnnnnnnnnnnnnnnnnnnn

SEQ ID NO: 20729 - DNA, 173 bp, Homo sapiens; identical to SEQ ID NO: 20337
  misc_feature: GYAE6OF01BOLAF.49.53.E09.1.454.CMB.1.raw
  modified_base (173)..(173): a, c, t, g, unknown or other
  misc_feature (173)..(173): n is a, c, g, or t

SEQ ID NO: 20730 - DNA, 181 bp, Homo sapiens; identical to SEQ ID NO: 20539
  misc_feature: GYAE6OF01A6CO6.49.53.E09.1.454.CMB.1.raw
  modified_base (173)..(181): a, c, t, g, unknown or other
  misc_feature (173)..(181): n is a, c, g, or t

SEQ ID NO: 20731 - DNA, 175 bp, Homo sapiens; identical to SEQ ID NO: 20458
  misc_feature: GYAE6OF01BXNWB.49.53.E09.1.454.CMB.1.raw
  modified_base (173)..(175): a, c, t, g, unknown or other
  misc_feature (173)..(175): n is a, c, g, or t

SEQ ID NO: 20732 - DNA, 174 bp, Homo sapiens; identical to SEQ ID NO: 20265
  misc_feature: GYAE6OF01ESS70.49.53.E09.1.454.CMB.1.raw
  modified_base (173)..(174): a, c, t, g, unknown or other
  misc_feature (173)..(174): n is a, c, g, or t

SEQ ID NO: 20733 - DNA, 173 bp, Homo sapiens; identical to SEQ ID NO: 20229
  misc_feature: GYAE6OF01ARMZH.49.53.E09.1.454.CMB.1.raw
  modified_base (173)..(173): a, c, t, g, unknown or other
  misc_feature (173)..(173): n is a, c, g, or t

SEQ ID NO: 20734 - DNA, 173 bp, Homo sapiens; identical to SEQ ID NO: 20337
  misc_feature: GYAE6OF01EVDT2.49.53.E09.1.454.CMB.1.raw
  modified_base (173)..(173): a, c, t, g, unknown or other
  misc_feature (173)..(173): n is a, c, g, or t

SEQ ID NO: 20735 - DNA, 513 bp, Homo sapiens
  misc_feature: GYAE6OF01BPBEW.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagtactttgagagggcctcgagggacccctgagcgattctctggctccagctcagcgacaacagtcacgttgaccatcagtggagtcggcagaggacgaggctgactattactgtcagtcactcagacagtagtgctacttctgtcgtagttcgggcggtacgggacaggctacggacccgttccgtacgggtccacggcccaaaggtccgtacccgg

SEQ ID NO: 20736 - DNA, 211 bp, Homo sapiens
  misc_feature: GYAE6OF01CV0GY.49.53.E09.1.454.CMB.1.raw
  modified_base (142)..(142): a, c, t, g, unknown or other
  misc_feature (142)..(142): n is a, c, g, or t
  modified_base (174)..(211): a, c, t, g, unknown or other
  misc_feature (174)..(211): n is a, c, g, or t
tcagagtcgagagacacgaccggtgctcgatttagagagagtgtgttgggtttgggggaagtaggaagactgacggtaccccaggagttcaggtgctggcactagcggccctgggctgcctggtcaaggactacttcctctntcgactctgagcgggctggcaaggcgcatagnnnnnnnnnnnnnnnnnnnnnnnnnnnnnnnnnnnnnn

SEQ ID NO: 20737 - DNA, 173 bp, Homo sapiens; identical to SEQ ID NO: 20229
  misc_feature: GYAE6OF01EG921.49.53.E09.1.454.CMB.1.raw
  modified_base (173)..(173): a, c, t, g, unknown or other
  misc_feature (173)..(173): n is a, c, g, or t

SEQ ID NO: 20738 - DNA, 255 bp, Homo sapiens
  misc_feature: GYAE6OF01E3ZE8.49.53.E09.1.454.CMB.1.raw
  modified_base (172)..(255): a, c, t, g, unknown or other
  misc_feature (172)..(255): n is a, c, g, or t
tcagagtcgagagacacgaccggtgctcgatttagagagagtgtgttgggtttggggggaagaggaagactggaccggtcccccaggagttcaggtgctgggcacagcgccctggctgctggtcaggactactcctcttcgactctgagcgggctggcaagggcgcataggnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20739 - DNA, 168 bp, Homo sapiens
  misc_feature: GYAE6OF01DAFLY.49.53.E09.1.454.CMB.1.raw
  modified_base (167)..(168): a, c, t, g, unknown or other
  misc_feature (167)..(168): n is a, c, g, or t
tcagagtcgagagacacgaccggtgctcgatttagagagagtgtgttgggtttgggaacattgacctgtgtgggaattgcaccatgcccctttgtgtgttcagacgtctgctaaatcgagcaccggtcgtgtctctcgactctgagcgggctggcaaggcgcatagnn

SEQ ID NO: 20740 - DNA, 176 bp, Homo sapiens
  misc_feature: GYAE6OF01B8AJD.49.53.E09.1.454.CMB.1.raw
  modified_base (174)..(176): a, c, t, g, unknown or other
  misc_feature (174)..(176): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctgggcaaggcgcatagnnn

SEQ ID NO: 20741 - DNA, 173 bp, Homo sapiens; identical to SEQ ID NO: 20229
  misc_feature: GYAE6OF01AN03G.49.53.E09.1.454.CMB.1.raw
  modified_base (173)..(173): a, c, t, g, unknown or other
  misc_feature (173)..(173): n is a, c, g, or t

SEQ ID NO: 20742 - DNA, 173 bp, Homo sapiens; identical to SEQ ID NO: 20229
  misc_feature: GYAE6OF01DHO4F.49.53.E09.1.454.CMB.1.raw
  modified_base (173)..(173): a, c, t, g, unknown or other
  misc_feature (173)..(173): n is a, c, g, or t

SEQ ID NO: 20743 - DNA, 175 bp, Homo sapiens; identical to SEQ ID NO: 20418
  misc_feature: GYAE6OF01BBUTL.49.53.E09.1.454.CMB.1.raw
  modified_base (173)..(175): a, c, t, g, unknown or other
  misc_feature (173)..(175): n is a, c, g, or t

SEQ ID NO: 20744 - DNA, 185 bp, Homo sapiens
  misc_feature: GYAE6OF01A69KB.49.53.E09.1.454.CMB.1.raw
  modified_base (173)..(185): a, c, t, g, unknown or other
  misc_feature (173)..(185): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnn

SEQ ID NO: 20745 - DNA, 183 bp, Homo sapiens
  misc_feature: GYAE6OF01DDO89.49.53.E09.1.454.CMB.1.raw
  modified_base (173)..(183): a, c, t, g, unknown or other
  misc_feature (173)..(183): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnn

SEQ ID NO: 20746 - DNA, 172 bp, Homo sapiens; identical to SEQ ID NO: 20291
  misc_feature: GYAE6OF01DEDO3.49.53.E09.1.454.CMB.1.raw

SEQ ID NO: 20747 - DNA, 172 bp, Homo sapiens; identical to SEQ ID NO: 20291
  misc_feature: GYAE6OF01EI9KW.49.53.E09.1.454.CMB.1.raw

SEQ ID NO: 20748 - DNA, 177 bp, Homo sapiens
  misc_feature: GYAE6OF01BF2KB.49.53.E09.1.454.CMB.1.raw
  modified_base (173)..(177): a, c, t, g, unknown or other
  misc_feature (173)..(177): n is a, c, g, or t
tcagagtcgagagacacgaccggtgctcgatttagagagagtgtgttgggtttgggggaagaggaagactgacggtcccccaggagttcaggtgctgggcacagcggccctgggctacctggtcaaggactacttcctctctcgactctgagcgggctggcaaggcgcatagnnnnn

SEQ ID NO: 20749 - DNA, 173 bp, Homo sapiens
  misc_feature: GYAE6OF01A328I.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcaatctgagcgggctggcaaggcgcatagn

SEQ ID NO: 20750 - DNA, 182 bp, Homo sapiens
  misc_feature: GYAE6OF01CJYID.49.53.E09.1.454.CMB.1.raw
  modified_base (174)..(182): a, c, t, g, unknown or other
  misc_feature (174)..(182): n is a, c, g, or t
tcagagtcgagagacacgaccggtgctcgatttagagagagtgtgttggggtttgggggaagaggaagactgacggtcccccaggagttcaggtgctgggcacagcggccctgggctgcctggtcaaggactacttcctctctcgactctgagcgggctggcaaggcgcatagnnnnnnnnn

SEQ ID NO: 20751 - DNA, 174 bp, Homo sapiens
  misc_feature: GYAE6OF01C3SEM.49.53.E09.1.454.CMB.1.raw
  modified_base (173)..(174): a, c, t, g, unknown or other
  misc_feature (173)..(174): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctctctcgacctgagcgggctggcaaggcgcatagnn

SEQ ID NO: 20752 - DNA, 637 bp, Homo sapiens
  misc_feature: GYAE6OF01CJV5F.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagcggccagtatcacctgctctggagatgcattgaccaaagcaatatgcttactggtaccagcaagaagccaggccacggcccctgtctgatcatttaataaagtactttgagagggcctcgacgggacccctgagcgtattctcgtcggctccagtcctcacgaccgtaacaaacgagtacctacggttacgaccctataccgtagggtacgggacgggtcccgggacgaagggaacgggacggacgggtcgtacggtacttaagttacgtgtactagtacacttacgacggaacgtaggttaacggttcggaccttacgttcggttcggttaccggttacggtttccggggacgggtaacgggtaacccgaaggtccgtaccggtacccggttacccgtaacgggtaccaaccggaccccgtaagggcccgttacccccgg

SEQ ID NO: 20753 - DNA, 173 bp, Homo sapiens; identical to SEQ ID NO: 20229
  misc_feature: GYAE6OF01CBDQ5.49.53.E09.1.454.CMB.1.raw
  modified_base (173)..(173): a, c, t, g, unknown or other
  misc_feature (173)..(173): n is a, c, g, or t

SEQ ID NO: 20754 - DNA, 174 bp, Homo sapiens; identical to SEQ ID NO: 20544
  misc_feature: GYAE6OF01E3B6H.49.53.E09.1.454.CMB.1.raw
  modified_base (174)..(174): a, c, t, g, unknown or other
  misc_feature (174)..(174): n is a, c, g, or t

SEQ ID NO: 20755 - DNA, 173 bp, Homo sapiens; identical to SEQ ID NO: 20229
  misc_feature: GYAE6OF01E182N.49.53.E09.1.454.CMB.1.raw
  modified_base (173)..(173): a, c, t, g, unknown or other
  misc_feature (173)..(173): n is a, c, g, or t

SEQ ID NO: 20756 - DNA, 172 bp, Homo sapiens; identical to SEQ ID NO: 20291
  misc_feature: GYAE6OF01AZQNS.49.53.E09.1.454.CMB.1.raw

SEQ ID NO: 20757 - DNA, 173 bp, Homo sapiens; identical to SEQ ID NO: 20229
  misc_feature: GYAE6OF01BJNYM.49.53.E09.1.454.CMB.1.raw
  modified_base (173)..(173): a, c, t, g, unknown or other
  misc_feature (173)..(173): n is a, c, g, or t

SEQ ID NO: 20758 - DNA, 183 bp, Homo sapiens; identical to SEQ ID NO: 20501
  misc_feature: GYAE6OF01A87O2.49.53.E09.1.454.CMB.1.raw
  modified_base (172)..(183): a, c, t, g, unknown or other
  misc_feature (172)..(183): n is a, c, g, or t

SEQ ID NO: 20759 - DNA, 661 bp, Homo sapiens
  misc_feature: GYAE6OF01CD5NB.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctcgtggagatgcattcgaccaaagcaaatatgtacttactggtaacagcagaacgccaggccacggccctgtcttgatctatttaataagtactttgagagggcctacgacgggaccctgagtacgtattcctcgtcggcctccgagtcctacgacgaccgaaacaacgtacgtaccgtacgttacgaacctagtacgtagggtagggacggtcccgggacgaagggaacgggacggacgggacttaggtaacttagttaacgtcggtactacgtacaacgttacgaacggtaacgtaaggttaggtacggtaccttacgtttcgttcggtttacggttaccggttccgggaacggggtaacgggtaaccgaacggtccggttaccggtacccggttaccgtacgggtaccgaaccgggtaccccgtaagggtccccttccccgggg

SEQ ID NO: 20760 - DNA, 741 bp, Homo sapiens
  misc_feature: GYAE6OF01BY2EU.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaacgccacggccacggcccctgtcttgatctatttataaagtactttgagagggcctacgacggacccctggagcgattctcgtcggcctccagctacgacggaccgaaccaaacgacgttacctacggtttacgaacccgtagttaccgtaaggtcggggtaacgggttcccggggaacgtaaggggaacgggaaccgggacggggtacgttacggtaaccgtttaaacgtttaacccgttacggttaccgtaacggtttactaaacgttacgtaaacggtacgtaacgggttaacgggttacgggtacctaaccgttttccgtacgggttttaccggttaacggttttacccgggggaccgggggtaaccggggtaaccccgtaaacgggtcccgttacgggtaaccccggttacccggttaacgggttacccgaacccgggtaccccgaaaacggggttccccgttaaccccccgggg

SEQ ID NO: 20761 - DNA, 174 bp, Homo sapiens; identical to SEQ ID NO: 20265
  misc_feature: GYAE6OF01B5355.49.53.E09.1.454.CMB.1.raw
  modified_base (173)..(174): a, c, t, g, unknown or other
  misc_feature (173)..(174): n is a, c, g, or t

SEQ ID NO: 20762 - DNA, 176 bp, Homo sapiens; identical to SEQ ID NO: 20270
  misc_feature: GYAE6OF01BNHCH.49.53.E09.1.454.CMB.1.raw
  modified_base (173)..(176): a, c, t, g, unknown or other
  misc_feature (173)..(176): n is a, c, g, or t

SEQ ID NO: 20763 - DNA, 179 bp, Homo sapiens
  misc_feature: GYAE6OF01C1Z8J.49.53.E09.1.454.CMB.1.raw
  modified_base (172)..(179): a, c, t, g, unknown or other
  misc_feature (172)..(179): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactactcctctctcgactctgagcgggctggcaaggcgcatagnnnnnnnn

SEQ ID NO: 20764 - DNA, 174 bp, Homo sapiens; identical to SEQ ID NO: 20265
  misc_feature: GYAE6OF01BTRK5.49.53.E09.1.454.CMB.1.raw
  modified_base (173)..(174): a, c, t, g, unknown or other
  misc_feature (173)..(174): n is a, c, g, or t

SEQ ID NO: 20765 - DNA, 189 bp, Homo sapiens
  misc_feature: GYAE6OF01BWSDX.49.53.E09.1.454.CMB.1.raw
  modified_base (173)..(189): a, c, t, g, unknown or other
  misc_feature (173)..(189): n is a, c, g, or t
tcagagtcgagagacacgaccggtgctcgatttagagagagtgtgttgggtttgggggaagaggaagactgaccggtccccccaggagttcaggtgctgggcacagcgcctggctgcctggtcaaggactacttcctctctacgactctgagcgggctggcaaggcgcatagnnnnnnnnnnnnnnnnn

SEQ ID NO: 20766 - DNA, 174 bp, Homo sapiens; identical to SEQ ID NO: 20265
  misc_feature: GYAE6OF01BZ4BB.49.53.E09.1.454.CMB.1.raw
  modified_base (173)..(174): a, c, t, g, unknown or other
  misc_feature (173)..(174): n is a, c, g, or t

SEQ ID NO: 20767 - DNA, 207 bp, Homo sapiens
  misc_feature: GYAE6OF01CWRDS.49.53.E09.1.454.CMB.1.raw
  modified_base (177)..(207): a, c, t, g, unknown or other
  misc_feature (177)..(207): n is a, c, g, or t
tcagagtcgagagacacgaccggtgctcgatttagagagagtgtgttggggtttgggggaagagggaagactggacggtcccccaggagttcaggtgctggcacagcggccctgggcctgcctggtcaacggactacttcctctctcgactctgagcgggctggcaaggcgcatagnnnnnnnnnnnnnnnnnnnnnnnnnnnnnnn

SEQ ID NO: 20768 - DNA, 176 bp, Homo sapiens
  misc_feature: GYAE6OF01D3OW8.49.53.E09.1.454.CMB.1.raw
  modified_base (174)..(176): a, c, t, g, unknown or other
  misc_feature (174)..(176): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcgcatagnnn

SEQ ID NO: 20769 - DNA, 176 bp, Homo sapiens
  misc_feature: GYAE6OF01C064F.49.53.E09.1.454.CMB.1.raw
  modified_base (173)..(176): a, c, t, g, unknown or other
  misc_feature (173)..(176): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnnn

SEQ ID NO: 20770 - DNA, 585 bp, Homo sapiens
  misc_feature: GYAE6OF01CCOIM.49.53.E09.1.454.CMB.1.raw
  modified_base (224)..(224): a, c, t, g, unknown or other
  misc_feature (224)..(224): n is a, c, g, or t
  modified_base (416)..(416): a, c, t, g, unknown or other
  misc_feature (416)..(416): n is a, c, g, or t
  modified_base (563)..(563): a, c, t, g, unknown or other
  misc_feature (563)..(563): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctgaggacagacggccagtatcacctgctcgtgganatgcattgaccaaaagcaatatgcttactggtaccagcagaacgccaggccacggcccctgtcttgatctatttaataaagtctttggagacgggcctacgacgggacccctgagcgtattctctggccttcagctcacgtccgaacaagtacgtcacgttcgaacctatcgagtgggaacggtcccggganaaggacgggacgaggctagtactaattactgtacacgtcaagtacaaggaaccgtaggtagtcggacctacgtttccgtaggttcgttacgttcgggtacgggaacgggtaaccaaggtccgtacggtacccgtccgtacggtaccngtaacccgaggtccgtccccgg

SEQ ID NO: 20771 - DNA, 174 bp, Homo sapiens; identical to SEQ ID NO: 20265
  misc_feature: GYAE6OF01ALRL1.49.53.E09.1.454.CMB.1.raw
  modified_base (173)..(174): a, c, t, g, unknown or other
  misc_feature (173)..(174): n is a, c, g, or t

SEQ ID NO: 20772 - DNA, 173 bp, Homo sapiens; identical to SEQ ID NO: 20229
  misc_feature: GYAE6OF01BQNWC.49.53.E09.1.454.CMB.1.raw
  modified_base (173)..(173): a, c, t, g, unknown or other
  misc_feature (173)..(173): n is a, c, g, or t

SEQ ID NO: 20773 - DNA, 175 bp, Homo sapiens; identical to SEQ ID NO: 20418
  misc_feature: GYAE6OF01A4L35.49.53.E09.1.454.CMB.1.raw
  modified_base (173)..(175): a, c, t, g, unknown or other
  misc_feature (173)..(175): n is a, c, g, or t

SEQ ID NO: 20774 - DNA, 174 bp, Homo sapiens; identical to SEQ ID NO: 20265
  misc_feature: GYAE6OF01D1VTY.49.53.E09.1.454.CMB.1.raw
  modified_base (173)..(174): a, c, t, g, unknown or other
  misc_feature (173)..(174): n is a, c, g, or t

SEQ ID NO: 20775 - DNA, 180 bp, Homo sapiens
  misc_feature: GYAE6OF01DLEO3.49.53.E09.1.454.CMB.1.raw
  modified_base (174)..(180): a, c, t, g, unknown or other
  misc_feature (174)..(180): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagtcgggctggcaaggcgcatagnnnnnnn

SEQ ID NO: 20776 - DNA, 173 bp, Homo sapiens; identical to SEQ ID NO: 20229
  misc_feature: GYAE6OF01D3F3X.49.53.E09.1.454.CMB.1.raw
  modified_base (173)..(173): a, c, t, g, unknown or other
  misc_feature (173)..(173): n is a, c, g, or t

SEQ ID NO: 20777 - DNA, 648 bp, Homo sapiens
  misc_feature: GYAE6OF01CYJB8.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgaggcctcctatgagctgacacagcccaccctcggtgtctgtgtcctcaggacagacggccagtatcacctgctctggagatgctattcgaccaaagcaatatgcttactggtaccagcaagaagccaggccacggcccctgtctgatctaatttaataaaagtacgttttaggaggtacgggtcctacggaacgggaccccgtggacgcgtatttcctctggcctccgaagcctacgacgaccgaacaaacgtacgtaccgtacgttacgaacctaacgtcgtaagggtacgggaacgggtaccccgggacgaagggaacgggtacggacgggtctaggtaacttaagtttactcgtacgtagttcaatacgaagtaacgtagtaggtcgtacttacgttcgtacgttcggtacgttcgggacgggtaacggtaaccgaaggtccgtacggtacccgttacgttacggttaccgaccggtacccgaacggtccgtacccccggg

SEQ ID NO: 20778 - DNA, 173 bp, Homo sapiens
  misc_feature: GYAE6OF01D8A5L.49.53.E09.1.454.CMB.1.raw
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcgcatag

SEQ ID NO: 20779 - DNA, 499 bp, Homo sapiens
  misc_feature: GYAE6OF01AQLXS.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcattttataaagacttttgagagggcctcgacgggacccctggagcgattctctggctccagctcagcgacaacagtcacgttgaccatcagtggagtccgggcaggaggacggaggctgactattactgtcagtcatcagactagtagtggcacttctgtcgtatcggcgggaggaccaaggctgaccgtctaggcagcccaaggcctccgg

SEQ ID NO: 20780 - DNA, 526 bp, Homo sapiens
  misc_feature: GYAE6OF01BKOVF.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccacggcccctgtcttgatctatttaataaagtactttgagagggcctacgacgggacccctgagcgattctctggcctccagctcgagcgaacaacagtcacgttcgacctatcaggtggacggtccgggagaggaggacgaggctagactattactgtcagtcatcagacagtagtgctacttcgtgtcgttagtcgggacggacgggacaaggctacgacccgttcgtacggtacacgcccgaaggcctccccgg

SEQ ID NO: 20781 - DNA, 174 bp, Homo sapiens; identical to SEQ ID NO: 20265
  misc_feature: GYAE6OF01B556Y.49.53.E09.1.454.CMB.1.raw
  modified_base (173)..(174): a, c, t, g, unknown or other
  misc_feature (173)..(174): n is a, c, g, or t

SEQ ID NO: 20782 - DNA, 191 bp, Homo sapiens
  misc_feature: GYAE6OF01B3QRY.49.53.E09.1.454.CMB.1.raw
  modified_base (172)..(191): a, c, t, g, unknown or other
  misc_feature (172)..(191): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggctacttcctctctcgactctgagcgggctggcaaggcgcatagnnnnnnnnnnnnnnnnnnnn

SEQ ID NO: 20783 - DNA, 521 bp, Homo sapiens
  misc_feature: GYAE6OF01CEZCU.49.53.E09.1.454.CMB.1.raw
  modified_base (396)..(396): a, c, t, g, unknown or other
  misc_feature (396)..(396): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggcccctgtcttgatctatttaataaagtactttgagagggcctcgacgggacccctgagcgtattctcgtggctccagctcagcgaacaacagtcacgttcgacctatcaggtggacgtccggnaggaggacgaggctagactattactgtcagtcatcagactagtagtgactcttctgtcgtagttcgggacggacggaccgagcgtacgtaccgtccgtacggtacacggcccaaggcctacccgg

SEQ ID NO: 20784 - DNA, 174 bp, Homo sapiens; identical to SEQ ID NO: 20265
  misc_feature: GYAE6OF01ANIR9.49.53.E09.1.454.CMB.1.raw
  modified_base (173)..(174): a, c, t, g, unknown or other
  misc_feature (173)..(174): n is a, c, g, or t

SEQ ID NO: 20785 - DNA, 185 bp, Homo sapiens
  misc_feature: GYAE6OF01AQ808.49.53.E09.1.454.CMB.1.raw
  modified_base (172)..(185): a, c, t, g, unknown or other
  misc_feature (172)..(185): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnnnnnnnnnnn

SEQ ID NO: 20786 - DNA, 173 bp, Homo sapiens; identical to SEQ ID NO: 20229
  misc_feature: GYAE6OF01DIV79.49.53.E09.1.454.CMB.1.raw
  modified_base (173)..(173): a, c, t, g, unknown or other
  misc_feature (173)..(173): n is a, c, g, or t

SEQ ID NO: 20787 - DNA, 174 bp, Homo sapiens; identical to SEQ ID NO: 20265
  misc_feature: GYAE6OF01CIIIA.49.53.E09.1.454.CMB.1.raw
  modified_base (173)..(174): a, c, t, g, unknown or other
  misc_feature (173)..(174): n is a, c, g, or t

SEQ ID NO: 20788 - DNA, 495 bp, Homo sapiens
  misc_feature: GYAE6OF01BD4F1.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagtactttgagagggcctcgacgggacccctgacgcgattctctggctcagctcagcgacaacagtcacgttgaccatcagtggacgtccgggcaggagggacgaggctgactattactgtcagtcatcagactagtagtggctacttctgtcgtagtcgggcggagggacagctcgaccgtctagcagccagcgtcccg

SEQ ID NO: 20789 - DNA, 735 bp, Homo sapiens
  misc_feature: GYAE6OF01BJ092.49.53.E09.1.454.CMB.1.raw
  modified_base (256)..(256): a, c, t, g, unknown or other
  misc_feature (256)..(256): n is a, c, g, or t
tcagagtcgagagacacgaccggtgctcgatttagagagagtgtggttgggtttgggggtgggtccaggaggcagaactctgggtgtctcaccatggcctggatccctctacttcctcccctcctcactctctgcacgaggctctgaggccctcctatgagctgacacagtccacccttcggtgtctggtcgtccctgaggacaggaccggccaggtactccacgtgctcgtggcatgactattcgaaccaaaaanagtatgccttaacgtcggtaaccagcgaaggacggaccacggccacggccccttggtcgttggtagtactttaataaagtactttagaagtacggtaccctacgtaacgggtacccctaggacgtacgtacttccgtacgtcggtacttaccgacgtctacggaacgggaactaacgtacgtacctaccgttacggacctaagttaccgtagttacgggaacggttacccggacgaacgggtaacggaaccggtagggtccgttaagtaaccgtttacggttaacgttcggtaccgacggttaccgtacgtaacgactacggacgtacggtacggtacttaacggttacgtacggtttacgaacgggtttacgggcgggtaaacgggtaacccgttacggcgttaccgggtaaccgtaccgttcggtaacccaccggtacccgtaaggtcccgtaccggtcccccgttcgggttaaccc

SEQ ID NO: 20790 - DNA, 174 bp, Homo sapiens; identical to SEQ ID NO: 20265
  misc_feature: GYAE6OF01ERWX3.49.53.E09.1.454.CMB.1.raw
  modified_base (173)..(174): a, c, t, g, unknown or other
  misc_feature (173)..(174): n is a, c, g, or t

SEQ ID NO: 20791 - DNA, 177 bp, Homo sapiens; identical to SEQ ID NO: 20482
  misc_feature: GYAE6OF01AFEQG.49.53.E09.1.454.CMB.1.raw
  modified_base (173)..(177): a, c, t, g, unknown or other
  misc_feature (173)..(177): n is a, c, g, or t

SEQ ID NO: 20792 - DNA, 187 bp, Homo sapiens
  misc_feature: GYAE6OF01CD6YS.49.53.E09.1.454.CMB.1.raw
  modified_base (175)..(187): a, c, t, g, unknown or other
  misc_feature (175)..(187): n is a, c, g, or t
tcagagtcgagagacacgaccggtgctcgatttagagagagtgtggttgggtttgggggaagaggaagactgaccggtcccccaggagttcaggtgctgggcacagcggccctgggctgcctggtcaaggactacttcctctctcgactctgagcgggctggcaaggcgcatagnnnnnnnnnnnnn

SEQ ID NO: 20793 - DNA, 539 bp, Homo sapiens
  misc_feature: GYAE6OF01DGKT1.49.53.E09.1.454.CMB.1.raw
  modified_base (396)..(396): a, c, t, g, unknown or other
  misc_feature (396)..(396): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaaccagcagaagccaggccacggcccctgtcttgatctatttaataaagactttgagagggcctcgacgggacccctgagcgtacttctctggctccagctcagcgaacaacagtcacgttgacctatcagtggagtccggnaggaggacgaggctagactattactgtcagtcaatcagactagtagtgctacttcgtgttacgtacgttcgggacgggaacgggaacctaaggcctacggacccgttaccgtagggtaccacggacccgaggtcctaccccgg

SEQ ID NO: 20794 - DNA, 516 bp, Homo sapiens
  misc_feature: GYAE6OF01AUV8Y.49.53.E09.1.454.CMB.1.raw
tcagagtcgagagacacgaccggtgctcgatttagagagagtgtgttgggtttggggtgtgttgggtttgggttgagaacctatgaaaattctgcaggggccactgtcttctccacggtgctcccttcatgcgtgacctggcagctgtagcttctgtgggacttccactgctcaggcgtcaggctcagatagctgctggccgcgtacttgttgttgctttgtttggagggtgtggtggtctccactcccgccttgacgggctgctatctgccttccaggcccctgtcttgatcatttataaagactttgagagggcctcagggacccctgagcgattctctggctccagctcagcgacaacagtcacgttgaccatcagtggacgtccgggcaggaggacgaggctgactattactgtcagtcatcagacagtagtggctacttctgtcgtagttcggcggagggaccaagcgtcgaccgtctaggtcagcccaaggcctacgcccctggtctacc

SEQ ID NO: 20795 - DNA, 173 bp, Homo sapiens; identical to SEQ ID NO: 20229
  misc_feature: GYAE6OF01C488X.49.53.E09.1.454.CMB.1.raw
  modified_base (173)..(173): a, c, t, g, unknown or other
  misc_feature (173)..(173): n is a, c, g, or t

SEQ ID NO: 20796 - DNA, 536 bp, Homo sapiens
  misc_feature: GYAE6OF01DFSFI.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaccagcagaagccaggccacggcccctgtcttgatctatttataaagtacttttgaggagggtcctacgacgggaccccctgacgacgtatttctctggcctccagctcagcgaacaacagtcacgttcgacctatcgagtggacggtccgggcaaggaggacgaggctagactattactgtcagtcattcaagacgtagtagtggactacttcgtgttcgtagttcgggacggaggaccaggtcgtcgtaccgtcgtaggtcagcccgaaggctaccccgg

SEQ ID NO: 20797 - DNA, 597 bp, Homo sapiens
  misc_feature: GYAE6OF01C8C8B.49.53.E09.1.454.CMB.1.raw
tcagagtcgagagacacgaccggtgctcgatttagagagagtgtgttggggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgaccaaagcaatatgtcttactggtaccagcaagaagccgaaggccaggcccctgtccttgatctaatttaataaagtcttttagaggagggtcctacgacggaccctgagcgtattctcgtcggctcagtctacagtcgaacaacgagtactacgttcgaaccctagtcgaaggtggacggtccgggacaaggagggacgaggctaggaacttattaacgtgtactagtcgtaatcgaacggaacgtaggtaggtcggtactaacgtttcgtcgttccggttacgttcgggacggggtaacgggacctaaacggtctacggtaccgttccgtaacggtacacgccccgaaagggcccttaccccggg

SEQ ID NO: 20798 - DNA, 175 bp, Homo sapiens; identical to SEQ ID NO: 20499
  misc_feature: GYAE6OF01B05YR.49.53.E09.1.454.CMB.1.raw
  modified_base (174)..(175): a, c, t, g, unknown or other
  misc_feature (174)..(175): n is a, c, g, or t

SEQ ID NO: 20799 - DNA, 554 bp, Homo sapiens
  misc_feature: GYAE6OF01EGKA0.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaccagcagaagccaggccaggcccctgtcttgatcatttataaagtactttgagagggcctcgacgggacccctgacgcgtattctctggctccagctcagcgacaacagtcacgttcgaccatcagtggacgtccgggcagaggacgaggctagactattactgtacagtcatacagacgtaggttagtcggctacgttcgtagttccgttagttccggggacggtacgggtaccaaggtccgtacggacccgttccgtacgggtacccacggtaccccgaagggtcccgtaccccggg

SEQ ID NO: 20800 - DNA, 173 bp, Homo sapiens; identical to SEQ ID NO: 20229
  misc_feature: GYAE6OF01B2KC7.49.53.E09.1.454.CMB.1.raw
  modified_base (173)..(173): a, c, t, g, unknown or other
  misc_feature (173)..(173): n is a, c, g, or t

SEQ ID NO: 20801 - DNA, 723 bp, Homo sapiens
  misc_feature: GYAE6OF01BOUVY.49.53.E09.1.454.CMB.1.raw
  modified_base (232)..(232): a, c, t, g, unknown or other
  misc_feature (232)..(232): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgacggcctcctatgagctgacacacgcccaccctcggtgtctgtcgtcctcgaggacaggaccggcctagtactcacctgctcgtgganatgactattcgaccaaagcaaatatcgtacttacgtacggtaccagaccgaaggaacgaccgaggacccgaaccgggccccttcggttcctagacttactaaattttaaacgtaaagttacgtttaggaacggtaccgggtacccgttaccgggaaccggggtaacccctggaacggtccggtaactttccgtacgttcgggacccttcccgaggaccctacgacggaccaaacctaaacgtacgtaccgtacgttacgaaccagttcgaggtcgggacggtacccgggacagggaacggtacggacggacgtagtacgttaacttacgtcgtacaacgtcaacgtacgacgtaacgtagtacggtagacgtacgttcgtcggttacggttaccggttacgggacggggtaacgggacgtaacggtccgtaccggacccgtttaacgtaccgggtaccacggaccccgtaacgggtcccgttacccccggg

SEQ ID NO: 20802 - DNA, 183 bp, Homo sapiens
  misc_feature: GYAE6OF01BPK9O.49.53.E09.1.454.CMB.1.raw
  modified_base (173)..(183): a, c, t, g, unknown or other
  misc_feature (173)..(183): n is a, c, g, or t
tcagagtcgagagacacgaccggtgctcgatttagagagagtgtgttggggttgggggaagaggaagactgacggtcccccaggagttcaggtgctgggcacagcggccctgggctgcctggtcaaggactacttcctcgtagcactctgagcgggctggcaaggcgcatagnnnnnnnnnnn

SEQ ID NO: 20803 - DNA, 172 bp, Homo sapiens; identical to SEQ ID NO: 20391
  misc_feature: GYAE6OF01E00MT.49.53.E09.1.454.CMB.1.raw
  modified_base (172)..(172): a, c, t, g, unknown or other
  misc_feature (172)..(172): n is a, c, g, or t

SEQ ID NO: 20804 - DNA, 174 bp, Homo sapiens; identical to SEQ ID NO: 20265
  misc_feature: GYAE6OF01D5LMR.49.53.E09.1.454.CMB.1.raw
  modified_base (173)..(174): a, c, t, g, unknown or other
  misc_feature (173)..(174): n is a, c, g, or t

SEQ ID NO: 20805 - DNA, 173 bp, Homo sapiens; identical to SEQ ID NO: 20229
  misc_feature: GYAE6OF01C7PBK.49.53.E09.1.454.CMB.1.raw
  modified_base (173)..(173): a, c, t, g, unknown or other
  misc_feature (173)..(173): n is a, c, g, or t

SEQ ID NO: 20806 - DNA, 177 bp, Homo sapiens; identical to SEQ ID NO: 20482
  misc_feature: GYAE6OF01AWXLA.49.53.E09.1.454.CMB.1.raw
  modified_base (173)..(177): a, c, t, g, unknown or other
  misc_feature (173)..(177): n is a, c, g, or t

SEQ ID NO: 20807 - DNA, 176 bp, Homo sapiens; identical to SEQ ID NO: 20768
  misc_feature: GYAE6OF01CSWY3.49.53.E09.1.454.CMB.1.raw
  modified_base (174)..(176): a, c, t, g, unknown or other
  misc_feature (174)..(176): n is a, c, g, or t

SEQ ID NO: 20808 - DNA, 174 bp, Homo sapiens; identical to SEQ ID NO: 20265
  misc_feature: GYAE6OF01EP86D.49.53.E09.1.454.CMB.1.raw
  modified_base (173)..(174): a, c, t, g, unknown or other
  misc_feature (173)..(174): n is a, c, g, or t

SEQ ID NO: 20809 - DNA, 174 bp, Homo sapiens; identical to SEQ ID NO: 20544
  misc_feature: GYAE6OF01C24AN.49.53.E09.1.454.CMB.1.raw
  modified_base (174)..(174): a, c, t, g, unknown or other
  misc_feature (174)..(174): n is a, c, g, or t

SEQ ID NO: 20810 - DNA, 561 bp, Homo sapiens
  misc_feature: GYAE6OF01BWB4G.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgaggcctcctatgagctgacacagccaccctcggtgtctgtgtcctcaggacagacggccagtatcacctgctctggagatgcattgaccaaaagcaaatatgcttactggtaccagcagaagccaggccacggcccctgtcttgatcatttataaagtactttgagagggcctcgacgggacccctgacgcgattctcgtggctcagctcagcacaacagtcacgttcgacctataccgaggtggaacggtcccgggagaaggaacgggacggaagggctagaacttagttacctgtactagtcaattccaagacgtagtagtggctacgttcgtgttcgttacgttcgggcgggaacgggtaccaaggtcgacgtaccgtaccgtaggtccgaacgcccgaaaggtcctaccccgg

SEQ ID NO: 20811 - DNA, 607 bp, Homo sapiens
  misc_feature: GYAE6OF01AGZIG.49.53.E09.1.454.CMB.1.raw
  modified_base (385)..(385): a, c, t, g, unknown or other
  misc_feature (385)..(385): n is a, c, g, or t
  modified_base (481)..(481): a, c, t, g, unknown or other
  misc_feature (481)..(481): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccacctcggtgtctgtgtcctcaggacagacggccagtatcacctgctcgtggagatgcattcgaccaaagcaatattcgcttacgtggtaccagcaagaacgccgacggccgacggcccctgttctgatctatttaataaacgtacgtttagaggacggtccgtacgaaccgggtaccccgtaggacgtcgtactttctcgtcggcctccagcctanacgacacgaactacgtactacgttacgaacctatcgagggtggacggtacgggacgaagggacggaacggcgcgttagaccttagttacgtcgtanacgtcatacgagtacgagttagtcgactacttacgtgtacgtaggttccggagggtacggaaccgagtcccgtacgtacccggtacttacggggacaccgggaacccgacgggtcttacccccggg

SEQ ID NO: 20812 - DNA, 175 bp, Homo sapiens; identical to SEQ ID NO: 20418
  misc_feature: GYAE6OF01AP7PC.49.53.E09.1.454.CMB.1.raw
  modified_base (173)..(175): a, c, t, g, unknown or other
  misc_feature (173)..(175): n is a, c, g, or t

SEQ ID NO: 20813 - DNA, 191 bp, Homo sapiens
  misc_feature: GYAE6OF01B1P23.49.53.E09.1.454.CMB.1.raw
  modified_base (173)..(191): a, c, t, g, unknown or other
  misc_feature (173)..(191): n is a, c, g, or t
tcagagtcgagagacacgaccggtgctcgatttagagagagtgtgttgggtttgggggaagaggaaggactgacggtcccccaggagttcaggtgctgggcacagcggccctgggctgcctggtcaaggctacttcctctctcgactctgagcgggctggcaaggcgcatagnnnnnnnnnnnnnnnnnnn

SEQ ID NO: 20814 - DNA, 514 bp, Homo sapiens
  misc_feature: GYAE6OF01A31BY.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggccccctgtcttgatcatttataaagactttgagagggcctcgacgggacccctgagcgattctcgtggctccagctcagcgacaacagtcacgttgaccatcagtggagtcccgggcaggaggacgaggctgactattactgtcagtcatacagacagtagtgcacttcgtgtcgttagttcggcggtacgggaccaggctacgtaccgtcgttacggcacgcccgaaaggccgtacccgg

SEQ ID NO: 20815 - DNA, 173 bp, Homo sapiens; identical to SEQ ID NO: 20229
  misc_feature: GYAE6OF01A1N53.49.53.E09.1.454.CMB.1.raw
  modified_base (173)..(173): a, c, t, g, unknown or other
  misc_feature (173)..(173): n is a, c, g, or t

SEQ ID NO: 20816 - DNA, 174 bp, Homo sapiens; identical to SEQ ID NO: 20265
  misc_feature: GYAE6OF01ES8GP.49.53.E09.1.454.CMB.1.raw
  modified_base (173)..(174): a, c, t, g, unknown or other
  misc_feature (173)..(174): n is a, c, g, or t

SEQ ID NO: 20817 - DNA, 505 bp, Homo sapiens
  misc_feature: GYAE6OF01BIZXG.49.53.E09.1.454.CMB.1.raw
  modified_base (393)..(393): a, c, t, g, unknown or other
  misc_feature (393)..(393): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaccagcagaagccaggccaggcccctgtctgatctatttaataaagtactttgagaggcctcgacgggacccctgagcgattctctcggctccagctcagcgacaacagtctacgttcactatcagtggagtccggganaggaggacgagctgactatactgtcagtcatcagacagtagtgctactctgtcgtagttcgggacggtaggaccaggtctacgaccgtcgtagcacgccgtaagctacccgg

SEQ ID NO: 20818 - DNA, 239 bp, Homo sapiens
  misc_feature: GYAE6OF01CQDXM.49.53.E09.1.454.CMB.1.raw
  modified_base (186)..(239): a, c, t, g, unknown or other
  misc_feature (186)..(239): n is a, c, g, or t
tcagagtcgagagacacgaccggtgctcgatttagagagagtgtggttggggtttgggggggaagaggaagactgacggtccccccaggagttcgaggtgctgggcacagcggcccgtcgggctgcctgtccaagggctacttcctctcgtccgactcgtgacgcggggctggcaaggcgcatagnnnnnnnnnnnnnnnnnnnnnnnnnnnnnnnnnnnnnnnnnnnnnnnnnnnnnn

SEQ ID NO: 20819 - DNA, 173 bp, Homo sapiens; identical to SEQ ID NO: 20229
  misc_feature: GYAE6OF01ERI0Y.49.53.E09.1.454.CMB.1.raw
  modified_base (173)..(173): a, c, t, g, unknown or other
  misc_feature (173)..(173): n is a, c, g, or t

SEQ ID NO: 20820 - DNA, 173 bp, Homo sapiens; identical to SEQ ID NO: 20229
  misc_feature: GYAE6OF01CRPVS.49.53.E09.1.454.CMB.1.raw
  modified_base (173)..(173): a, c, t, g, unknown or other
  misc_feature (173)..(173): n is a, c, g, or t

SEQ ID NO: 20821 - DNA, 568 bp, Homo sapiens
  misc_feature: GYAE6OF01C4EF2.49.53.E09.1.454.CMB.1.raw
  modified_base (223)..(223): a, c, t, g, unknown or other
  misc_feature (223)..(223): n is a, c, g, or t
  modified_base (456)..(456): a, c, t, g, unknown or other
  misc_feature (456)..(456): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgaggcctcctatgagctgacacagcccaccctcggtgtctgtgtcctcaggacagacggccagtatcacctgctctgganatgcagttgaccaaagcaaatatgacttactcggtaccagcagaacgccaggccaggcccctgtactgatctattaataaagtactttgagagggctacgacggtaccctagagcgtacttctcgtcggctaccgagcctacgacgcaacgaaacgtacgtacacgttacgaccaagttccgaggtaggacggtccggacgaaggacggacggaggtcctaggactagttacncgtacagtcaagtcagaactaggtacgtgactacgttcgttgtcgtagttccgggaggtaccggtacaagtcgtacggtacctacgtacgtacacgccgaaggtctccccgg

SEQ ID NO: 20822 - DNA, 650 bp, Homo sapiens
  misc_feature: GYAE6OF01CS2UU.49.53.E09.1.454.CMB.1.raw
  modified_base (222)..(222): a, c, t, g, unknown or other
  misc_feature (222)..(222): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctcgtgganatgcattgaccaaagcaatatgcttactggtaccagacaagaagccaggccacggccctgtctgatctatttaataagtactttgagtacggtcctacgacgggaccctggacgcgtattctcgtaggcctaccgagtcctacgacgtacgaacaacgtagtacctacggttacaacctataccggaggttacgggacggtcccgggagaagggacgggacggacggcgttagtacttacgttacgtcgtactacgtactaacgttacgaacggtacgtagggttacggtcggttaacctacgtttccgttacggttccgtacgggttccgggacggggtaacgggtaacccgaaggtcccgttacggtaccccgttacggtaacgggtacccaaccgggacccgtaacgggtccccgtacccccggg

SEQ ID NO: 20823 - DNA, 173 bp, Homo sapiens; identical to SEQ ID NO: 20337
  misc_feature: GYAE6OF01EM5QZ.49.53.E09.1.454.CMB.1.raw
  modified_base (173)..(173): a, c, t, g, unknown or other
  misc_feature (173)..(173): n is a, c, g, or t

SEQ ID NO: 20824 - DNA, 187 bp, Homo sapiens
  misc_feature: GYAE6OF01CMEAH.49.53.E09.1.454.CMB.1.raw
  modified_base (171)..(171): a, c, t, g, unknown or other
  misc_feature (171)..(171): n is a, c, g, or t
  modified_base (177)..(187): a, c, t, g, unknown or other
  misc_feature (177)..(187): n is a, c, g, or t
tcagagtcgagagacacgaccggtgctcgatttagagagagtgtggttggggtttgggggaagaggaagactggaccggtcccccaggagttcaggtgctgggcacagcggccctgggctgcctggtcaaggactacttcctctctcgactctgagcgggctggcaaggcncatagnnnnnnnnnnn

SEQ ID NO: 20825 - DNA, 173 bp, Homo sapiens; identical to SEQ ID NO: 20229
  misc_feature: GYAE6OF01DVWVN.49.53.E09.1.454.CMB.1.raw
  modified_base (173)..(173): a, c, t, g, unknown or other
  misc_feature (173)..(173): n is a, c, g, or t

SEQ ID NO: 20826 - DNA, 590 bp, Homo sapiens
  misc_feature: GYAE6OF01ESN35.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagcccaccctcggtgtctgtgtcctcaggacagacggccagtatcacctgctcgtggagatgcattgaccaaagcaatatgcttactggtaccagcagaagccaggccacggcccctgtcttgatctatttataagtactttgagaggcctcgacgggacccctgacgcgtattctcgtggcctcacgctcgagcgaacacgacgtacacgttcgaccatcaggtggacggtccggacgaaggacggacggaggcgtagtacttagttacgtgtacgagtcatacgaagacgtaagttaggtcggtactacctttcgtcggttacgttacggttccggggacgggtaacgggtacgaacggtcgtaccggtacccggttaccgtacgggtaccgaaccggccccgaacgggtcccgtacccccggg

SEQ ID NO: 20827 - DNA, 175 bp, Homo sapiens; identical to SEQ ID NO: 20499
  misc_feature: GYAE6OF01AYV38.49.53.E09.1.454.CMB.1.raw
  modified_base (174)..(175): a, c, t, g, unknown or other
  misc_feature (174)..(175): n is a, c, g, or t

SEQ ID NO: 20828 - DNA, 590 bp, Homo sapiens
  misc_feature: GYAE6OF01B9ILP.49.53.E09.1.454.CMB.1.raw
  modified_base (406)..(406): a, c, t, g, unknown or other
  misc_feature (406)..(406): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgaccaaagcaatatgcttactgtaccagcagaagccaggccacggcccctgtcttgatctatttaataaagtactttgagacgggcctcgacgggacccctgagcgtattctactcggcctccagtctcacgcgtaacaacagtcctacgttcgacatcgaggtggacggtccggganagggaacggacggaggcgttagaacttacgttacgtgtcgagtcattacgaagtacgtaggtaaggttcgtactacgttacgtggttacgtacgttccgggacgggacgggtaaccaacggtccggttaccgtaacccggttacctacgggtaccaccggaccccgtaaggccgttacccccgg

SEQ ID NO: 20829 - DNA, 172 bp, Homo sapiens; identical to SEQ ID NO: 20291
  misc_feature: GYAE6OF01D8P65.49.53.E09.1.454.CMB.1.raw

SEQ ID NO: 20830 - DNA, 174 bp, Homo sapiens; identical to SEQ ID NO: 20265
  misc_feature: GYAE6OF01ETDG6.49.53.E09.1.454.CMB.1.raw
  modified_base (173)..(174): a, c, t, g, unknown or other
  misc_feature (173)..(174): n is a, c, g, or t

SEQ ID NO: 20831 - DNA, 173 bp, Homo sapiens; identical to SEQ ID NO: 20229
  misc_feature: GYAE6OF01BXL2O.49.53.E09.1.454.CMB.1.raw
  modified_base (173)..(173): a, c, t, g, unknown or other
  misc_feature (173)..(173): n is a, c, g, or t

SEQ ID NO: 20832 - DNA, 173 bp, Homo sapiens; identical to SEQ ID NO: 20229
  misc_feature: GYAE6OF01A49C7.49.53.E09.1.454.CMB.1.raw
  modified_base (173)..(173): a, c, t, g, unknown or other
  misc_feature (173)..(173): n is a, c, g, or t

SEQ ID NO: 20833 - DNA, 171 bp, Homo sapiens
  misc_feature: GYAE6OF01E37J8.49.53.E09.1.454.CMB.1.raw
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcggctggcaaggcgcatag

SEQ ID NO: 20834 - DNA, 173 bp, Homo sapiens
  misc_feature: GYAE6OF01AD2YN.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaggaagactggcggtcccccaggagttcaggtgctgggcacagcggccctgggctgcctggtcaaggactacttcctctctcgactctgagcgggctggcaaggcgcatagn

SEQ ID NO: 20835 - DNA, 193 bp, Homo sapiens
  misc_feature: GYAE6OF01EG0I8.49.53.E09.1.454.CMB.1.raw
  modified_base (136)..(136): a, c, t, g, unknown or other
  misc_feature (136)..(136): n is a, c, g, or t
  modified_base (140)..(140): a, c, t, g, unknown or other
  misc_feature (140)..(140): n is a, c, g, or t
  modified_base (169)..(193): a, c, t, g, unknown or other
  misc_feature (169)..(193): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaagactactcntctnactctgagcgggctggcaaggcgcatagnnnnnnnnnnnnnnnnnnnnnnnnn

SEQ ID NO: 20836 - DNA, 539 bp, Homo sapiens
  misc_feature: GYAE6OF01CIXDC.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagccaggccaggcccctgtcttgatctatttataaagtactttagagaggcctcgacggaccctgagcgtattctcgtcggctccagtctcagcgaacaacgcgtcacgttgaccatcgaggtggacggtccgggacaaggaggacgagggctgacttattactgtcagtcatcgagactaggtagtgctacgttctggtcgttagttcgggacgggtacgggacaaggcgtacggtacccgttccgtacggaccacggcccgaagggtcctccccgg

SEQ ID NO: 20837 - DNA, 174 bp, Homo sapiens; identical to SEQ ID NO: 20265
  misc_feature: GYAE6OF01B9L75.49.53.E09.1.454.CMB.1.raw
  modified_base (173)..(174): a, c, t, g, unknown or other
  misc_feature (173)..(174): n is a, c, g, or t

SEQ ID NO: 20838 - DNA, 179 bp, Homo sapiens; identical to SEQ ID NO: 20397
  misc_feature: GYAE6OF01CJL9T.49.53.E09.1.454.CMB.1.raw
  modified_base (173)..(179): a, c, t, g, unknown or other
  misc_feature (173)..(179): n is a, c, g, or t

SEQ ID NO: 20839 - DNA, 189 bp, Homo sapiens
  misc_feature: GYAE6OF01EGXGP.49.53.E09.1.454.CMB.1.raw
  modified_base (172)..(189): a, c, t, g, unknown or other
  misc_feature (172)..(189): n is a, c, g, or t
tcagagtcgagagacacgaccggtgctcgatttagagagagtgtgttgggtttgggggaagaggagactgacggtcccccaggagttcaggtgctgggctacagcggcctgggctgcctggtcaaggactacttctctctcgactctgagcgggctggcaaggcgtcatagnnnnnnnnnnnnnnnnnn

SEQ ID NO: 20840 - DNA, 173 bp, Homo sapiens
  misc_feature: GYAE6OF01DJAXF.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggttgggggaagaggaagactgaccggtcccccaggagttcaggtgctgggcacagcggccctgggctgcctggtcaaggactacttcctctctcgactctgagcgggctggcaaggcgcatagn

SEQ ID NO: 20841 - DNA, 172 bp, Homo sapiens; identical to SEQ ID NO: 20291
  misc_feature: GYAE6OF01E222D.49.53.E09.1.454.CMB.1.raw

SEQ ID NO: 20842 - DNA, 569 bp, Homo sapiens
  misc_feature: GYAE6OF01DXK9J.49.53.E09.1.454.CMB.1.raw
  modified_base (189)..(189): a, c, t, g, unknown or other
  misc_feature (189)..(189): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctnaggacagacggccagtatcacctgctctggagatgcattgaccaaagcaatatgcttactggtaccagcaagaacgccacggccacggcccctgtcttgatactaatttaataaagtactttaggaggacggcctacgacggacccctggacgcgtattctcgtcggcctccagctacagacgaacaacgacgtactacgttcgaacctagtcgaggtcggacggtccgggacgaaggagggacgaggctagtacttattactgtcagtcatcgagtactaggtagtcgactcttcgtgtacgttcgtcgggacggaacgggacaacggtcgtacggtacccgtacgtacggtaccagaccccgaaggtcccgtacccgg

SEQ ID NO: 20843 - DNA, 176 bp, Homo sapiens; identical to SEQ ID NO: 20270
  misc_feature: GYAE6OF01D662T.49.53.E09.1.454.CMB.1.raw
  modified_base (173)..(176): a, c, t, g, unknown or other
  misc_feature (173)..(176): n is a, c, g, or t

SEQ ID NO: 20844 - DNA, 173 bp, Homo sapiens; identical to SEQ ID NO: 20229
  misc_feature: GYAE6OF01CRJ3B.49.53.E09.1.454.CMB.1.raw
  modified_base (173)..(173): a, c, t, g, unknown or other
  misc_feature (173)..(173): n is a, c, g, or t

SEQ ID NO: 20845 - DNA, 174 bp, Homo sapiens; identical to SEQ ID NO: 20265
  misc_feature: GYAE6OF01CIUSC.49.53.E09.1.454.CMB.1.raw
  modified_base (173)..(174): a, c, t, g, unknown or other
  misc_feature (173)..(174): n is a, c, g, or t

SEQ ID NO: 20846 - DNA, 615 bp, Homo sapiens
  misc_feature: GYAE6OF01B0BZX.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctcgtggagatgcagttgaccaaaagcaaattatgtcttactggtaaccagcagaacgccgaggccacggcccctgtcttgatctaattttaataaagtactttggagacgggtcctcgacggtacccctgagcgattctcgtggctcagctcacgccgaacaactacgtcacgttcgaccatccgagtggacggtcccgggacaggaacggacggaggctaggtaacttagtttactcgttacctagtactactacgaagtactaaggttaggtcggtacttaccgttacgttcggttaccgttaggttaccgggacggggtacggtaacccgaaaggtccgtacggtaccccggtaccgtacgggtacgaccgaacccgtaacgggtcccgtaccccggg

SEQ ID NO: 20847 - DNA, 553 bp, Homo sapiens
  misc_feature: GYAE6OF01A96IK.49.53.E09.1.454.CMB.1.raw
  modified_base (375)..(375): a, c, t, g, unknown or other
  misc_feature (375)..(375): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagccaggccacggcccctgtcttgatctatttaataagtactttgagacggcctcgacggacccctgacgcgattctctgcctaccagctcgagcgaacaacacgtcacgttnaccatcgaggtggacgtccgggacaggacggacgaggctagtactagttacgtgtacagtcatcgagtacgaggttagtggactacgttcgtgttcgttacggttccgggacgggtacgggaccctaaggtcctacggacccgttcgtacggtcgaacgcccgaaggtccgtccccgg

SEQ ID NO: 20848 - DNA, 632 bp, Homo sapiens
  misc_feature: GYAE6OF01CEU3A.49.53.E09.1.454.CMB.1.raw
  modified_base (307)..(307): a, c, t, g, unknown or other
  misc_feature (307)..(307): n is a, c, g, or t
  modified_base (367)..(367): a, c, t, g, unknown or other
  misc_feature (367)..(367): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggccctcctatgagctgacacagcccaccctcggtgtctgtcgtcctcaggacagacggccagtatccacctgctcgtggagatgctattcgaccaaaagcaatatgcttactggtaccagacagaacgcgaggccaggtcccctgtctgatctatttaanaagtactttgagagggcctacgacgggacccctagacgcgtacttctcgtcggctaccgngtaccgtacgacggaccgaaccaaacgtaacgtccgtaacgttacgaaccctagtaccgaggtgggtaaccggtccgggaacgagggaacggacggacgggtaccgtaggtaaccttagtttaacttggtactaggttacaacttacgaaacgacgtaggttaacgtcggtacctcgtttacgtgttacgtagttcgggacgggtacggacctaacggcgtacgacccgtacgtacggtaccgcgacccggaggtcctaccccgg

SEQ ID NO: 20849 - DNA, 173 bp, Homo sapiens; identical to SEQ ID NO: 20229
  misc_feature: GYAE6OF01D4YNF.49.53.E09.1.454.CMB.1.raw
  modified_base (173)..(173): a, c, t, g, unknown or other
  misc_feature (173)..(173): n is a, c, g, or t

SEQ ID NO: 20850 - DNA, 174 bp, Homo sapiens; identical to SEQ ID NO: 20265
  misc_feature: GYAE6OF01ANIB0.49.53.E09.1.454.CMB.1.raw
  modified_base (173)..(174): a, c, t, g, unknown or other
  misc_feature (173)..(174): n is a, c, g, or t

SEQ ID NO: 20851 - DNA, 206 bp, Homo sapiens
  misc_feature: GYAE6OF01A31IS.49.53.E09.1.454.CMB.1.raw
  modified_base (175)..(206): a, c, t, g, unknown or other
  misc_feature (175)..(206): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctctctcgactctgagcgggctggcaaggcgtcatagnnnnnnnnnnnnnnnnnnnnnnnnnnnnnnnn

SEQ ID NO: 20852 - DNA, 175 bp, Homo sapiens; identical to SEQ ID NO: 20458
  misc_feature: GYAE6OF01C7B8Z.49.53.E09.1.454.CMB.1.raw
  modified_base (173)..(175): a, c, t, g, unknown or other
  misc_feature (173)..(175): n is a, c, g, or t

SEQ ID NO: 20853 - DNA, 584 bp, Homo sapiens
  misc_feature: GYAE6OF01BGL5C.49.53.E09.1.454.CMB.1.raw
  modified_base (406)..(406): a, c, t, g, unknown or other
  misc_feature (406)..(406): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggcagtatcacctgctctggagatgcattgaccaaaagcaatatgcttactggtaccagcagaagccaggccacggccctgtcttgattactatttaataaagtacttttagagagggtcctcgacgggacccctagacgcgtattctcgtcggactccagctcagcacaacagtcacgttcaccatccgtagtggacgtccggganaaggaggacgacgggctagacttaattacgtgtctagtcagtacaacggactaggtaacggtcggacttacgttcgttggtaccgttaggttccgggacgggaacgggtacccgaaggtcgtaccggtacccggtaccgtacgggttacccacggtacccgagggtccctaccccggg

SEQ ID NO: 20854 - DNA, 180 bp, Homo sapiens
  misc_feature: GYAE6OF01EI7HG.49.53.E09.1.454.CMB.1.raw
  modified_base (172)..(180): a, c, t, g, unknown or other
  misc_feature (172)..(180): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnnnnnn

SEQ ID NO: 20855 - DNA, 211 bp, Homo sapiens
  misc_feature: GYAE6OF01EKHDS.49.53.E09.1.454.CMB.1.raw
  modified_base (175)..(211): a, c, t, g, unknown or other
  misc_feature (175)..(211): n is a, c, g, or t
tcagagtcgagagacacgaccggtgctcgatttagagagagtgtgttgggtttgggggggaagaggaagactgacggtcccccaggagttcaggtgctgggcacagcgcctgggctgccttggtcaaggactacttccgtctctcgactctgagcgggctggcaaggctcatagnnnnnnnnnnnnnnnnnnnnnnnnnnnnnnnnnnnnn

SEQ ID NO: 20856 - DNA, 529 bp, Homo sapiens
  misc_feature: GYAE6OF01BGHKI.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaacgccaggccacggcccctgtcttgatcatttaataaagtactttgagagggcctcgacgggtacccctgacgcgtattctcgtggcctccgagtcctcacgcgaacaacagtacacgttacgaccatcgagtggacgtccggcaggacggacgaggctagacttattacgtgtcagtcatcagactagtagtgctacttctgtcgtgtcggacggacggacaggtctacgtaccgtacgtacggtcacgacccaggtcctacccgg

SEQ ID NO: 20857 - DNA, 176 bp, Homo sapiens; identical to SEQ ID NO: 20270
  misc_feature: GYAE6OF01D9S6I.49.53.E09.1.454.CMB.1.raw
  modified_base (173)..(176): a, c, t, g, unknown or other
  misc_feature (173)..(176): n is a, c, g, or t

SEQ ID NO: 20858 - DNA, 195 bp, Homo sapiens
  misc_feature: GYAE6OF01B2269.49.53.E09.1.454.CMB.1.raw
  modified_base (175)..(195): a, c, t, g, unknown or other
  misc_feature (175)..(195): n is a, c, g, or t
tcagagtcgagagacacgaccggtgctcgatttagagagagtgtgttgggtttggtggggaagaggaagactgaccggtcccccaggagttcaggtgctgggcacagcggccctgggctgcctggtcaaggctacttcctctctcgactctgagcgggctggcaaggcgcatagnnnnnnnnnnnnnnnnnnnnn

SEQ ID NO: 20859 - DNA, 172 bp, Homo sapiens; identical to SEQ ID NO: 20391
  misc_feature: GYAE6OF01A8VTK.49.53.E09.1.454.CMB.1.raw
  modified_base (172)..(172): a, c, t, g, unknown or other
  misc_feature (172)..(172): n is a, c, g, or t

SEQ ID NO: 20860 - DNA, 174 bp, Homo sapiens; identical to SEQ ID NO: 20265
  misc_feature: GYAE6OF01DJGVD.49.53.E09.1.454.CMB.1.raw
  modified_base (173)..(174): a, c, t, g, unknown or other
  misc_feature (173)..(174): n is a, c, g, or t

SEQ ID NO: 20861 - DNA, 174 bp, Homo sapiens
  misc_feature: GYAE6OF01CZIED.49.53.E09.1.454.CMB.1.raw
tcagagtcgagagacacgaccggtgctcgatttagagagagtgtgttgggtttgtggggaagaggaagactgacggtccccccaggagttcaggtgctgggcacagcggccctgggctgcctggtcaaggactacttcctctctcgactctgagcgggctggcaaggcgcatag

SEQ ID NO: 20862 - DNA, 175 bp, Homo sapiens
  misc_feature: GYAE6OF01DX6ZK.49.53.E09.1.454.CMB.1.raw
  modified_base (173)..(175): a, c, t, g, unknown or other
  misc_feature (173)..(175): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctctcctcgactctgagcgggctggcaaggcgcatagnnn

SEQ ID NO: 20863 - DNA, 648 bp, Homo sapiens
  misc_feature: GYAE6OF01CDHZG.49.53.E09.1.454.CMB.1.raw
  modified_base (417)..(417): a, c, t, g, unknown or other
  misc_feature (417)..(417): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgaccaaagcaatatgcttactggtaccagacagaacgccaggccacggcccctgtcttgatctatttaataaagtactttgagacgggtcctacgacgggaccctgacgcgtacttctctcggctccagtctcacgcgaacaacacgtcacgttacgaacctatacgaggtacgggacgtacccggggngaacggaacgggacggaacgggcgttacggaactttaagttaccgttcgtacgtacgtacaacgttacgaagtaccgtaagttacggtacgggtaccttacgtttccgttacggttacggttacggtttacgggggaccgggtaacggggaaccctaacggtccggtaccggtaacccggttccgtacgggtaccgaaccggtacccggtaaacgggtcccgtacccccgg

SEQ ID NO: 20864 - DNA, 177 bp, Homo sapiens; identical to SEQ ID NO: 20482
  misc_feature: GYAE6OF01CINNY.49.53.E09.1.454.CMB.1.raw
  modified_base (173)..(177): a, c, t, g, unknown or other
  misc_feature (173)..(177): n is a, c, g, or t

SEQ ID NO: 20865 - DNA, 595 bp, Homo sapiens
  misc_feature: GYAE6OF01C5YLM.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctcgtggagatgctattgaccaaaagcaatatgcttactcggtaccagcagaagccacggccacggcccctgtcttgatctatttaataaagtactttagaggacggcctacgacgggacccctgagcgtacttctcgtcggcctccgagcctcgacgcgaacaactacgtacacggttcaacctatcgaggtcgggacggtcccgggagaggaggacgacggctagacttagttacgtcgtactagtctatacgagaacgtaggttaaggtcgtactaccgtttcgtcggttcgttacggttcgggacgggtacgggaccgaaggtccgtaccggtacccgttacggtacgtaccgacggcccgaaggtccctccccggg

SEQ ID NO: 20866 - DNA, 229 bp, Homo sapiens
  misc_feature: GYAE6OF01BDM0T.49.53.E09.1.454.CMB.1.raw
  modified_base (178)..(185): a, c, t, g, unknown or other
  misc_feature (178)..(185): n is a, c, g, or t
  modified_base (188)..(229): a, c, t, g, unknown or other
  misc_feature (188)..(229): n is a, c, g, or t
tcagagtcgagagacacgaccggtgctcgatttagagagagtgtgttgggttggggggggaagaggaagactgacggtccccccaggagttcgaggtgctgggcacagcggccctgggctgcctggtcaaggcctacttcctcgtagcactctggagcgggctggcaaggcgcatagnnnnnnnngcnnnnnnnnnnnnnnnnnnnnnnnnnnnnnnnnnnnnnnnnnn

SEQ ID NO: 20867 - DNA, 174 bp, Homo sapiens; identical to SEQ ID NO: 20630
  misc_feature: GYAE6OF01BPGJ0.49.53.E09.1.454.CMB.1.raw
  modified_base (173)..(174): a, c, t, g, unknown or other
  misc_feature (173)..(174): n is a, c, g, or t

SEQ ID NO: 20868 - DNA, 175 bp, Homo sapiens
  misc_feature: GYAE6OF01DEO55.49.53.E09.1.454.CMB.1.raw
  modified_base (170)..(175): a, c, t, g, unknown or other
  misc_feature (170)..(175): n is a, c, g, or t
tcagagtcgagagacacgaccggtgctcgatttagagagagtgtgttgggtttgggggaagaggaagactgacggtcccccaggagttcaggtgctgggcacagcggcctgggctgcctggtcaaggactactcctgtagcactctgagcgggctggcaaggcgcatagnnnnnn

SEQ ID NO: 20869 - DNA, 182 bp, Homo sapiens; identical to SEQ ID NO: 20300
  misc_feature: GYAE6OF01DOPWS.49.53.E09.1.454.CMB.1.raw
  modified_base (173)..(182): a, c, t, g, unknown or other
  misc_feature (173)..(182): n is a, c, g, or t

SEQ ID NO: 20870 - DNA, 689 bp, Homo sapiens
  misc_feature: GYAE6OF01ER5O3.49.53.E09.1.454.CMB.1.raw
  modified_base (299)..(299): a, c, t, g, unknown or other
  misc_feature (299)..(299): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctggtgtctgtgtcctcaggacaggacggccagtatcacctttctctggagatgctattcgaccaaagcaatatgtcttactggtaccagcagaagccagccacggcccctgtctgatctatttanaaagtactttgagagggcctcgacgggacccctggagtcgattctcgtaggcctccagtctacgacgacgaacaactacgtctaacggtttcgaacctatccgaggtcggggacgttcccggggagaacggacggggaacggaggtccgtaggtaacttagtttaccgtggtactacggtacctaagttaccgaaggtaaccgttaagggttaacggttcggggtacccttacgttttaccggttacgggttaccggttaacggtttccgggggaaccgggtaacgggggtaacccgtaaacgggtccggtaccggtaaccccggttacggtaaccgggttaccgaaccgggaccccgtaaacgggtcccgtcccggtaccccccccggg

SEQ ID NO: 20871 - DNA, 578 bp, Homo sapiens
  misc_feature: GYAE6OF01COPHZ.49.53.E09.1.454.CMB.1.raw
  modified_base (343)..(343): a, c, t, g, unknown or other
  misc_feature (343)..(343): n is a, c, g, or t
  modified_base (383)..(383): a, c, t, g, unknown or other
  misc_feature (383)..(383): n is a, c, g, or t
  modified_base (404)..(404): a, c, t, g, unknown or other
  misc_feature (404)..(404): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccacctcggtgtctgtgtcctcaggacagacggcagtatcacctgctcgtaggagatgcattgaccaaagcaatatgcttactggtaccagacaagaacgccgacggccacggcccctgtccttgatctaatttaataaagacttttggagagggtcctacgagggacccctggacncgtattctctggctcagctcagcgaacacgagtcacgttnactatcgagtgacgtccgganaggaggcgagactacgaactagttactgtactaggttcaattcaagaacgtaggtagttggtactacgttcgtacgttacgtaagtttccgggacgggttaaacgggaccaacggtacctacggtacccgttaccgtaggtacccacggacccgtaagggtccgttaccccggg

SEQ ID NO: 20872 - DNA, 754 bp, Homo sapiens
  misc_feature: GYAE6OF01AG08J.49.53.E09.1.454.CMB.1.raw
  modified_base (222)..(222): a, c, t, g, unknown or other
  misc_feature (222)..(222): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagntgcattgaccaaagcaatatgcttacgtggtaccagcagaacgccaggccacggcccctgtcttgatctatttaataaagtactttgaggtacgggtcctacgacggggtacccctggacgtcgtactttccgtcgtcggcctaccagtcccgttacgaacggacccgaaacctaaaccgtacggttacccgtaaccggtttaaccggaacccttacgtaccgtaaggggttaccggggaccgggttaccccgggggacgaaacggggtaacggggaaaccgggtacgggtaccgttaacgggtaaaccttttaacgtttaccgttacggtacctaacggtttaccaacgttaacgaacggtaacgtaggttacggtacggtcccttaaccgtttcgttacgggtttaccggttacggttaccggggtaccggggtaaacgggtacccgtaaacggtcccgttaaccgggtaccccgttaccggttacgggtacccgaacccgggacccgtaacggtcccgttccccccggg

SEQ ID NO: 20873 - DNA, 177 bp, Homo sapiens
  misc_feature: GYAE6OF01DK98H.49.53.E09.1.454.CMB.1.raw
  modified_base (174)..(177): a, c, t, g, unknown or other
  misc_feature (174)..(177): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcgcatagnnnn

SEQ ID NO: 20874 - DNA, 545 bp, Homo sapiens
  misc_feature: GYAE6OF01C357T.49.53.E09.1.454.CMB.1.raw
  modified_base (222)..(222): a, c, t, g, unknown or other
  misc_feature (222)..(222): n is a, c, g, or t
  modified_base (385)..(385): a, c, t, g, unknown or other
  misc_feature (385)..(385): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctgganatgcattgaccaaaagcaatatgcttaactggtaccagcagaagcagcaggcccctgtctgatcatttaataaagactttgagaggctacgacggacccctgagcgtattctctggctcagctcagcgacaacagtcacgttcgacatcagtggaagtccggnagaaggacgaggctgactattacctgtcgagtcgaatcgaagacgtagtaggtcggctacgttctgtacgtacgttcggccgggtaagggaaccaaggtctaccggacccgttaccgttacgggtaacacggtaaccccgaagggtcccgttaccccggg

SEQ ID NO: 20875 - DNA, 598 bp, Homo sapiens
  misc_feature: GYAE6OF01DGW5R.49.53.E09.1.454.CMB.1.raw
  modified_base (301)..(301): a, c, t, g, unknown or other
  misc_feature (301)..(301): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtcgtcctcaggacagcggccagtatcacctgctctggagatgcattgaccaaaagcaatatgcttactggtaccagcaagaacgccgaggccacggcccctgtcttgatctatttaanaaagtctttggagacgggtcctcggacgggacccctggagtcgatttcctcgtcggccttccgaagtcctacgacggaccgaacaaacgtacgtacctacggttcgaaccctatcgaggtgggacggtcccgggagaagggaacgggacggagggctacgtaactattaccgtgtcaagtcatcagacgtagtagtcggctacttcgttcggttcgttacggtcggggacggtaacgggaacctacggctaccggtacccgtccggtaaggtccaccggacccgaggccgtccccgg

SEQ ID NO: 20876 - DNA, 727 bp, Homo sapiens
  misc_feature: GYAE6OF01BWDV5.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgctattgaccaaaagcaaatatgcttactggtaccagcaagaacgccaggccacggcccctgtcttgatctatttaataaagtacgtttaggagacgggcctacgacgggacccctggacgcgtacttcctcgtcggcctccgacgtcctcgacggaccgaaccaaacgtacgtaccgtaacggttacgaacctacgtacgtaagggtacgggtaccgggtacccggggacgaagggaacggggaaccggtaagggtaccgttaacggtaaccgtttaacgtttaaccgttcggttaccgtaacggttactaacttaccgaacggtaaccgtaagggttaacggtcgggtaccttaaccgtttcgttcgggttacggtttaccggttaccgggggaccggggtaaccggggaacccgaacgggtccgttaccggtaaccccggttaccggttacgggtacccgaacccgggaccccgtaaacggggtccccgttacccccgggg

SEQ ID NO: 20877 - DNA, 186 bp, Homo sapiens; identical to SEQ ID NO: 20381
  misc_feature: GYAE6OF01AC8PC.49.53.E09.1.454.CMB.1.raw
  modified_base (173)..(186): a, c, t, g, unknown or other
  misc_feature (173)..(186): n is a, c, g, or t

SEQ ID NO: 20878 - DNA, 174 bp, Homo sapiens; identical to SEQ ID NO: 20265
  misc_feature: GYAE6OF01DXTLH.49.53.E09.1.454.CMB.1.raw
  modified_base (173)..(174): a, c, t, g, unknown or other
  misc_feature (173)..(174): n is a, c, g, or t

SEQ ID NO: 20879 - DNA, 797 bp, Homo sapiens
  misc_feature: GYAE6OF01EN344.49.53.E09.1.454.CMB.1.raw
tcagagtcgagagacacgaccggtgctcgatttagagagagtgtgttggggtttggggggtgggtccaggtaggcagaactctgggtgtctcaccatggcctggatccctctacttctcccctcctcactctctgcacagactctgaggcctccgtatgagctgacacagccacctcggtgtctggtcgtcctcgaggacagacggccagtatccacctgctctggatatgctattcgacctaaaagcaaatactagtactttacgtggtaaccaggcaagaacgcccacggccacgggccccgtggtctgatctaatttaagtaagtactttggagtacgggtcctacgacgggacccctggacgtacgtacttcctcgtggacctccgagtacctacgacgaccgaaacctaaacgtacgtaccgtaaccgtttacggaacccttaacgtacgtacggtacgggtaccggttacccggggacaacggggtaacgggtaccggacggggtaccgtaacgtaaccgttaaacgtttaccgtacggttaacccgtaggttaccgtaaacgttaccgtaaggacgttaacggttacgggttacggtaccttaaccggttttccggttaacgggttaccgggtttaaacgggtttcccgggggaacgggggtaaaccggggtaaaccgtaaccgggttcccgggttaaacccgggttaccccgggtaaccccggttttacgggaccccgtaaacccgggtaccccgggtaaaaccgggttccccggtaaacccccccggg

SEQ ID NO: 20880 - DNA, 722 bp, Homo sapiens
  misc_feature: GYAE6OF01CL1H1.49.53.E09.1.454.CMB.1.raw
  modified_base (132)..(132): a, c, t, g, unknown or other
  misc_feature (132)..(132): n is a, c, g, or t
  modified_base (187)..(187): a, c, t, g, unknown or other
  misc_feature (187)..(187): n is a, c, g, or t
  modified_base (238)..(238): a, c, t, g, unknown or other
  misc_feature (238)..(238): n is a, c, g, or t
  modified_base (542)..(542): a, c, t, g, unknown or other
  misc_feature (542)..(542): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctcngcacagactctgaggccctctaatggatctagacacgacgccctacccgtgggtntctgtgtcccagaggacaggacggcctagtactccacctgctacgtggganatgcattcgaccaaaagtcaaatgtctcttaactcggtaccaggaccaaggaacgccgaacggccacggcccctggttcctttagattacctaattttaacgtaaagtacttttaggaacggtaacgggtccctacggaaccggtaacccgttggaacggtccggttaattccgtcgttaacgggacccgttccaacggcctttacgaacggggtaccgaaccttaaaaacgcgtccgtaacgtttaccgaacctagtaccgagggttcgggtaacggccgggacaagggacggaaggttccgngtacgtaagttacgttacgtgtaccagttacagacgaagactagggttacgcggtacttaacgttcgttaggttcggtaacgttacgggacgggaaccgggaaaccgtacgtcggtacccggtacccgttcggttaaacggcccggaaacccgaccgtaacgggtccccgtacccccggg

SEQ ID NO: 20881 - DNA, 175 bp, Homo sapiens; identical to SEQ ID NO: 20418
  misc_feature: GYAE6OF01DMV5J.49.53.E09.1.454.CMB.1.raw
  modified_base (173)..(175): a, c, t, g, unknown or other
  misc_feature (173)..(175): n is a, c, g, or t

SEQ ID NO: 20882 - DNA, 176 bp, Homo sapiens; identical to SEQ ID NO: 20270
  misc_feature: GYAE6OF01A300R.49.53.E09.1.454.CMB.1.raw
  modified_base (173)..(176): a, c, t, g, unknown or other
  misc_feature (173)..(176): n is a, c, g, or t

SEQ ID NO: 20883 - DNA, 647 bp, Homo sapiens
  misc_feature: GYAE6OF01BGGKZ.49.53.E09.1.454.CMB.1.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (307)..(307): a, c, t, g, unknown or other
  misc_feature (307)..(307): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacagcccaccctggtgtctgtgtcctcaggacagaccggccagtactccacctgctctgganatgctattcgaccaaagcaaatntgacttactggtaaccagacgagaacgccgacggccgacggtccccttgtctgacttntaattaataaagtactttgaggtacggcctacgacggtacccctggacgtacgtattccgtcgtcggcctaccgacgtccgtcgaacggccgaactaacgacgtaccgtacgttaacaccgtagtcgtacgggtacgggtacgggtcccgggagaagggacgggacgtagggtctaaggtaaccttaagttcgtagtacgtagtacactacgagtacgtcgtagtcgtactacgttgttacggtcgtacggttccgggacgggtaaccggaccgtaagtccgtacgggtaccccttacgggtacgaccgtaacggaccccgtacgggtccctaccccggg

SEQ ID NO: 20884 - DNA, 774 bp, Homo sapiens
  misc_feature: GYAE6OF01EBRRB.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgacggcctcctatgagctgacacacgcccacccgtcggtgtctgtcgtcctcgaggacaggaccggccaagtactccaccgtcgctcgtaggagtatcgctagttcgaaccgaaagactaaatatcgtacttacgtcggtaaccagacgaagaacgaccgacggccgaccggtccccttgttcctagtacttacttaattttaaacgttaaacgttacgtttaggaacggtacgggtacccgtaccggaccgggtacccctaggacgtacgtacttcgtacgtcggcctaccgacggtcctacgaacgaccgaaaccgtaaacgtaccggttaccgtaaccggttacgaaccgttagtacggtaaggggtcgggtaaccgggtaccgggaacgtaagggaacgggaacgggacggtaccgttaacggtaaccgtttaagtttaccgaggttactaacgtacgtaaccgtacgaacggtaacggtaagttaacgggtcggtaacgttaggtttacgtacgggttacgttaacgggttaccggggacggggtaacgttaacggtccggtacgtaccgggttacccgtacgggttacgaccgaccgacccggtacggtccccgtacccccggg

SEQ ID NO: 20885 - DNA, 503 bp, Homo sapiens
  misc_feature: GYAE6OF01A4GMQ.49.53.E09.1.454.CMB.1.raw
  modified_base (345)..(345): a, c, t, g, unknown or other
  misc_feature (345)..(345): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggctcagggacccctgagcgattctctggctccagctnacgcgacaacagtcacgttgaccatcagtggagtcgggcaggaggacgagctgactattactgtcagtcatcagactagtagtggcacttctgtcgttagttcggcggtagggaccaaggtctggaccgttccgtaggtcagcccaaaggctacccgg

SEQ ID NO: 20886 - DNA, 175 bp, Homo sapiens; identical to SEQ ID NO: 20499
  misc_feature: GYAE6OF01C90HG.49.53.E09.1.454.CMB.1.raw
  modified_base (174)..(175): a, c, t, g, unknown or other
  misc_feature (174)..(175): n is a, c, g, or t

SEQ ID NO: 20887 - DNA, 175 bp, Homo sapiens
  misc_feature: GYAE6OF01EBQC1.49.53.E09.1.454.CMB.1.raw
  modified_base (172)..(175): a, c, t, g, unknown or other
  misc_feature (172)..(175): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggctacttcctctctcgactctgagcgggctggcaaggcgcatagnnnn

SEQ ID NO: 20888 - DNA, 177 bp, Homo sapiens; identical to SEQ ID NO: 20482
  misc_feature: GYAE6OF01A07D1.49.53.E09.1.454.CMB.1.raw
  modified_base (173)..(177): a, c, t, g, unknown or other
  misc_feature (173)..(177): n is a, c, g, or t

SEQ ID NO: 20889 - DNA, 175 bp, Homo sapiens; identical to SEQ ID NO: 20418
  misc_feature: GYAE6OF01CLJKT.49.53.E09.1.454.CMB.1.raw
  modified_base (173)..(175): a, c, t, g, unknown or other
  misc_feature (173)..(175): n is a, c, g, or t

SEQ ID NO: 20890 - DNA, 173 bp, Homo sapiens
  misc_feature: GYAE6OF01CEK7B.49.53.E09.1.454.CMB.1.raw
  modified_base (171)..(173): a, c, t, g, unknown or other
  misc_feature (171)..(173): n is a, c, g, or t
tcagagtcgagagacacgaccggtgctcgatttagagagagtgtgttgggtttgggggaagaggaagactgacggtcccccaggagttcaggtgctggcacagcggccctgggctgcctggtcaaggactacttcctctctcgactctgagcggctggcaaggcgcatagnnn

SEQ ID NO: 20891 - DNA, 595 bp, Homo sapiens
  misc_feature: GYAE6OF01C89NT.49.53.E09.1.454.CMB.1.raw
  modified_base (412)..(412): a, c, t, g, unknown or other
  misc_feature (412)..(412): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggcccctgtctgatctatttataaagtactttagagagggtctacgacgggacccctgacgacgtatttcgtctggcctccgagtcctcgacgcgaacaacgtagtcaacgttgaacctatcgagtgggacgtcccggganaaggaaggacgaggcgtagactattactgtcagtcatcaaggtactaggtacgtggactacgttctacggtttcgtacgtttcgggacggggtaacgggacccgtaaacggtccgttaccgggtacccggttccgttaacgggtaccgaccggtaaccccgaaagggtcccgttacccccggg

SEQ ID NO: 20892 - DNA, 174 bp, Homo sapiens; identical to SEQ ID NO: 20265
  misc_feature: GYAE6OF01EDEIR.49.53.E09.1.454.CMB.1.raw
  modified_base (173)..(174): a, c, t, g, unknown or other
  misc_feature (173)..(174): n is a, c, g, or t

SEQ ID NO: 20893 - DNA, 175 bp, Homo sapiens
  misc_feature: GYAE6OF01AVQ7N.49.53.E09.1.454.CMB.1.raw
  modified_base (172)..(175): a, c, t, g, unknown or other
  misc_feature (172)..(175): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgatctgagcgggctggcaaggcgcatagnnnn

SEQ ID NO: 20894 - DNA, 176 bp, Homo sapiens
  misc_feature: GYAE6OF01CS4K5.49.53.E09.1.454.CMB.1.raw
  modified_base (172)..(176): a, c, t, g, unknown or other
  misc_feature (172)..(176): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnn

SEQ ID NO: 20895 - DNA, 531 bp, Homo sapiens
  misc_feature: GYAE6OF01BA8SE.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagccaggccaggcccctgtcttgatcatttataaagtactttgagagggcctcgacgggacccctgagcgtattctctggcctccagctcagcgacaacagtcacgttgacctatcgaggtggacggtcccgggacaggaggacgaggctagactattactgtcagtcatcagactagtagtgacctacttcgtgtcgttagttcgggacgggacgggaccaaggcgtacggacccgttccgtacgggtcacgcccgaaggtcctcccgg

SEQ ID NO: 20896 - DNA, 715 bp, Homo sapiens
  misc_feature: GYAE6OF01D10P2.49.53.E09.1.454.CMB.1.raw
  modified_base (228)..(228): a, c, t, g, unknown or other
  misc_feature (228)..(228): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagcccacccgtcggtgtctgtcgtcctgaggacaggacggccagtatccacctgcttcgtgganatgctattcgaccaaagcaaattatgtacttacgtggtaccagcagaacgccgaggccacggccctgtctgatctattaataagtcttgagtggcctacgacggaccctgagcgtattctcgtcggcctcgacgcctacgacgaccgaacaacgtacgtacctaacgttacgaacctagtacgaacgggttacgggtaccgggtacccggggacggaaacgggtacggggaaccggtaccggggtacttaacggtaaacgttttaacgtttaaccgtcggttaaccgacgttactaacgttaaccgaacggtaacgttaacgggtacggttacgggtaccttacgtttccggttggttaccggttacggttaccgggggaccggggtaacggtaacccggaaggtcccgttacgggaaccccggtttaccggttaacgggtaccccaaccgggtaccccggtaacgggtcccccggttacccccggg

SEQ ID NO: 20897 - DNA, 175 bp, Homo sapiens; identical to SEQ ID NO: 20418
  misc_feature: GYAE6OF01C3MA4.49.53.E09.1.454.CMB.1.raw
  modified_base (173)..(175): a, c, t, g, unknown or other
  misc_feature (173)..(175): n is a, c, g, or t

SEQ ID NO: 20898 - DNA, 173 bp, Homo sapiens; identical to SEQ ID NO: 20295
  misc_feature: GYAE6OF01ANVWK.49.53.E09.1.454.CMB.1.raw
  modified_base (172)..(173): a, c, t, g, unknown or other
  misc_feature (172)..(173): n is a, c, g, or t

SEQ ID NO: 20899 - DNA, 563 bp, Homo sapiens
  misc_feature: GYAE6OF01A8G9A.49.53.E09.1.454.CMB.1.raw
  modified_base (242)..(242): a, c, t, g, unknown or other
  misc_feature (242)..(242): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatntgcttactggtaccagcagaagccaggccaggcccctgtctgatctatttaataaagtacttgagacggcgtcacgggaccctgagcgtattctctgctccagctcacgcgaacaacacgtcacgttagaccatcaggtgacgtccggcaggacggagaggctagacttattactgtcagtacatacgagactaggtagtcgtactacgttacttggtacgttacggtccggtacgggggaacggaccctaaacgggcttacccgggacccgttcccggttaaggacccgaacgccccgaaagggtccccgttaccccggg

SEQ ID NO: 20900 - DNA, 174 bp, Homo sapiens; identical to SEQ ID NO: 20265
  misc_feature: GYAE6OF01B36ZZ.49.53.E09.1.454.CMB.1.raw
  modified_base (173)..(174): a, c, t, g, unknown or other
  misc_feature (173)..(174): n is a, c, g, or t

SEQ ID NO: 20901 - DNA, 174 bp, Homo sapiens; identical to SEQ ID NO: 20265
  misc_feature: GYAE6OF01D0JSV.49.53.E09.1.454.CMB.1.raw
  modified_base (173)..(174): a, c, t, g, unknown or other
  misc_feature (173)..(174): n is a, c, g, or t

SEQ ID NO: 20902 - DNA, 823 bp, Homo sapiens
  misc_feature: GYAE6OF01AN31A.49.53.E09.1.454.CMB.1.raw
  modified_base (249)..(249): a, c, t, g, unknown or other
  misc_feature (249)..(249): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacagccaccctggtgtctgtgtcctcaggacagacggccagtatcacctgctcgtggagatgctattcgacctaaaagctaaatntgtcttacgtcggtaccagcagaacgccgacggcccgaggtcccctgtcttgatctaattttaataaacgtacgtttggaggtagggtctacgacgggtacccctgacgtcgtacttctcgtcggcctccgagtcctacgacgaccgaacctaaacgacggttacccgtaaccggtttacgaaacccctacgttaccgtaacggggttacggggtaacccggggttacccgggggaaccgaacggggtaaaccgggggaaacccggggtaacggggtacccggtttaacgggtaaacccgttttaacgttttacccggttacggttaccgtaaccggttaccgtaacgttaacccggtaacgggtaaaccggtaaggggttaacggttacgggtacccgttaccgttttacccggttaggtttccgggtttaaaccggtttccgggggacccgggggtaaacggggtaaccccgtaaacggcccgttaaacccggggttaccccgttaaccgggttaccgggttacccgaacccgggtaccccggtaaaccgggtccccggttacccccccggg

SEQ ID NO: 20903 - DNA, 175 bp, Homo sapiens; identical to SEQ ID NO: 20418
  misc_feature: GYAE6OF01CUJV3.49.53.E09.1.454.CMB.1.raw
  modified_base (173)..(175): a, c, t, g, unknown or other
  misc_feature (173)..(175): n is a, c, g, or t

SEQ ID NO: 20904 - DNA, 176 bp, Homo sapiens; identical to SEQ ID NO: 20270
  misc_feature: GYAE6OF01BL0L5.49.53.E09.1.454.CMB.1.raw
  modified_base (173)..(176): a, c, t, g, unknown or other
  misc_feature (173)..(176): n is a, c, g, or t

SEQ ID NO: 20905 - DNA, 519 bp, Homo sapiens
  misc_feature: GYAE6OF01EHC1J.49.53.E09.1.454.CMB.1.raw
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggcccctgtcttgatctatttataaagtactttgagagggcctcgacgggacccctgacgcgtatctctggctcagctcagcgacaacagtcacgttgaccatcagtggagtccggcaagnggacgngctgactattacngtcagtcatcagacagttagtggactacgttgtcgtcgttacgttcgggcgggtaacggaccaagcgtacggaccgtccgtaggtacacggacccgaaggctccccgg

SEQ ID NO: 20906 - DNA, 180 bp, Homo sapiens
  misc_feature: GYAE6OF01C07F2.49.53.E09.1.454.CMB.1.raw
  modified_base (171)..(180): a, c, t, g, unknown or other
  misc_feature (171)..(180): n is a, c, g, or t
tcagagtcgagagacacgaccggtgctcgatttagagagagtgtgtgggtttgggggaagaggaagactgacggtcccccaggagttcaggtgctgggcacagcggcctgggctgcctggtcaaggactacttcctctctcgactctgagcgggctggcaaggcgcatagnnnnnnnnnn

SEQ ID NO: 20907 - DNA, 178 bp, Homo sapiens
  misc_feature: GYAE6OF01CRICN.49.53.E09.1.454.CMB.1.raw
  modified_base (175)..(178): a, c, t, g, unknown or other
  misc_feature (175)..(178): n is a, c, g, or t
tcagagtcgagagacacgaccggtgctcgatttagagagagtgtgttgggtttgggggaagaggaagactgacggtcccccaggagttcaggtgctgggcacagcggccctgggctgcctgtcaaggactacttcctctctcgactctgaggcgggctggacaaggcgcaatagnnnn

SEQ ID NO: 20908 - DNA, 556 bp, Homo sapiens
  misc_feature: GYAE6OF01BGDPC.49.53.E09.1.454.CMB.1.raw
  modified_base (351)..(351): a, c, t, g, unknown or other
  misc_feature (351)..(351): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgaccaaaagcaatatgcttactggtaccagcaagaacgccaggccaggcccctgtcttgatctatttaataaagtactttgagagggcctacgacggacccctgacgcgtatctcgtggctcngcctcgacgcgaacaacgagtctacgttcgaccagtacgaggtgacgtcgggacgagaggacgagctagattattctgtctagtcatacgagacgtagtacggtagactacgttctggttacgtacgttcggggacggagggaaccaggtccgttacgacccggttcgtacgggtacacggtaccccgaaggtcccgtaccccgg

SEQ ID NO: 20909 - DNA, 692 bp, Homo sapiens
  misc_feature: GYAE6OF01CHSJZ.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacacgcccaccctcggtgtctgtgtcctcaggacagacggccagtactcacctgctcgtggagatgctattcgaccaaaagcaaatatgtcttacgtcggtaccagacaaggaacgccgacggccacggtcccctgtctgactactaatttaataaagtacgtttaggaggacgggtcctacgacggaccctggacgcgtacttctcgtcggcctaccacgtcctacgacgaccgaaccaaacgtacgtacctaacggttacgaacctagtaccgtagggtacgggtaaccgggtccggggacgaacgggacgggacggacgggcgttagtaactttacgttaccgttcgtacgtacgtcaacgttacgaagtaaccgtaggttaacgtcggtacttacgtttcgtacggttacggtaggttaccgggggacggggtaaccgggtaacccgtaacggtccgtaaccgggtacccgttaccggtaacgggtcccaaccgggaccccgtaacgggtcccgtccccccggg

SEQ ID NO: 20910 - DNA, 175 bp, Homo sapiens
  misc_feature: GYAE6OF01D0BEJ.49.53.E09.1.454.CMB.1.raw
  modified_base (172)..(175): a, c, t, g, unknown or other
  misc_feature (172)..(175): n is a, c, g, or t
tcagagtcgagagacacgaccggtgctcgatttagagagagtgtgttgggttgggggaagaggaagactgaccggtcccccaggagttcaggtgctgggcacagcggcctgggctgcctggtcaaggactacttccagtactctatctgagcgggctggcaaggcgcatagnnnn

SEQ ID NO: 20911 - DNA, 589 bp, Homo sapiens
  misc_feature: GYAE6OF01BZPD3.49.53.E09.1.454.CMB.1.raw
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctggaggcctcctatgagctgacacacgccaccctcggtgtctgtcgtcctcgaggacaggacggccagtactcacctgctcgtgganatgctattcgaccaaagctaaatatgacttacgtggtaccagacaagaacgccaggccaggcccctgtcttgntactatttaataaagtactttggagacggcctcgacgggacccctgacgcgtacttctcgtcggcctccgacgctcgagcgaacaactagtcacgttcgaccatcaggtcggacgtccggganaggaggacgaggctagactattcngtacagtcatcagtataggtagtcggacttaccgttcgtacggttcgtagttccgggacgggtagggtaaccacggccgttacggtaaccccggttccgtaagggtcctaaccggaccccggtaaggcccgttaccccggg

SEQ ID NO: 20912 - DNA, 174 bp, Homo sapiens
  misc_feature: GYAE6OF01EZ1IV.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctcgtagcactctgagcgggctggcaaggcgcatagn

SEQ ID NO: 20913 - DNA, 176 bp, Homo sapiens; identical to SEQ ID NO: 20270
  misc_feature: GYAE6OF01C1KJX.49.53.E09.1.454.CMB.1.raw
  modified_base (173)..(176): a, c, t, g, unknown or other
  misc_feature (173)..(176): n is a, c, g, or t

SEQ ID NO: 20914 - DNA, 190 bp, Homo sapiens
  misc_feature: GYAE6OF01CT7GN.49.53.E09.1.454.CMB.1.raw
  modified_base (157)..(157): a, c, t, g, unknown or other
  misc_feature (157)..(157): n is a, c, g, or t
  modified_base (167)..(167): a, c, t, g, unknown or other
  misc_feature (167)..(167): n is a, c, g, or t
  modified_base (184)..(190): a, c, t, g, unknown or other
  misc_feature (184)..(190): n is a, c, g, or t
tcagagtcgagagacacgaccggtgctcgatttagagagagtgtgttggggttgggggaagaggaagactgaccggtcccccaggagttcaggtgcgtgggcacgagccggccctgggctgcctggtacaaaggtactacttcctcctctcgactcngaggcgggcnggacaaggcacaatagnnnnnnn

SEQ ID NO: 20915 - DNA, 174 bp, Homo sapiens; identical to SEQ ID NO: 20265
  misc_feature: GYAE6OF01BA09I.49.53.E09.1.454.CMB.1.raw
  modified_base (173)..(174): a, c, t, g, unknown or other
  misc_feature (173)..(174): n is a, c, g, or t

SEQ ID NO: 20916 - DNA, 672 bp, Homo sapiens
  misc_feature: GYAE6OF01EE8XJ.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgacggcctcctatgagctgacacagccaccctggtgtctgtgtcctcgaggacagaccggccagtactcacctgcctcgtggagatgcctagttcgaccaaaagcaaattactgtacttactcggtaccagccaagaacgccgaggcccgacggcccccttgtcttagatactaatttaataaagtactttaggagacgggtcctcggacgggtacccctggacgccgtacttcctcgtcggccttccgatcctacgacgacgaacaactacgtcctacgttacgaccattcgaagggtcgggacggtcccgggagaacggagggtacggaggcctaggtaaccttacgttaccgtcggttaccgagttaccattacggaacgtacgtacggtttaaggtcggttacctcgttttacggttccggttacgtttacggttcggggaccggggaaacggtaccgtaaacggtcgtaccggaaccggtttccggtacgtaccgaccggacccggtacggcccttcccccggg

SEQ ID NO: 20917 - DNA, 651 bp, Homo sapiens
  misc_feature: GYAE6OF01BOH9P.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctggtgcctgtgtcctcgagggacagacggccagtatcactgctctggagatgctattcgaccaaagcaattatgtcttacgtggtaccagacaagaagccgacggccgacggcccctgtcttgacttactaactttaagtaaagtacgttttaggaaggtacgggcctacggaacgggacccctggaacgtcgtacgtttctacgtcggtcctaccgacgtctacgacgaccgaacaacgtagtaccgtacgttacgacctagtacgaggtcgggaacggtcggacgaaggacggacggacggcgtagtaacttatacgtgtacgtacgtctatacgtaagacgtaggttacgtcggtacttaccgttgtcggttacgttaggttaccgggacgggtaacgggtaaccgacggtccgtacggtaaccccggttcgtaacgggttccgaacggacccggtaccggtccgttaccccccgg

SEQ ID NO: 20918 - DNA, 571 bp, Homo sapiens
  misc_feature: GYAE6OF01CWKRN.49.53.E09.1.454.CMB.1.raw
  modified_base (188)..(188): a, c, t, g, unknown or other
  misc_feature (188)..(188): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccacctcggtgtctgtgtcctnaggacagacggccagtatcacctgctcgtggagatgcattcgaccaaaagcaaatatcgtacttacgtacggtaccaaggacaagaacgaccgacggccgacggcccctgttactgactactaatttaataaagtactttagagacggctcgacggaccctagacgtcgtatctcgtggctacgagtctacacgacgacaacgacgtacgtacgttacgaccatcgaggtaggacgtcgggagaggacggacgaggtcgtagactacttacgtcgtacagtacatacgagacgtagtaagtgactacttcgtgtacgtcgtacggacggacggacgacgtcgtaccggaccgtacgtacggtacaacggccgaggcctcccgg

SEQ ID NO: 20919 - DNA, 196 bp, Homo sapiens
  misc_feature: GYAE6OF01ECIUY.49.53.E09.1.454.CMB.1.raw
  modified_base (167)..(167): a, c, t, g, unknown or other
  misc_feature (167)..(167): n is a, c, g, or t
  modified_base (173)..(196): a, c, t, g, unknown or other
  misc_feature (173)..(196): n is a, c, g, or t
tcagagtcgagagacacgaccggtgctcgatttagagagagtgtgttggggtttgggggaagaggaagactgacggtcccccaggagttcaggtgctgggcacagcggccctgggctgcctggtcaaggctacttcctctctcgactctgagcgggctggcaaggcncatagnnnnnnnnnnnnnnnnnnnnnnnn

SEQ ID NO: 20920 - DNA, 191 bp, Homo sapiens
  misc_feature: GYAE6OF01E0LSV.49.53.E09.1.454.CMB.1.raw
  modified_base (176)..(191): a, c, t, g, unknown or other
  misc_feature (176)..(191): n is a, c, g, or t
tcagagtcgagagacacgaccggtgctcgatttagagagagtgtgttggggtttgggggaagaggaagactgaccggtccccccaggagttcaggtgctgggcacagcggccctgggctgcctggtcaaggactacttcctcgtagcactctgagcgggctggcaaggcgcatagnnnnnnnnnnnnnnnn

SEQ ID NO: 20921 - DNA, 176 bp, Homo sapiens; identical to SEQ ID NO: 20768
  misc_feature: GYAE6OF01C5D9F.49.53.E09.1.454.CMB.1.raw
  modified_base (174)..(176): a, c, t, g, unknown or other
  misc_feature (174)..(176): n is a, c, g, or t

SEQ ID NO: 20922 - DNA, 738 bp, Homo sapiens
  misc_feature: GYAE6OF01CUYDN.49.53.E09.1.454.CMB.1.raw
  modified_base (324)..(324): a, c, t, g, unknown or other
  misc_feature (324)..(324): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagaccggccagtactccacctgcctcgtggagatgctattcgaccaaaagcaaatatcgtacttacgtcggtaccagacgaagaacgccgacggccgacggtcccctgtcgtttagatctaattttaanaaagtacgtttagaggacggcctacgacgggacccctgacgtcgtactttccgtacgttcggccttaccgacgtcctacgaacggaccgaaacctaaaccgtacgttaccacggtttcaacccgtagtaccgtagggtacgggacgggtcccgggagaacgggacgggacggaggtcgtaggtacttagttacgtagtcaggttacaacgtacgaacgtaacggtaggttaacggtcggacgttacccgtttcggttaccgggtttaccggtttaaacgggttcccggggtaacggggtaaaccggggtaaccctaccgggttacgttaccgggttaaccccgttaacccgggttacgggttaacccggaccggtaacccccgggtaaagggtcccccggtttaaccccccggg

SEQ ID NO: 20923 - DNA, 769 bp, Homo sapiens
  misc_feature: GYAE6OF01D6RDD.49.53.E09.1.454.CMB.1.raw
tcagagtcgagagacacgaccggtgctcgatttagagagagtgtgttgggtttggggtgtgttgggttgggttgagaacctatagaaaattctgcgaggggccactgtcttctccacggtgctcccttcatgcgtgacctggcagctgtagcttctgtggacttccactgctcaggcgtcaggctcgagatagctgctggccgtgtacttgttgttgtcttttggttgggagggtgtggtcggtcctccaccgtcccgtcgttggacggggctgctatctcgtccttccgacggtccctgtcttgacttactatttaataagtactttaggacggcggtcctcggacggacccctggacgtcgtattcctcgtcggccttacgacgtccgtacgacggaccgaaacctaacgtacggttaccgtacggtttacgaacctacgtcgtaagggtcgggtacgggtaccgggagaacgggaacggtaacgggacggtacgttaacggtaaccgttaacgtttaccgtacgtaccgtagtacccgtaataacccggtaggaaccgttaacgggtacggtccgtaccgttacgtttcgttacgggttaccggttacggttaccggggaacgggtaacgggtaacccgtaaacgggtccggttccgggttaaacccgggttacggtaccgggttaccgaaaccccgggtaccccggtaaacgggttcccccgtaaccccgggttccccggtttacccggttcccgtttaaccccg

SEQ ID NO: 20924 - DNA, 174 bp, Homo sapiens; identical to SEQ ID NO: 20265
  misc_feature: GYAE6OF01A4RT1.49.53.E09.1.454.CMB.1.raw
  modified_base (173)..(174): a, c, t, g, unknown or other
  misc_feature (173)..(174): n is a, c, g, or t

SEQ ID NO: 20925 - DNA, 174 bp, Homo sapiens; identical to SEQ ID NO: 20265
  misc_feature: GYAE6OF01EWML3.49.53.E09.1.454.CMB.1.raw
  modified_base (173)..(174): a, c, t, g, unknown or other
  misc_feature (173)..(174): n is a, c, g, or t

SEQ ID NO: 20926 - DNA, 174 bp, Homo sapiens; identical to SEQ ID NO: 20630
  misc_feature: GYAE6OF01DB20P.49.53.E09.1.454.CMB.1.raw
  modified_base (173)..(174): a, c, t, g, unknown or other
  misc_feature (173)..(174): n is a, c, g, or t

SEQ ID NO: 20927 - DNA, 176 bp, Homo sapiens; identical to SEQ ID NO: 20768
  misc_feature: GYAE6OF01C6LJ5.49.53.E09.1.454.CMB.1.raw
  modified_base (174)..(176): a, c, t, g, unknown or other
  misc_feature (174)..(176): n is a, c, g, or t

SEQ ID NO: 20928 - DNA, 175 bp, Homo sapiens; identical to SEQ ID NO: 20418
  misc_feature: GYAE6OF01D8KXF.49.53.E09.1.454.CMB.1.raw
  modified_base (173)..(175): a, c, t, g, unknown or other
  misc_feature (173)..(175): n is a, c, g, or t

SEQ ID NO: 20929 - DNA, 177 bp, Homo sapiens; identical to SEQ ID NO: 20482
  misc_feature: GYAE6OF01D8M92.49.53.E09.1.454.CMB.1.raw
  modified_base (173)..(177): a, c, t, g, unknown or other
  misc_feature (173)..(177): n is a, c, g, or t

SEQ ID NO: 20930 - DNA, 208 bp, Homo sapiens
  misc_feature: GYAE6OF01BRD75.49.53.E09.1.454.CMB.1.raw
  modified_base (178)..(208): a, c, t, g, unknown or other
  misc_feature (178)..(208): n is a, c, g, or t
tcagagtcgagagacacgaccggtgctcgatttagagagagtgtgttgggtttggggggaagaggaagactgacggtcccccaggagttcgaggtgcgtgggccacagcggccctgggctgcctggtcaaggactacttccttctcgactctgacgcgggctggctaaggcgcatagnnnnnnnnnnnnnnnnnnnnnnnnnnnnnnn

SEQ ID NO: 20931 - DNA, 177 bp, Homo sapiens
  misc_feature: GYAE6OF01BCEY7.49.53.E09.1.454.CMB.1.raw
  modified_base (176)..(177): a, c, t, g, unknown or other
  misc_feature (176)..(177): n is a, c, g, or t
tcagagtcgagagacacgaccggtgctcgatttagagagagtgtgttgggtttggggggaagaggaagactgaccggtcccccaggagttcaggtgctgggcacagccggccctgggctgcctggtcaaggactacttcctctctcgactctgagcgggctggcaaggcgcatagnn

SEQ ID NO: 20932 - DNA, 570 bp, Homo sapiens
  misc_feature: GYAE6OF01C3NW5.49.53.E09.1.454.CMB.1.raw
  modified_base (364)..(364): a, c, t, g, unknown or other
  misc_feature (364)..(364): n is a, c, g, or t
  modified_base (415)..(415): a, c, t, g, unknown or other
  misc_feature (415)..(415): n is a, c, g, or t
  modified_base (426)..(426): a, c, t, g, unknown or other
  misc_feature (426)..(426): n is a, c, g, or t
  modified_base (460)..(460): a, c, t, g, unknown or other
  misc_feature (460)..(460): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgtcttacgtggtaccagacaacgaagccacggacacggccccctgtcttgatctatttaactaaagtactttagagaggtcctacgacggtacccctgacgctattctctggcctcagcncacgcgaacaacgagtctacgttcgaacactcaggtggacggtcccggganaggacggacgngggctggactattactgtacagtcaatacaaganaagtagtcgtacctatttcgtgttacgtacgttcgggacgggtaaccggataacggtcgtaccggacccgttacgtaacggtaccacggacccgaaggtccgtaccccgg

SEQ ID NO: 20933 - DNA, 173 bp, Homo sapiens; identical to SEQ ID NO: 20229
  misc_feature: GYAE6OF01ENP21.49.53.E09.1.454.CMB.1.raw
  modified_base (173)..(173): a, c, t, g, unknown or other
  misc_feature (173)..(173): n is a, c, g, or t

SEQ ID NO: 20934 - DNA, 195 bp, Homo sapiens
  misc_feature: GYAE6OF01CTFF0.49.53.E09.1.454.CMB.1.raw
  modified_base (170)..(170): a, c, t, g, unknown or other
  misc_feature (170)..(170): n is a, c, g, or t
  modified_base (176)..(195): a, c, t, g, unknown or other
  misc_feature (176)..(195): n is a, c, g, or t
tcagagtcgagagacacgaccggtgctcgatttagagagagtgtgttgggttgggggaagaggaagactgaccggtcccccaggagttcgaggtgcgtgggcacaggccggcccgtgggctgcctggtcaaggactactctcgtagcactctgagcgggctggcaaggcncatagnnnnnnnnnnnnnnnnnnnn

SEQ ID NO: 20935 - DNA, 693 bp, Homo sapiens
  misc_feature: GYAE6OF01B27TZ.49.53.E09.1.454.CMB.1.raw
  modified_base (221)..(221): a, c, t, g, unknown or other
  misc_feature (221)..(221): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctgganatgctattcgaccaaagcaatatgtacttacgtggtaccagcaagaacgccgaggccacggcccctgtcttgactctaatttaataaagtactttgaggacggtcctacgacgggacccctggacgcgtacttctcgtcggtcctccgagtcctacgacgaccgaaacaaacgtacggttaccgtaacgtttcgaaccctagtaccgtaaggtcgggtacggtacccgggacgaagggaacgggaacggacgggtcgtacgtaacctttacgtttaccgtacggtacgtaacgtcgtaagtccgaaggtaaccgtaggttaacggtcggtaccttacgtttcgttacggttacggttacggttccggggaccgggaacgggtaacccaacggtccggttaaccggtaccccggttaccggttaacgggtaccgaaccggtaccccggtaaacgggtcccgttaccccccggg

SEQ ID NO: 20936 - DNA, 173 bp, Homo sapiens; identical to SEQ ID NO: 20229
  misc_feature: GYAE6OF01EYKEQ.49.53.E09.1.454.CMB.1.raw
  modified_base (173)..(173): a, c, t, g, unknown or other
  misc_feature (173)..(173): n is a, c, g, or t

SEQ ID NO: 20937 - DNA, 178 bp, Homo sapiens; identical to SEQ ID NO: 20465
  misc_feature: GYAE6OF01A7UHK.49.53.E09.1.454.CMB.1.raw
  modified_base (173)..(178): a, c, t, g, unknown or other
  misc_feature (173)..(178): n is a, c, g, or t

SEQ ID NO: 20938 - DNA, 623 bp, Homo sapiens
  misc_feature: GYAE6OF01DD032.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctctatgagctgacacagccaccctcggtgtctgtgtcctcaggacagacggccagtatcacctgctcgtggagatgctattcgaccaaaagcaatatgcttaacgtcggtaccagacaagaacgccaggccacggcccctgtcttgatctatttaataaagtactttaggaggacggtcctacgacggacccctgagcgtacttctcgtacggtcctccgacgctcgacgaccgaacaaacgagtaccacggttcaacctatcgaggtaggacgggtcccgggagaaggacgggacgagggtctagtaacttattacgtgtactagtcaatacaagacgtagtaggtcgtacttacttcgtcggttacggtacggttcgggaccggggtaacgggaacccaaggtcccgtacggtaccccggttacgtaaccgggttacgaaccggacccgaaacgggtcccgttacccccggg

SEQ ID NO: 20939 - DNA, 649 bp, Homo sapiens
  misc_feature: GYAE6OF01EJGSB.49.53.E09.1.454.CMB.1.raw
tcagagtcgagagacacgaccggtgctcgatttagagagagtgtgttgggtttgggggtgggtccaggaggcagaactctgggtgtctcaccatggcctggatcctctacttctcccctcctcactctctgcacagactctgaggcctcctatgagctgacacagccaccctcggtgtctgtgtcctcaggacagacggccagtatcacctgctctggagatgcattcgaccaaagcaatatgtcttacgtcggtaccagacaagaacgccgaggccacggcccctggtcttgatactatttaataagtactttaggagacgggtcctacgacgggacccctggacgcgtacttccgtcgtcggcctccgacgtcctacgacgaccgaacaacgtacgtccgtaacgttacgaacctatacgtaagggtcgggtacggtcccgggagaacggaacgggacggtaggtcgtagtacttagttacgtgtacagtcagtacgaagacgtaaggttcggtacggacttacgttcgtacggttcggttacgttccggggtacgggaacgggtaaccgaacggtccgtaccgggtaaccccggttaccggttacggtaccgaaccgggaccccgtaagggtccccgttccccggg

SEQ ID NO: 20940 - DNA, 172 bp, Homo sapiens
  misc_feature: GYAE6OF01CZIDO.49.53.E09.1.454.CMB.1.raw
  modified_base (171)..(172): a, c, t, g, unknown or other
  misc_feature (171)..(172): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactattcctctctcgctctgagcgggctggcaaggcgcatagnn

SEQ ID NO: 20941 - DNA, 174 bp, Homo sapiens; identical to SEQ ID NO: 20265
  misc_feature: GYAE6OF01AEZ0Z.49.53.E09.1.454.CMB.1.raw
  modified_base (173)..(174): a, c, t, g, unknown or other
  misc_feature (173)..(174): n is a, c, g, or t

SEQ ID NO: 20942 - DNA, 173 bp, Homo sapiens; identical to SEQ ID NO: 20229
  misc_feature: GYAE6OF01DT2TZ.49.53.E09.1.454.CMB.1.raw
  modified_base (173)..(173): a, c, t, g, unknown or other
  misc_feature (173)..(173): n is a, c, g, or t

SEQ ID NO: 20943 - DNA, 174 bp, Homo sapiens; identical to SEQ ID NO: 20912
  misc_feature: GYAE6OF01AZ4RW.49.53.E09.1.454.CMB.1.raw
  modified_base (174)..(174): a, c, t, g, unknown or other
  misc_feature (174)..(174): n is a, c, g, or t

SEQ ID NO: 20944 - DNA, 187 bp, Homo sapiens
  misc_feature: GYAE6OF01AHG5Q.49.53.E09.1.454.CMB.1.raw
  modified_base (174)..(187): a, c, t, g, unknown or other
  misc_feature (174)..(187): n is a, c, g, or t
tcagagtcgagagacacgaccggtgctcgatttagagagagtgtgttgggtttgggggaaggaggaagactgacggtcccccaggagttcaggtgctgggcacagcggccctgggctgcctggtcaaggactacttcctctctcgactctgagcgggctggcaaggcgcatagnnnnnnnnnnnnnn

SEQ ID NO: 20945 - DNA, 736 bp, Homo sapiens
  misc_feature: GYAE6OF01B5KYN.49.53.E09.1.454.CMB.1.raw
  modified_base (250)..(250): a, c, t, g, unknown or other
  misc_feature (250)..(250): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgacggcctcctatgagctgacacagcccacctcggtgtctgtcgtcctcgaggacagacggccagtactcacctgctctggacatgcctattcgaccgaaagcaaatntgtccttacgtggtaccagtcgaagaacgcccgtaaggcccgaacggtccccttgtccgttttcgaacttcttaattttaaacgtaaacggttccgttttaggacgtaacgggtccctacggaaccgggtacccctaggaaccgtcgtacgtttaccgcgttcggtcctaccgtacgtccttagaccgaccgaaactaaacgtcggttacctaacgggtttcaacccgtagttaccgaacgggttcgtaaccggggtacccggagtaaacgggtcgggtaacggaccgttcgttacggtaactttaacgttacggttacgtacgtacgttacgaagtaccgagaaccggttacgtacggttcgtacgttaccgttcgtcggtttacccgacggttccgggaacgggtaccgtaacgttaaccgtcggttaccggtacccgtacggttacggtacccgacgtaccccggaggtccccgttaccccgg

SEQ ID NO: 20946 - DNA, 175 bp, Homo sapiens
  misc_feature: GYAE6OF01B9SG3.49.53.E09.1.454.CMB.1.raw
  modified_base (171)..(175): a, c, t, g, unknown or other
  misc_feature (171)..(175): n is a, c, g, or t
tcagagtcgagagacacgaccggtgctcgatttagagagagtgtgttgggttgggggaagaggaagactgacggtcccccaggagttcaggtgctgggcacagcggccctgggctgcctgtcaaggactacttcctttctcgactctgagcgggctggcaaggcgcatagnnnnn

SEQ ID NO: 20947 - DNA, 686 bp, Homo sapiens
  misc_feature: GYAE6OF01DQPIF.49.53.E09.1.454.CMB.1.raw
  modified_base (238)..(238): a, c, t, g, unknown or other
  misc_feature (238)..(238): n is a, c, g, or t
tcagagtcgagagacacgaccggtgctcgatttagagagagtgtgttgggtttgggggtgggtccaggaggcagaactcgtgggtgtctcaccatggcctggatccctctacttcctccccctcctcactctctgcacagactctgacggcctcctatgagctgaccacacgcccacccgttcggtgtccgtggtcgtcctcgaggacacggacgccagtactccactgctcgtgganatcgctagttcgaaccgaaagctaaattagtcgtactttacgtacggtaccagacgaagacgaccgaccggccgaccggccccttgttccgttagtacttacttaatttaagttaaagtacgtttaggacggtaccggtcctacggaccgggtacccgtggagtccgtacgttctacgtcggcctccgacgctacgacgtacgaaccaacgtacgtacgtacgttacgaccagtacgtagggtacggtacggtaccggacgaaggacgggacgacggtctacgtaattacgttacgtagtcgtacgtacacgtacaggtacgtagtcggtacgtcttacgtcgtcggttagtaccgggttacggggacggaccggtacgtacggtaccgtccgtacccggttaccgtaacggttccaaccgggtcccgtaaggtcccgtacccccggg

SEQ ID NO: 20948 - DNA, 180 bp, Homo sapiens
  misc_feature: GYAE6OF01DMLRW.49.53.E09.1.454.CMB.1.raw
  modified_base (174)..(180): a, c, t, g, unknown or other
  misc_feature (174)..(180): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcgcatagnnnnnnn

SEQ ID NO: 20949 - DNA, 174 bp, Homo sapiens; identical to SEQ ID NO: 20265
  misc_feature: GYAE6OF01E1GO8.49.53.E09.1.454.CMB.1.raw
  modified_base (173)..(174): a, c, t, g, unknown or other
  misc_feature (173)..(174): n is a, c, g, or t

SEQ ID NO: 20950 - DNA, 197 bp, Homo sapiens
  misc_feature: GYAE6OF01CBN9K.49.53.E09.1.454.CMB.1.raw
  modified_base (175)..(197): a, c, t, g, unknown or other
  misc_feature (175)..(197): n is a, c, g, or t
tcagagtcgagagacacgaccggtgctcgatttagagagagtgtgttgggtttgggggaagagggaagactgacggtcccccaggagttcaggtgctgggcacacgcggccctgggctgcctggtcaaggctacttcctctctcgactctgagcgggctggcaaggcgacatagnnnnnnnnnnnnnnnnnnnnnnn

SEQ ID NO: 20951 - DNA, 545 bp, Homo sapiens
  misc_feature: GYAE6OF01D3989.49.53.E09.1.454.CMB.1.raw
  modified_base (190)..(190): a, c, t, g, unknown or other
  misc_feature (190)..(190): n is a, c, g, or t
  modified_base (222)..(222): a, c, t, g, unknown or other
  misc_feature (222)..(222): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggccagtatcacctgctctgganatgcattgccaaaagcaatatgcttactggtaccagcagaagcaggccacggcccctgtctgatctatttataaagtactttgagtaggcctacgacgggacccctgacgcgacttctcgtcggctccaggctcgagcgaacacgagtctacgttgacctatccagtggacggtcgggcaggacggacggaggctgactattacgtgtacgagtacagtcgaacgagtagtagtgctacgttctgtcgttacgtcgggcgggtacggacaggtcgtacgtacccgtaccgtacggtacacggacccgaaggccgtacccccgg

SEQ ID NO: 20952 - DNA, 627 bp, Homo sapiens
  misc_feature: GYAE6OF01BZ2AI.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgctattgaccaaagcaatatgcttactggtaccagcagaagccaggccacggcccctgtcttgatcatttaataaagtactttgagagggcctcgacgggtacccctgacgcgtattctcgtcggctccagctacgagcgaacaacacgtactacggttgaacccgtatacgtaggtacgggacggtcccgggacagggacggacggaggtctagtacttagttactgtactagtcagtacagaactaggttagtcggactacgtttcgtcggttacggttacgttaccggggacgggtaacggggaacccgtaacggtccgttacccgggtaacccggtttacccggttaacggggtccgaaacccggaccccggtaacggggtccccgttaccccccgggg

SEQ ID NO: 20953 - DNA, 230 bp, Homo sapiens
  misc_feature: GYAE6OF01EQ1SK.49.53.E09.1.454.CMB.1.raw
  modified_base (145)..(145): a, c, t, g, unknown or other
  misc_feature (145)..(145): n is a, c, g, or t
  modified_base (174)..(174): a, c, t, g, unknown or other
  misc_feature (174)..(174): n is a, c, g, or t
  modified_base (181)..(182): a, c, t, g, unknown or other
  misc_feature (181)..(182): n is a, c, g, or t
  modified_base (184)..(230): a, c, t, g, unknown or other
  misc_feature (184)..(230): n is a, c, g, or t
tcagagtcgagagacacgaccggtgctcgatttagagagagtgtgttggggtttgggggggaagaggaagactgaccggtcccccaggagttcaggtgcgtgggcacaggccggccctgggctgcctgggtcaaggctacttccncgtagcactctgagcgggctggcaaggcncaatagnntnnnnnnnnnnnnnnnnnnnnnnnnnnnnnnnnnnnnnnnnnnnnnnn

SEQ ID NO: 20954 - DNA, 719 bp, Homo sapiens
  misc_feature: GYAE6OF01DKZ4V.49.53.E09.1.454.CMB.1.raw
  modified_base (134)..(134): a, c, t, g, unknown or other
  misc_feature (134)..(134): n is a, c, g, or t
  modified_base (264)..(264): a, c, t, g, unknown or other
  misc_feature (264)..(264): n is a, c, g, or t
  modified_base (571)..(571): a, c, t, g, unknown or other
  misc_feature (571)..(571): n is a, c, g, or t
  modified_base (644)..(644): a, c, t, g, unknown or other
  misc_feature (644)..(644): n is a, c, g, or t
tcagagtcgagagacacgaccggtgctcgatttagagagagtgtggttgggtttgggggtgggtccaggaggcagaactctgggtgtctcaccatggcctggactccctctacttcctcccctcctcactctcngcacaggctctgacggtcctctagtgagtctgacacagttcctaccgtcggtgtctgcgtcctgaggacaggtacggcgaggatccacgtcgctcgtcgggagtactcgactacgttacgaaccaaaaangttaactcgtaccgtttaacgtacggtaccaggacgacggaccggtccaacggcctacgggtccccttaggttccggttaggttacgtaatttaagtaaacggtcgtttaggaggtaccgccgtacgtacgggtaccctaggacgtactacttcgtcgtaggacctcgacgtcaacggacgaactaactcgtcctacgtacggacacgtacgacgtccgggtacgaccggtacaacggaaacggtacgacgtcgttaagaaccgttcgtttaaccggtacgcgtaaccgtaccgaacgtcggaaacncgtaacggacgttacgggaacctaggtttacgacgttaggttaacggtccgggagtaccggtaactccgggtnttaccgggaccccttgggtaacgtacggaaccccgttgaaccggttccggtaccccgggtccgttcggtaacccg

SEQ ID NO: 20955 - DNA, 732 bp, Homo sapiens
  misc_feature: GYAE6OF01EMEVJ.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtactcacctgctctggagatgctattcgaccaaaagcaaatatgtcttacgtggtaccagcaagacgcaggccacggcccctgtcttgatctaatttaataagtactttgaggtacggcctacgacggaccctggacgtacgtacttcgtcgtcggtcctccgaacgtcctacgaacggaccgaacaaacgtacgttaccgtacggtttacgaacctacgtaccggtagggtacgggacgggtacccgggacgaacgggaacgggaccggagggtaccgttaaggtaacctttaacgttaccgttcggttaccgtaacgtacgtaactaccgtaaggaaccgtaagggttaacggttcgggtaaccttaaccggtttccgttacggttaccggttaccggttaccggggaccggggtaaaccggggtaacccgtaaacggtcccggttaacccgggtaccccggttacccggttaacgggtacccgaaccggaaccccggtaaacggtccccgtaacccccccgggg

SEQ ID NO: 20956 - DNA, 175 bp, Homo sapiens; identical to SEQ ID NO: 20499
  misc_feature: GYAE6OF01DV9RI.49.53.E09.1.454.CMB.1.raw
  modified_base (174)..(175): a, c, t, g, unknown or other
  misc_feature (174)..(175): n is a, c, g, or t

SEQ ID NO: 20957 - DNA, 541 bp, Homo sapiens
  misc_feature: GYAE6OF01C555B.49.53.E09.1.454.CMB.1.raw
  modified_base (321)..(321): a, c, t, g, unknown or other
  misc_feature (321)..(321): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaggatcaccttgtttggagtatacgttacgaaaggaatatggtcattggtaccagcaagaagacaggcacggccctgtcttggtgtatataaagacagtgagaggcctcgaggactccngagcgattctctgctccagctacgagggacaacgagtcagttgacctatcgagtggatccgagcagaagacgagctagactattatgtacaatcagcagacacggtagtactgtcggtgttcggcggacggacagcgtacgaccgtacgtagtcgacggacccaaggtcctaccggcccctcggtcctaaccgttccgttccgttccccgcccttacccg

SEQ ID NO: 20958 - DNA, 803 bp, Homo sapiens
  misc_feature: GYAE6OF01DOZYE.49.53.E09.1.454.CMB.1.raw
  modified_base (222)..(222): a, c, t, g, unknown or other
  misc_feature (222)..(222): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggccctcctatgagctgacacagccaccctggtgtctgtgtcctcaggacagacggccagtatcacctgctctgganatgcattggaccaaagcaatatgcttactggtaccagcaagaagccaggccacggcccctgtcttgatctatttaataaagtctttggagacggcctacgacggacccctgacgcgtactttcctcgttcgggccttacccgagtcctaccgaacgccggtaaaccaaaccgtacgttacccgtaacggtttacgaaccctaacgttaccgtaaacggggttcggggtaaccggggttaccccgggggaacgtaacgggggaaaacggggtaaccccgggaaaggggtcccgttaacgggttaaaccgtttaacgttttaaccgtttcggttaccgtaacgtttaccgaaacgtttccggaaaacggtaaccgttaagggttaacggttacggggtacccttaccgttttacggttaccggtttaccggtttaacgggtttcccgggggaccggggttaaaaccggggaaacccgtaagggttccccggtttaaccgggtaccccgggttacccggttaacggggtaacccgtaaccgggtaacccccggtaaacgggggtccccttaacccccccggggg

SEQ ID NO: 20959 - DNA, 198 bp, Homo sapiens
  misc_feature: GYAE6OF01B2TA1.49.53.E09.1.454.CMB.1.raw
  modified_base (174)..(198): a, c, t, g, unknown or other
  misc_feature (174)..(198): n is a, c, g, or t
tcagagtcgagagacacgaccggtgctcgatttagagagagtgtgttgggtttgggggaagaggaagactgacggtcccccaggagttcaggtgctgggcacagcggccctgggctgcctgggtcaaggactacttcctctctcgactctgagcgggctggcaaggcgcatagnnnnnnnnnnnnnnnnnnnnnnnnn

SEQ ID NO: 20960 - DNA, 174 bp, Homo sapiens
  misc_feature: GYAE6OF01B21SQ.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagn

SEQ ID NO: 20961 - DNA, 559 bp, Homo sapiens
  misc_feature: GYAE6OF01DJS4Y.49.53.E09.1.454.CMB.1.raw
  modified_base (223)..(223): a, c, t, g, unknown or other
  misc_feature (223)..(223): n is a, c, g, or t
  modified_base (403)..(403): a, c, t, g, unknown or other
  misc_feature (403)..(403): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctgganatgcattgaccaaagcaatatgcttactggtaccagcaagaagccaggccaggcccctgtcttgatctatttataaagtactttgagagggtccctacgacgggacccctggacgcgtacttctcgtcggctccagtcctcagcgacaacagtcacgttgaccatcagtggacgtccggnaaggaggacgaggctacgactattactgtcagtcaatcgaagactagtagtggtacctactttcgtaggttcgtaggttccgggacggaacggggtacccaaggtcctacggtacccgtaccgtaggtaccacggacccgtaacggcctaccccgg

SEQ ID NO: 20962 - DNA, 683 bp, Homo sapiens
  misc_feature: GYAE6OF01BFOX6.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattggaccaaaagcaaatatgtacttacgtggtaccagcaagaagccgaaggccaggccccctgtctgatctaatttaataaagtactttgagacggtctacgacggcccctgacgcgtatttcgtcgtcggcctaccgagtccgtacgacggacccgaacaaaccgtacggttacctaaccggttacgaacccgtacgtacgtagggttacggggacgggttacccgggacgaacgggaacgggaaccgggaggtcgttacggtaacctttaacgttacgtcgttaaccaacgttcgaacgacgtaacggaccggtaccgggttaggttaaccgttcggttcggggttaggttccgggacggggtaccgggaaccgtacggtcgttaccggtacccgtcggtaccggtccaaccggtacccgtaacggtccccgtcccggtcccccgtggtaccccg

SEQ ID NO: 20963 - DNA, 175 bp, Homo sapiens; identical to SEQ ID NO: 20418
  misc_feature: GYAE6OF01BU9BN.49.53.E09.1.454.CMB.1.raw
  modified_base (173)..(175): a, c, t, g, unknown or other
  misc_feature (173)..(175): n is a, c, g, or t

SEQ ID NO: 20964 - DNA, 744 bp, Homo sapiens
  misc_feature: GYAE6OF01AZR8G.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctctatgagctgacacagcccacccgtcggtgtctgtcgtcctcgaggacagaccggccagtactccacctgctcgtggagatgctattcgaccaaaagcaattatcgtacttacgtcggtaccagacaagaacgccgagccacggccctgtctagatactaattataagtcttggaggcggtcctacgacggtaccctagacgtcgtattccgtcgtacggcctccgagtcctacgacggaccgaactaaccgtacgttaccgtaacgtttacgaaccctagttaccggtaacgggttcgggtaccgggttaccccggggacgtaaggggaacggggaaccggtagggtaccgttacgtaaaccgtttacgtttaaccggtgtaaccgtagttaccctaagttaccgaaaggtaccgttagggttacggtacggttacctttacgtttcggttacggtttaccggttaacgggttacccgggggaacgggtaaccgggtaacctaacgggttccccgtaccggttaacccccgggttaaccgttacgggacccgtaacccggtaacccggtaccgggtccccgttaccccccggg

SEQ ID NO: 20965 - DNA, 218 bp, Homo sapiens
  misc_feature: GYAE6OF01DE5LY.49.53.E09.1.454.CMB.1.raw
  modified_base (178)..(218): a, c, t, g, unknown or other
  misc_feature (178)..(218): n is a, c, g, or t
tcagagtcgagagacacgaccggtgctcgatttagagagagtgtgttgggtttgggggaagagggaagactgacggtcccccaggtagttcaggtgctgggcacacgcggccctgggctgcctggtcaaggactacttcctctctccgactctgacgcgggctggcaaggcgcatagnnnnnnnnnnnnnnnnnnnnnnnnnnnnnnnnnnnnnnnnn

SEQ ID NO: 20966 - DNA, 696 bp, Homo sapiens
  misc_feature: GYAE6OF01CS63X.49.53.E09.1.454.CMB.1.raw
  modified_base (186)..(186): a, c, t, g, unknown or other
  misc_feature (186)..(186): n is a, c, g, or t
  modified_base (218)..(218): a, c, t, g, unknown or other
  misc_feature (218)..(218): n is a, c, g, or t
  modified_base (567)..(567): a, c, t, g, unknown or other
  misc_feature (567)..(567): n is a, c, g, or t
tcagagtcgagagacacgaccggtgctcgatttagagagagtgtgttgggtttgggggtgggtccaggaggcagaactctgggtgtctcaccatggcctggactccctctacttcctccccctcctcactctctgcacagactctgaggccctcctatgagctagacacacgcccacccgtcggtntctgtcgtcctcaggacagaccggccagtacncacctgctcgtggagtatcgctagttacgaccaaaagctaaattatcgtacttacgtacggtaccagacgaggacggccgacggccgaccggtcccctgtcgttggtagtattaagtaagtacgttggagccggtacctacggaaccgggccctagacgtctacgttccgtcgtacgtccctaccgacgtccgtacgggaacggaacctaacgtacgtaaccctaccgttacgaaccgtcttaacggtaggtcgggaacccggtaccggaaccgaagggtacggtacggtaacggtcgttaacgtaacttacgttacgtacggtccgtaacgtcccgaagtacgaacgngacgtaggtgactagttagtcggtacgttacgggtcgggaccggtaggccgtacggtaccgtaccggtacccggttaccgtaggtacccgaccgaacccggacggtccccggtcccgtccccggtcccg

SEQ ID NO: 20967 - DNA, 177 bp, Homo sapiens
  misc_feature: GYAE6OF01D2P9X.49.53.E09.1.454.CMB.1.raw
  modified_base (172)..(177): a, c, t, g, unknown or other
  misc_feature (172)..(177): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 20968 - DNA, 655 bp, Homo sapiens
  misc_feature: GYAE6OF01EJCTB.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcactgctctggagatgcattgaccaaagcaatatgcttactggtaccagacaagaagccaggccacggcccctgtctgattactaatttaataaagtactttaggagtacggcctacgacgggtacccctgacgtcgtattcctcgtcggtcctccgagtcctcgaacgccgaacaacgtacgtcacgttcgaacctatacgaggtggacggtccgggataaggaggaacgaggtcgtagtaacttagttacgtgtactagtactaatcgaaggaccgtaagggttacgtgggaccttacctttggttacggttaccggttaggtttacccgggggacggggtaaccggggtaacccgaaacgggttccttacccgggtaaccccggtttacccggttaacgggtacccgtaaaccggaccccggtaaacgggtcccgtcccccggg

SEQ ID NO: 20969 - DNA, 173 bp, Homo sapiens
  misc_feature: GYAE6OF01CJHUE.49.53.E09.1.454.CMB.1.raw
  modified_base (172)..(173): a, c, t, g, unknown or other
  misc_feature (172)..(173): n is a, c, g, or t
tcagagtcgagagacacgaccggtgctcgatttagagagagtgtgttgggttgggggaagaggaagactgaccggtcccccaggagttcaggtgctgggcacagcggccctgggctgcctggtcaaggactacttcctctctcgactctgagcggctggcaaggcgcatagnn

SEQ ID NO: 20970 - DNA, 715 bp, Homo sapiens
  misc_feature: GYAE6OF01DOD9A.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacaggacggccagtactcacctgctcgtggagatgcattcgaccaaagcaatatgtacttacgtggtaccagacaagaacgccgacggccgacggccccttgtcttgatctaatttaataaagtacgtttgaggacggtacctacggaccggtaccccgtaggacgacgtacttccgtcgtcggtcctccgaacggtcctccgacggaccgaaccaaacgtacgtccgtaacgttcgaaccttagtacgtaagggtcgggaacgggttcccgggacgaagggtaacgggtaccgacgggtaccgttacgtaaccgttaagtttaacccgttggttactacggttactaacgtacgaacgtaacgtaggttacggttacggtaccgttactttcgtacgggttaccggttacggtttacccggggacgggggtaaccggaaccgaacggttccggtaaccgggtacccgttaccggtaacgggttaccgaccggacccggtaaccgggtcccgtacccccggg

SEQ ID NO: 20971 - DNA, 179 bp, Homo sapiens
  misc_feature: GYAE6OF01A1C1X.49.53.E09.1.454.CMB.1.raw
  modified_base (174)..(179): a, c, t, g, unknown or other
  misc_feature (174)..(179): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcgcatagnnnnnn

SEQ ID NO: 20972 - DNA, 173 bp, Homo sapiens; identical to SEQ ID NO: 20229
  misc_feature: GYAE6OF01AXNUR.49.53.E09.1.454.CMB.1.raw
  modified_base (173)..(173): a, c, t, g, unknown or other
  misc_feature (173)..(173): n is a, c, g, or t

SEQ ID NO: 20973 - DNA, 184 bp, Homo sapiens; identical to SEQ ID NO: 20573
  misc_feature: GYAE6OF01AT4BX.49.53.E09.1.454.CMB.1.raw
  modified_base (173)..(184): a, c, t, g, unknown or other
  misc_feature (173)..(184): n is a, c, g, or t

SEQ ID NO: 20974 - DNA, 648 bp, Homo sapiens
  misc_feature: GYAE6OF01DTMHV.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtcgtcctcgaggacagacggccagtactccacctgctcgtggagtatgctattcggaccaaaagctaaatatgactttacgtggtaaccagacaagaacgcacggccacggcccctgtcttgattctatttaataaagtactttaggacgtaggtcctcgacggacccctgacgcgtattctcgtcggtacctccgagtctaccacgaccgaaccaacgagttaccaacgtttcgaacctagtacgaggtcgggtacggtaccggacgaagggacggacggacggcgtacggtacttaagttacgtgtacagtacaagtacacggacttaaggtacggttcggaccttacgttccgttagtttaccgttacggttccgggacgggtaacgggaaccgtaacgggtctacccgggtaccgtccgttacggtaccgaaccggacccaacgggtcccgtaccccggg

SEQ ID NO: 20975 - DNA, 174 bp, Homo sapiens
  misc_feature: GYAE6OF01CD07J.49.53.E09.1.454.CMB.1.raw
  modified_base (172)..(174): a, c, t, g, unknown or other
  misc_feature (172)..(174): n is a, c, g, or t
tcagagtcgagagacacgaccggtgctcgatttagagagagtgtgttgggtttgggggaagaggaagactgacggtcccccaggagttcaggtgctggcacagcggccctgggctgcctggtcaaggactacttcctctctcgactctgagcgggctggcaaggcgcatagnnn

SEQ ID NO: 20976 - DNA, 175 bp, Homo sapiens; identical to SEQ ID NO: 20418
  misc_feature: GYAE6OF01DKX3M.49.53.E09.1.454.CMB.1.raw
  modified_base (173)..(175): a, c, t, g, unknown or other
  misc_feature (173)..(175): n is a, c, g, or t

SEQ ID NO: 20977 - DNA, 668 bp, Homo sapiens
  misc_feature: GYAE6OF01B587K.49.53.E09.1.454.CMB.1.raw
  modified_base (232)..(232): a, c, t, g, unknown or other
  misc_feature (232)..(232): n is a, c, g, or t
  modified_base (656)..(656): a, c, t, g, unknown or other
  misc_feature (656)..(656): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctggacgcctcctatgagctgacacagccacccgtggtcgtctgtcgtcctcgacggacaggaccggccaagtactcacctgctcgtgganatgactagttcgaccaaaagctaatagtcgtacttacgtcggtaaccaaggacgaagaacgccgacggtccgaaccggtccctgttcttacgtatacttaatttaagtaaaacgtcgtttaggacggtacgggtcctacgaccgggaccctgacgtacgtattctcgtcggtcgtccgaggtcgaacggacgtaacggtcacgtacgtacgacctagtcgaggtggaacgtccgagggacgaaacgggacgggaacgaggtccgtagtaagtttaatttacgtacgtaacaactaacaacgtaacgtaactaccgtagtttaacgtactttacgtacgtttacgtacggtaccgtcgtaaccgaacgtaccggtccgtaccggtccgtcgggacaaccgacccgtaacggaccccaaccgttcncgtacctacccg

SEQ ID NO: 20978 - DNA, 748 bp, Homo sapiens
  misc_feature: GYAE6OF01A2OTE.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacagccaccctcggtgtctgtgtcctcaggacagacggccagtatcacctgctcgtggagatgcattgaccaaagcaatatgacttacgtaggtaccagcagaagccaggccacggcccctgtctgatctaatttaataaagtactttagaggacggcctacgacgggacccctgacgcgtacttctcgtgcctccgagtctcgacgaccgaacaaacgtacgtacctaaccggtttacgaacctacgtacgtaagggtcgggtacgggttacccggggacgaacggggaacgggaaccgggtacgggaccggttaggtaaacccgtttaagtttaccgttacgttaccgtaacggtttacctaacgttaacgaacggtaacgttaacgggttaggttaccgggtaccgttaccgtttcggttacggtttacccggttacgggtttaacccggggaccggggtaaccggggtaaccgaaacccgggttcccgttaaccgggttaacccccggttacccggtttaaccgggttaccgtaaacccgggttaccccggtaaaaccgggttcccggttaccccccggg

SEQ ID NO: 20979 - DNA, 175 bp, Homo sapiens; identical to SEQ ID NO: 20499
  misc_feature: GYAE6OF01BRQJ3.49.53.E09.1.454.CMB.1.raw
  modified_base (174)..(175): a, c, t, g, unknown or other
  misc_feature (174)..(175): n is a, c, g, or t

SEQ ID NO: 20980 - DNA, 177 bp, Homo sapiens
  misc_feature: GYAE6OF01AML6K.49.53.E09.1.454.CMB.1.raw
  modified_base (172)..(177): a, c, t, g, unknown or other
  misc_feature (172)..(177): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactactcctctctcgactctgagcgggctggcaaggcgcatagnnnnnn

SEQ ID NO: 20981 - DNA, 674 bp, Homo sapiens
  misc_feature: GYAE6OF01ESPFK.49.53.E09.1.454.CMB.1.raw
  modified_base (181)..(181): a, c, t, g, unknown or other
  misc_feature (181)..(181): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgacgcctcctatgagctgacacagcccacccgtggtntctgtgtccctgaggacaggaccggaccagtactcaccgtgccttcgtaggagatgacctattcgaccaaaagccaaatgtgtcttacgtggtaccagacaagaacgccgaacggcccgacggtcccccgtgttcttagactttacgtaattttaaagtaaacgtacgtttaggaacggacgggtcccgtacggaaccggtaccccgtggacgtcgtacttcgtcgtcggtacctccgacgcctacgaacgaccgaactaacgtacgtaccgtacggttacgaacctaagtaccggagggttacggaacgggtcccgggaacgaacggggaaccggtaacgggacggtacctaacggtaacttaacgttacgttcgtacgtacgtacacgttaacgaacgtaagtacgtaggtcgtacttacgttgttacgtcgtcgtacgggacggacgacgtagcgtacgccgtacgtagacaccgacgtgccgtaccccg

SEQ ID NO: 20982 - DNA, 177 bp, Homo sapiens; identical to SEQ ID NO: 20873
  misc_feature: GYAE6OF01BUUKS.49.53.E09.1.454.CMB.1.raw
  modified_base (174)..(177): a, c, t, g, unknown or other
  misc_feature (174)..(177): n is a, c, g, or t

SEQ ID NO: 20983 - DNA, 175 bp, Homo sapiens
  misc_feature: GYAE6OF01AW5OL.49.53.E09.1.454.CMB.1.raw
  modified_base (174)..(175): a, c, t, g, unknown or other
  misc_feature (174)..(175): n is a, c, g, or t
tcagagtcgagagacacgaccggtgctcgatttagagagagtgtgttgggtttggggggaagaggaagactgacggtcccccaggagttcaggtgctgggcacagcgccctgggctgcctggtcaaaggactacttcctctctcgactctgagcgggctggcaaggcgcatagnn

SEQ ID NO: 20984 - DNA, 743 bp, Homo sapiens
  misc_feature: GYAE6OF01DJCST.49.53.E09.1.454.CMB.1.raw
  modified_base (230)..(230): a, c, t, g, unknown or other
  misc_feature (230)..(230): n is a, c, g, or t
  modified_base (406)..(406): a, c, t, g, unknown or other
  misc_feature (406)..(406): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgacggcctcctatgagctgacacacgcccacccgtcggtgtctgtgtcctcgaggacagaccgccagtactcacctgctcgtggagntgctattcgaaccaaagctaatagtgtacttacgtcggtaccagacgaagacgaccgacggccacggtccccttgtcgtagatactaatttaagtaaagtacgtttggaacggtacgggtaccctacggaccggtacccgtggacgtacgtactttcgtcgtcggcctccggaacncctacgaacgcgaacaaacgtacgtaaccgtacggtacgaactagtcgaagggtcggacggtaccgggagaggaacgggcgacgtcgttagtaaccttacgtttacgtcgtacgacgtttacgaacttacgaacggtaacgtacggtacgggttccgttaccgttaccgtttcggtttacggtccgggtttaaccggtaccggggggtaccggggtaaaacgggtaccccggtaaaccggttcggttaaccccgggtacccgggttaacccggttaaacccgggttacccggaaaccccggttaaccccgggaacgggttccccggtaccccccggg

SEQ ID NO: 20985 - DNA, 179 bp, Homo sapiens; identical to SEQ ID NO: 20397
  misc_feature: GYAE6OF01APZCI.49.53.E09.1.454.CMB.1.raw
  modified_base (173)..(179): a, c, t, g, unknown or other
  misc_feature (173)..(179): n is a, c, g, or t

SEQ ID NO: 20986 - DNA, 181 bp, Homo sapiens; identical to SEQ ID NO: 20539
  misc_feature: GYAE6OF01AXQ4J.49.53.E09.1.454.CMB.1.raw
  modified_base (173)..(181): a, c, t, g, unknown or other
  misc_feature (173)..(181): n is a, c, g, or t

SEQ ID NO: 20987 - DNA, 728 bp, Homo sapiens
  misc_feature: GYAE6OF01DF4SE.49.53.E09.1.454.CMB.1.raw
  modified_base (299)..(299): a, c, t, g, unknown or other
  misc_feature (299)..(299): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctctatgagctgacacagccaccctcggtgtctgtgtcctcaggacagacggccagtatcacctgctcgtggagatgctattgaccaaaagcaatatgcttactggtaccagcaagaacgccaggccacggcccctgtcttgatctatttanaaagtctttagagaggtcctacgacgggacccctgagctattctcgtggcctacagtctcgagcgaacaacagtcacgttcgacctagtcgaggtggacggtccgggacaaggacggacggaggtcgtacgtaacgttacttacgtacgtacgtacggtctaactacgaacggtaacgtagggttacggttaccggtaccgtttacgtttaccggttaccggtttaacggttaccgggtttaccgggggacccgggggtaaaaccgggtaaaccccggtaacgggtttaccccgggttaaacccggggttaaccccccgggtttaacccggggtttaaaccccggggttaaaccccgtaaaccccgggggttaaacccccccgggtaaaacgggggttttccccccggtttaaccccccccccgggggg

SEQ ID NO: 20988 - DNA, 721 bp, Homo sapiens
  misc_feature: GYAE6OF01DRCO4.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgctattgaccaaagcaatatgtcttactggtaccagcagaagccgaggccacggcccctgtcttgatctatttaataaagtactttggagacgggcctacgacgggtacccctggacgcgtattcctcgtcggcctccgagtcctacgacgacgaacaaacgacgttaccgacggtttacgaacctaacgtacgtaacgggtacgggaacggtccccggggacaacggggaacgggaccgggaacgggtccgttaacggtaacgtttaacgtttaccgttggttacctaacggttaccaacgtttaccgaaggtaaacgtacgggttaacggttcgggtaccgttacgtttacgttacgggtttaccggttaacggttccggggtaccgggggaaacgggtaaccccgaaggtccccggttaccgggtaaccccggtttaccggttaaccgggtaccgaacccgggtaaccccggtaacgggccccgttacccccggg

SEQ ID NO: 20989 - DNA, 175 bp, Homo sapiens
  misc_feature: GYAE6OF01EP52E.49.53.E09.1.454.CMB.1.raw
  modified_base (173)..(175): a, c, t, g, unknown or other
  misc_feature (173)..(175): n is a, c, g, or t
tcagagtcgagagacacgaccggtgctcgatttagagagagtgtgttgggttgggggaagaggaagactgaccggtcccccaggagttcaggtgctgggcacagcggccctgggctgcctggtcaaggactacttcctctctcgactctgagcgggctggcaaggcgcatagnnn

SEQ ID NO: 20990 - DNA, 668 bp, Homo sapiens
  misc_feature: GYAE6OF01AW3WL.49.53.E09.1.454.CMB.1.raw
tcagagtcgagagacacgaccggtgctcgatttagagagagtgtgttgggggtttgggggtggggtccaggaggcagaactcgtgggtgtctcaccatcggcctggatccctcgtacttctcccctcctcacctctcctgcacagactctgagggcctccgtactggagctgacacagccaccctcggtgtcctggtgtcctcgaggacagacggctagtatccacctgctctggacgatgcattgccaaaaccggattatgcttattggtaccagcaagaagccgggccgacggacccctcgtgtcggtgatgtataaagacacgtgagacgggccctcagggagtccccgtgacgcgatttcctctcggctccgaggtcacggggacaacggtaccgaccgagttacggccctatctacggtacgggacggtacgaggacgaaggagggtaccggaggtctacgtattaacgttgttcgtcaattccaaactagaaccacccgtaagtttcggtaactttatacgttacgtttacgggtaaccttcggtaccggtaaccggtaaacgggttcccgaacccggttacccggtcggggttaccggaaccgtaccccggtaaacggggaccctaaaccccccgtaccgttccggttcccgtaaccccgg

SEQ ID NO: 20991 - DNA, 176 bp, Homo sapiens; identical to SEQ ID NO: 20768
  misc_feature: GYAE6OF01ENA3W.49.53.E09.1.454.CMB.1.raw
  modified_base (174)..(176): a, c, t, g, unknown or other
  misc_feature (174)..(176): n is a, c, g, or t

SEQ ID NO: 20992 - DNA, 670 bp, Homo sapiens
  misc_feature: GYAE6OF01DNPNA.49.53.E09.1.454.CMB.1.raw
  modified_base (188)..(188): a, c, t, g, unknown or other
  misc_feature (188)..(188): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgaggcctcctatgagctgacacagccaccgtggtgtctgtgtccncgaggacagacggcaagtatccacctgctcgtggagatcgactattcgaaccaaaagacaaattatcgtacttacgtacggtaccagacgaaggaacgaccgacggccgacggcccttgtctagtactactaattaagtaagtagtttaggaggtacggcctacggaccgggtacctaggacggtacgtacgtttcgcgtacggcctaccgacgtccgtacgacgtaacccgaactaaacggtacgttaccgtacgttacgaacccaggttaccgagggtcgggtacggtcccgggagaagggaacggacggacggtacttaacggtaacttacgttagtcgtaacgtacgctaaacgtcgaagacgtacggtgtctacttacggtcgttggttacgtacgggtacgggagggttaccgactaacggtcgtacccggtaccgtaccggtaacggccaacggtcccgacgccggttaccccgg

SEQ ID NO: 20993 - DNA, 174 bp, Homo sapiens
  misc_feature: GYAE6OF01EKVI4.49.53.E09.1.454.CMB.1.raw
  modified_base (166)..(166): a, c, t, g, unknown or other
  misc_feature (166)..(166): n is a, c, g, or t
  modified_base (171)..(174): a, c, t, g, unknown or other
  misc_feature (171)..(174): n is a, c, g, or t
tcagagtcgagagacacgaccggtgctcgatttagagagagtgtgttgggtttgggggaagaggaagactgacggtcccccaggagttcaggtgctgggcacagcgcctgggctgcctggtcaaggactacttcctctctcgactctgagcgggctggcaaggcgnatagnnnn

SEQ ID NO: 20994 - DNA, 173 bp, Homo sapiens
  misc_feature: GYAE6OF01D5NF3.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggttgggggaagaggaagactgacggtccccccaggagttcaggtgctgggcacagcggccctgggctgcctggtcaaggactacttcctctctcgactctgagcgggctggcaaggcgcatagn

SEQ ID NO: 20995 - DNA, 564 bp, Homo sapiens
  misc_feature: GYAE6OF01EMXXB.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagccaggccacggcccctgtcttgatctatttaataaagtactttgagacgggcctcgacgggacccctgacgcgtattctcgtggtcctccagcctcagaccgaacaaacacgtccacgttcgaaccatccgaggtcgggacggtccgggacgaggagggacgacggctagaacttagttacgtgtactagtacaatacgagagtagtaggttcgactacttcgtgtcgttacgttcggggacgggacgggaccaaggtcgtacgccgtacgttacggccgagccccaggcccgtccccgg

SEQ ID NO: 20996 - DNA, 753 bp, Homo sapiens
  misc_feature: GYAE6OF01AHRZO.49.53.E09.1.454.CMB.1.raw
  modified_base (137)..(137): a, c, t, g, unknown or other
  misc_feature (137)..(137): n is a, c, g, or t
  modified_base (188)..(188): a, c, t, g, unknown or other
  misc_feature (188)..(188): n is a, c, g, or t
  modified_base (495)..(495): a, c, t, g, unknown or other
  misc_feature (495)..(495): n is a, c, g, or t
  modified_base (636)..(636): a, c, t, g, unknown or other
  misc_feature (636)..(636): n is a, c, g, or t
tcagagtcgagagacacgaccggtgctcgatttagagagagtgtgttgggtttgggggtgggtccaggaggcagaactctgggtgtctcaccatggcctggactccctctacttcctccccctctcactctctgcanagactctggacggccctcctatggacgctagacacacgcccacccgtggtntctggtacgtcctacgaggaccaggaccggcctagtactccaccgtgcctcgtggagtagtcgactacgttgaacccgaaagctaattgtcgtccttaacgtcggtaaccacgacgtaacggaaccgccgaacggcccgtaaccgggtcccctttaggttaccgttaggtaacttaccgtttaaagttttaaacggtaaaccggttagttttacggggaacggtacccgggtacctaccgggaaccggggtaccccttagggaccgtcgtaacgttccgtacggtacgtccgtaccgacggttaccncgtaaccgtacgtaaacctaaccggtccggtaaccgttaccgtactacccgtaaggttccgaacgggttcgggaaccgttcgggaagtacggacgggagtaccggtctacgttacttacgtttacgcgttaacgcttacgnttaacggaacgtgtacgttcgagacccttagtcggttgtacggtccgtagggtaccggaacgtacgcgtccggacgtccgttaccgcggtaccgacccggctccggtccgtccccgg

SEQ ID NO: 20997 - DNA, 214 bp, Homo sapiens
  misc_feature: GYAE6OF01CLSWB.49.53.E09.1.454.CMB.1.raw
  modified_base (160)..(160): a, c, t, g, unknown or other
  misc_feature (160)..(160): n is a, c, g, or t
  modified_base (175)..(178): a, c, t, g, unknown or other
  misc_feature (175)..(178): n is a, c, g, or t
  modified_base (180)..(214): a, c, t, g, unknown or other
  misc_feature (180)..(214): n is a, c, g, or t
tcagagtcgagagacacgaccggtgctcgatttagagagagtgtggttggggtttggggggaagaggaagactgacggtccccccaggagttcaggtgctgggcacagcggccctgggctgcctggtcaaggctacttcctctctcgactctgagcgggntggcaggcgcatagnnnngnnnnnnnnnnnnnnnnnnnnnnnnnnnnnnnnnnn

SEQ ID NO: 20998 - DNA, 179 bp, Homo sapiens; identical to SEQ ID NO: 20397
  misc_feature: GYAE6OF01DHVKQ.49.53.E09.1.454.CMB.1.raw
  modified_base (173)..(179): a, c, t, g, unknown or other
  misc_feature (173)..(179): n is a, c, g, or t

SEQ ID NO: 20999 - DNA, 209 bp, Homo sapiens
  misc_feature: GYAE6OF01DT13U.49.53.E09.1.454.CMB.1.raw
  modified_base (178)..(209): a, c, t, g, unknown or other
  misc_feature (178)..(209): n is a, c, g, or t
tcagagtcgagagacacgaccggtgctcgatttagagagagtgtgttggggtttgggggggaagaggaagactgacggtccccccaggagttcaggtgctgggcacagcggccctgggctgcctggtcaaggactacttcctctctcgactctgagcgggctggccaaggcgcatagnnnnnnnnnnnnnnnnnnnnnnnnnnnnnnnn

SEQ ID NO: 21000 - DNA, 181 bp, Homo sapiens
  misc_feature: GYAE6OF01BAAMJ.49.53.E09.1.454.CMB.1.raw
  modified_base (166)..(166): a, c, t, g, unknown or other
  misc_feature (166)..(166): n is a, c, g, or t
  modified_base (172)..(181): a, c, t, g, unknown or other
  misc_feature (172)..(181): n is a, c, g, or t
tcagagtcgagagacacgaccggtgctcgatttagagagagtgtgttgggttgggggaagaggaagactgaccggtcccccaggagttcaggtgctgggcacagcggcccgtggctgcctggtcaaggctacttcctctctcgactctgagcgggctggcaaggcncatagnnnnnnnnnn

SEQ ID NO: 21001 - DNA, 188 bp, Homo sapiens
  misc_feature: GYAE6OF01BL8IP.49.53.E09.1.454.CMB.1.raw
  modified_base (174)..(188): a, c, t, g, unknown or other
  misc_feature (174)..(188): n is a, c, g, or t
tcagagtcgagagacacgaccggtgctcgatttagagagagtgtgttgggtttaggggggaagaggaagactgacggtcccccaggagttcaggtgctgggcacagcggcctgggctgcctggtcaaggactacttcctctctctactctgagcgggctggcaaggcgcatagnnnnnnnnnnnnnnn

SEQ ID NO: 21002 - DNA, 171 bp, Homo sapiens
  misc_feature: GYAE6OF01COTPM.49.53.E09.1.454.CMB.1.raw
tcagagtcgagagacacgaccggtgctcgatttagagagagtgtgttgggtttgggggaagaggaagactgacggtcccccaggagttcaggtgctgggcacagcggccctggctgcctggtcaaggactacttcctcgtagcactctgagcgggctggcaaggcgcatag

SEQ ID NO: 21003 - DNA, 178 bp, Homo sapiens
  misc_feature: GYAE6OF01EN9FY.49.53.E09.1.454.CMB.1.raw
  modified_base (176)..(178): a, c, t, g, unknown or other
  misc_feature (176)..(178): n is a, c, g, or t
tcagagtcgagagacacgaccggtgctcgatttagagagagtgtgttgggtttggggggaagaggaagactgaccggtccccccaggagttcaggtgctgggcacagcggccctgggctgcctggtcaaggactacttcctctctcgactctgagcgggctggcaaggcgcatagnnn

SEQ ID NO: 21004 - DNA, 202 bp, Homo sapiens
  misc_feature: GYAE6OF01C6Y26.49.53.E09.1.454.CMB.1.raw
  modified_base (174)..(202): a, c, t, g, unknown or other
  misc_feature (174)..(202): n is a, c, g, or t
tcagagtcgagagacacgaccggtgctcgatttagagagagtgtgttgggtttgggggaagaggaagactgacggtcccccaggagttcaggtgctgggcacagtcggccctgggctgcctggtcaaggactacttcctctctcgactctgagcgggctggcaaggcgcatagnnnnnnnnnnnnnnnnnnnnnnnnnnnnn

SEQ ID NO: 21005 - DNA, 802 bp, Homo sapiens
  misc_feature: GYAE6OF01ENQAQ.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctggaggcctcctatgagctgacacacgcccacccgtcggtgtcttgtcgtcctacgaggacagaccgccagtactccaccgttgctcgtaggagtatcgactagttcgaaccgtaaagacctaattctcgtaccttaacgtacgggtaaccagacgaacgacgccgaccggacccgaccggtccccttgttactaggtacttacttaatttaacgtaaagttcgtttaggaacgggtaccggtacctaccggacccgggtaccctaggaccgtacgtactttccgtcggtaccgtcccgtaccgacgtcctaacgacgtacccgaaaccgtaacgtacggttaacgtacgtttacgaacctagtacggtagggacggtacccggggtacggacgtaagggaccgggacggacgttaccgttaggtaacctttacggttaacgtccggttaacgtacgtaccgtaagtaccggtaagtaaccggttaggttacggttaccggtacctttaccggttaccggttacggttaaccgggttacgggtcccgggtaaacgggggtacccggtaaaccgttacggtcccggtacccggttacccggttaacccggtaggtacccccgtagggtaaccccggaacgttccccccgggtacccccgg

SEQ ID NO: 21006 - DNA, 616 bp, Homo sapiens
  misc_feature: GYAE6OF01AZGTV.49.53.E09.1.454.CMB.1.raw
  modified_base (342)..(342): a, c, t, g, unknown or other
  misc_feature (342)..(342): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggcccctgtcttgatcatttaataaagtactttgagagggcctacgacgggtacccctgacgcgtattccncttcggcctccagctcagcgaacaacagtacacgttacgaccagtaccgaggtcgggaacggtcccggggatagggaacgggtacgacgggtcgtaggtaaccttagttaacgtgttaccgtacgtcaacttacgacgtaactaggtaagttgggacctacgtttctggttacggttagtacggggtcgggaaacgggtaccaaacggtccgttacggacccggttaccgtacgggtacccaacggacccgtaaacgggtcccttaaccccggg

SEQ ID NO: 21007 - DNA, 175 bp, Homo sapiens; identical to SEQ ID NO: 20418
  misc_feature: GYAE6OF01CT914.49.53.E09.1.454.CMB.1.raw
  modified_base (173)..(175): a, c, t, g, unknown or other
  misc_feature (173)..(175): n is a, c, g, or t

SEQ ID NO: 21008 - DNA, 177 bp, Homo sapiens
  misc_feature: GYAE6OF01BOJ0X.49.53.E09.1.454.CMB.1.raw
  modified_base (168)..(168): a, c, t, g, unknown or other
  misc_feature (168)..(168): n is a, c, g, or t
  modified_base (174)..(177): a, c, t, g, unknown or other
  misc_feature (174)..(177): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcncatagnnnn

SEQ ID NO: 21009 - DNA, 174 bp, Homo sapiens; identical to SEQ ID NO: 20523
  misc_feature: GYAE6OF01AZB16.49.53.E09.1.454.CMB.1.raw
  modified_base (174)..(174): a, c, t, g, unknown or other
  misc_feature (174)..(174): n is a, c, g, or t

SEQ ID NO: 21010 - DNA, 190 bp, Homo sapiens
  misc_feature: GYAE6OF01E2J7G.49.53.E09.1.454.CMB.1.raw
  modified_base (173)..(190): a, c, t, g, unknown or other
  misc_feature (173)..(190): n is a, c, g, or t
tcagagtcgagagacacgaccggtgctcgatttagagagagtgtgttggggtttgggggaagaggaagactgacggtccccaggagttcaggtgctgggcacagcgccctgggctgcctggtcaaggactacttcctctctcgactctggagcgggctggcaaggcgcatagnnnnnnnnnnnnnnnnnn

SEQ ID NO: 21011 - DNA, 173 bp, Homo sapiens
  misc_feature: GYAE6OF01ASHT9.49.53.E09.1.454.CMB.1.raw
tcagagtcgagagacacgaccggtgctcgatttagagagagtgtgttgggtttgggggaagaggaagactgacggtcccccaggagttcaggtgctgggcacagccggccctgggctgcctggtcaaggactacttcctctctcgactctgagcgggctggcaaggcgcatag

SEQ ID NO: 21012 - DNA, 670 bp, Homo sapiens
  misc_feature: GYAE6OF01D532Q.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctctatgagctgacacagccaccctggtgtctgtgtcctcaggacagacggccagtatcacctgcctcgtggagatgctattcgaccaaaagctaatatgacttactggtaccagcaagaacgccacggccacggcccctgtcttgattctaatttaataaagtattttggagacgggcctcgaccgggaccctgagcgtattctcgtggcctaccagtcctcagacccgaacaaacctacggtcctaaccggtttagaaccctaagtacgtaacgggtgggtaaccgggtacccgggtacaagggaacggaccggacgggtactagtaacctttaagttaccgtcgtacacgttcaacttacgacgtaacgtaggttaggtacgaccgtacgtttcggtcgtttacggtaccggttaccggggacgggtaaccgggtaaccgtaacggtccgtaaccggtaccggttacccggttacggttacccgaaccggttaaccccggaaggtcccgtaccccccgg

SEQ ID NO: 21013 - DNA, 774 bp, Homo sapiens
  misc_feature: GYAE6OF01C4MBY.49.53.E09.1.454.CMB.1.raw
tcagagtcgagagacacgaccggtgctcgatttagagagagtgtggttggggtttgggggtgggtccaggaggcagaactctgggtgtctcaccatggcctggatccctctacttctcccctcctcactctctgcacagactcctgaggcctcctatgagctgacacagcccacccgtcggtgtctggtcgtcctcgaggacaggaccggccagtactcacctgctcgtggagatgactattacgaaccaaaagtctaaagtagtacgtacctttaacgtacggtaacccaaggaccgaaacggaaacgcccgaacgggccgaaccggtcccccgttagttacccgtttagtaagttaccttaaagttttaaacgtaaaacggttaccgttttaagggaacgggtaaccgggtaccccgttaacggacccggggtaaccccttagggtaacgtaccggtaaactttccgtaaccggttcgggtacccttaccgaacgtacccgttacgaaccggaccgtaaactaaccgtacgttaccgtacggttacgaacctagtcgaaggtacgggacggtccggagaaggacggacgaggcttacggtactagttaccgtgtactagtactaacgtacgagtacgtaggttaggtcggaccttacgttcgtacggttaaccggttggttaccggggacgggaacgggtaacccaacggttccgaccggttacccggtaccgtacggacccacggacccgtaacggtcccgtaacccccgg

SEQ ID NO: 21014 - DNA, 671 bp, Homo sapiens
  misc_feature: GYAE6OF01COO48.49.53.E09.1.454.CMB.1.raw
  modified_base (528)..(528): a, c, t, g, unknown or other
  misc_feature (528)..(528): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctggaggcctcctatgagctgacacagccaccctcggtgtctgtgtcctcaggacagacggccaagtatcacctgctcgtggagatggctaagttcgaccaaaagctaaatagtgtacctttacgttcggtaaccaggacaagaacgccgaggacccgacggtccccttggtccttagactactaagttttaataaacgtactttaggaacggacggtcctacgacgggtacccctaggacggcgtactttccgtcgtcggtacccttccgaacgtctacgacggaccgaacaaacgtacgtaacacggtttacgaaccatcgagggtcggacggtcccgggagaaggacggacgaggctacgtactaagttctacggtacagttanaacgtacgtaagaacgtagtaaggcgtaacttcgttacgttgttacgggttacgtaccgggacggggtaaacggtcaaaggttcccgtacggaacccgttcgtaaccggtacacccgggaccccgaagggttccctccccggg

SEQ ID NO: 21015 - DNA, 731 bp, Homo sapiens
  misc_feature: GYAE6OF01BHA0N.49.53.E09.1.454.CMB.1.raw
  modified_base (668)..(668): a, c, t, g, unknown or other
  misc_feature (668)..(668): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgacggcctcctatgagctgacacacgcccaccctcggtgtctgtcgtcctcgaggacagacggccagtactcactgctcgtggagatgctattcgaccaaagcaatatcgtacttacgtaggtaccagacgaagaacgccgaacggccgaccggccccttcggttacttagtaacttactaattttaaacgtaaacgtacgttttacggaacgggtacgggtccgtaccggaaccgggtaccccgttaggacgtaccgtacttccgtcgtacgggcctaccgacgtccgtacgaaggtaccgaaccaaaccgtcgtaccgtaacggttacgaacctactacggtaagggtacgggtaccgggtacccggggaacgtaacgggaacgggacggaacgggtcgttaaggtaacctttagttacgttgtacgtaactacgagttaacgacgaaccgtaggttacggtacgtaccgttacgttacggtaggttccgttacggttaccggggacgggaaccgggttaacncgggtcccgtacgggtacccgtacgttacgggccaaccggacccgacggtccgtacccccggg

SEQ ID NO: 21016 - DNA, 599 bp, Homo sapiens
  misc_feature: GYAE6OF01BIYJ4.49.53.E09.1.454.CMB.1.raw
  modified_base (339)..(339): a, c, t, g, unknown or other
  misc_feature (339)..(339): n is a, c, g, or t
  modified_base (460)..(460): a, c, t, g, unknown or other
  misc_feature (460)..(460): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtacccagcaagaagccgaggccacggcccctgtctgatcaatttataaagactttgagagggcctcgacgggacccctgagcgattcnctggctccagctcagacgacaacagtaccacgttcgacctatacgaggtagggacgtcccgggagaaggacgggaacggagggtctacggtaactttatacgtagttcgagtactacgtanaacgacgtagtacggtcggtctacctttcggttacgttcggttacgttcggggaccgggtaacgggaacgtaggtccgtaccggttacccggtaccgttacggtccggaacccgcccggtaaaggtccccgtaccccgg

SEQ ID NO: 21017 - DNA, 674 bp, Homo sapiens
  misc_feature: GYAE6OF01BUULA.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccacctcggtgtctgtgtcctcaggacagacggccagtatcgacctgctctggagatgcattcgaccaaaagctaatatgtcttactggtacctagcaagaacgccgaggccacggcccctgtcttgatactaatttaataaagtactttagaggacggtccgtacgacggacccctgagtcgtattcgtcgtcggcctccagtctacgacgaccgaacaacgacgtacgtacgttacgaacctatacgaggtcggacggtcccggagtaacggacgggaacggacggtacgtacgtaaccgttattacgtcgttacgtagttacgtacgtaccgaagtaacgtaaggttacggtacggtacctaccgtttcgtacggttaccggttacggtttaccgggacggggtaaccgggtaacctaacggggtcccgttacggtaaccccggttaccgttaaccgggtaccgtaacccggaccccggtaaacgggtcccgttaccccccggg

SEQ ID NO: 21018 - DNA, 711 bp, Homo sapiens
  misc_feature: GYAE6OF01EF2C9.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctggacgcctctatgagctagacacacgcctacccgtggtgtctgtcgtcctagaggacagaccggccagtactcctacctcgcctgtaggatagtcgacctagttacgaaccaaaagtactaaagttacgtcgtacgttaacgtacgggtaaccagtacgaaggaaccgccggacggtcccgaccgggtccccttggttcgtagtacttaacttaagttaagttaaacggttacgtttaggacgggtacggtccgtaccgggaaccggtaccctagggacttacgtacttcgtcgcggtaccctctacgtctacgacgacgtaacctaagtcgtaccgtacgtacgaactacgtacggtagggtcgggaacggtccggaggtaagggacgggacgacggtactacgtacgttacgttacgtcgtatacgtactacgtaacggacggtacgtaggttacgtcgtacctacgttacgtggttaccggtggtaccgggacgggaacgtaccgtaccggtcgtaccggtccgtaaccgtcggacccgaccgaccggtacgcccgttaccccgg

SEQ ID NO: 21019 - DNA, 177 bp, Homo sapiens
  misc_feature: GYAE6OF01DB5M6.49.53.E09.1.454.CMB.1.raw
  modified_base (173)..(177): a, c, t, g, unknown or other
  misc_feature (173)..(177): n is a, c, g, or t
tcagagtcgagagacacgaccggtgctcgatttagagagagtgtgttgggtttggggggaagaggaagactgaccggtcccccaggagttcaggtgctgggcacagcggcctgggctgcctgtcaaggactacttcctctctcgactctgagcgggctggcaaggcgcatagnnnnn

SEQ ID NO: 21020 - DNA, 557 bp, Homo sapiens
  misc_feature: GYAE6OF01CLI5S.49.53.E09.1.454.CMB.1.raw
  modified_base (230)..(230): a, c, t, g, unknown or other
  misc_feature (230)..(230): n is a, c, g, or t
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
  modified_base (455)..(455): a, c, t, g, unknown or other
  misc_feature (455)..(455): n is a, c, g, or t
  modified_base (553)..(553): a, c, t, g, unknown or other
  misc_feature (553)..(553): n is a, c, g, or t
tcagagtcgagagacacgaccggtgctcgatttagagagagtgtgttggggtttgggggtgggtccaggaggcagaactctgggtgtctcaccatggcctggactccctctacttcctcccctcctcactctctgcacagactctgagcctctatgagctgacacacgcctacccgtggtgtctgtcgtcctagaggacacgaccggctagtactccacctgctgagganatcactatacgaccaaaagtctaatatgtacttacgtcggacagacagaacnccgaaggcacggtccttgtattnacntaatttanaaagtntttgacgacggtctacgcggacctggntctatctcgnggcctcagctacaggcctaaanaacngtctacgacgacaatcgaaggtcggtacgacggcaaaggacgaggtaacggntacggactagtactnacngtacaatacgagtacgtagtcgtactctagtccgtgtcgtacggtcgacggacgtacacgtcgtacggtacgtacgtacgtacgacgaccggtcgccncccg

SEQ ID NO: 21021 - DNA, 795 bp, Homo sapiens
  misc_feature: GYAE6OF01D24J5.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacaggacggccagtatcacctgctcgtggagatgctattcgaccaaaagcaatatgtactttaacgtcggtaaccagcgaagaacgccgacggaccacggtcccccttgttacgtttgacttactaagttttaagtaaaagtacgttttaggaggtacgggccctacggaccgggacccctggacggtacgtacttcctcgtcggtcctaccgtacgccgtaccgaacggaccgaaaccaaaccgtacggttaccgtaaaccggtttcgaaacccgtaacgttaccggtaacggggttcggggaaacccggggtttccccgggggacggtaaaccggggaagggggaaacccgggtacgggtaccttaacgggtaacttttaacgtttaccggtttagtaccgtaagtttccaaacgttacgaaacggtaacgttaacgggttaggtacggttacttaccgtttccggttagtttaaccggttacggttaccgggggacggggtaaaccgggaaccgtaacgggtcccggttacgggtaacccccgttaccggtaacggtacccggtaccggaccccggtaaaggtccccgttaccccggg

SEQ ID NO: 21022 - DNA, 179 bp, Homo sapiens; identical to SEQ ID NO: 20971
  misc_feature: GYAE6OF01B1PRP.49.53.E09.1.454.CMB.1.raw
  modified_base (174)..(179): a, c, t, g, unknown or other
  misc_feature (174)..(179): n is a, c, g, or t

SEQ ID NO: 21023 - DNA, 579 bp, Homo sapiens
  misc_feature: GYAE6OF01CQ6GX.49.53.E09.1.454.CMB.1.raw
  modified_base (300)..(300): a, c, t, g, unknown or other
  misc_feature (300)..(300): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (473)..(473): a, c, t, g, unknown or other
  misc_feature (473)..(473): n is a, c, g, or t
tcagagtcgagagacacgaccggtgctcgatttagagagagtgtgttggggtttgggggtgggtccaggaggcagaactctgggtgtctcaccatggcctggatccctctacttctcccctcctcactctctgcacagactctgaggcctcctatgagctgacacagcccacctcggtgtctgtgtcctcaggacagacggccagtatcacctgctctggagatgcattcgaccaaagcaatatgcttactaggtacagcaagaagcacggccacggcccctgtcctgatctaatttaanaaagtcgtttaggagtacggcctcgacgggacccctgacgcgtattcncgtggcctcagtcncgancgaacacgngtaccaggttacaactagtacgaaggtcgggacggtccgggacaagggaacggacggaggcgtagacttagttactgtacgtatacatcgaagtacgngttagtcggtactcttcgtgttcgttacggtgggaccggaacgggtaccgaggtcctacggtacccgtaccggtaggaccacggacccgaggtccccgtaccccgg

SEQ ID NO: 21024 - DNA, 205 bp, Homo sapiens
  misc_feature: GYAE6OF01D1F1I.49.53.E09.1.454.CMB.1.raw
  modified_base (138)..(138): a, c, t, g, unknown or other
  misc_feature (138)..(138): n is a, c, g, or t
  modified_base (168)..(168): a, c, t, g, unknown or other
  misc_feature (168)..(168): n is a, c, g, or t
  modified_base (174)..(205): a, c, t, g, unknown or other
  misc_feature (174)..(205): n is a, c, g, or t
tcagagtcgagagacacgaccggtgctcgatttagagagagtgtgttgggttgggggaagaggaagactgacggtcccccaggagttcaggtgtctgggcacagtcggcctgggctgcctggtcaaaggctacttccnctctcggactctgagcgggctggcaaggcncatagnnnnnnnnnnnnnnnnnnnnnnnnnnnnnnnn

SEQ ID NO: 21025 - DNA, 185 bp, Homo sapiens
  misc_feature: GYAE6OF01AWHD5.49.53.E09.1.454.CMB.1.raw
  modified_base (174)..(185): a, c, t, g, unknown or other
  misc_feature (174)..(185): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctctctcgactctgagcgggctggcaaggcgcatagnnnnnnnnnnnn

SEQ ID NO: 21026 - DNA, 694 bp, Homo sapiens
  misc_feature: GYAE6OF01BIV5L.49.53.E09.1.454.CMB.1.raw
  modified_base (177)..(177): a, c, t, g, unknown or other
  misc_feature (177)..(177): n is a, c, g, or t
tcagagtcgagagacacgaccggtgctcgatttagagagagtgtgttgggtttgggggtgggtccaggaggcagaactctgggtgtctcaccatggcctggatccctctacttctcccctctcactctctgcacagactctgaggcctctatgagctgacacagcccacccgtggtntctgtgtcctcgaggacagacggccagtactccacctggctcgtggagatcgctacgttcgaaccaaagcaaagtactgtacctttaacgtcggtaaccagaccaaggaacgccgacggcccgaccggtccccttcgttacgttgaacttactaattttaagaaaggttcgttttaggacggtacggtacccgttacggaccgggtaccctaggacggtaccgttactttcctacggttcggctaccgtacggtctacgacggtaaccgaaccgtaaacgtacgtacctaacgggttacgacccgtagtacgacgggtacggaccggtaacggagacggaacggacgagtacgaaggtacttagttacgtacgtacgtacgtcaacgtaccgtaggaccgtaaggtcgacggtaccttcgttcgtggtaccgttcggtacgggacgggtaacggtaccaggtacgtccggtaacccgttacgacggtaccaacggaccctaggtccccggtccccgg

SEQ ID NO: 21027 - DNA, 950 bp, Homo sapiens
  misc_feature: GYAE6OF01EG2CB.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacacgcccacccgtcggtgtctgtcgtcctacgaggacaggacggccagtactccacctgctcgtggagtatgctattcgaccaaagctaatagtcgtacttacgtcggtaccagacgaagaacgccgacggcccaccggtcccccttagtcctttagacttacttaaattttaaagtaaaacgttacgttttagggaacggtaccgggtacccctacggtacccggggtaaccccctgggtaaccggtccgttaaccgttttccgttccggttcggtacccgttacccgtaacgtcccgttaaccgaacggaacccgtaaaacccgtaaaccggttaaccggttacccgttaaccgggtttaccgaaacccgtaacggttacccggtaagggggttaccggggtaaccggggtcccccgggggaagaaacgggggaaccgggggtaaaccgggtacgggttaccgttaacggtttaaaacccgttttaacggttttaaccgttacgggtttaaccgtaccggtttaaccgtaacgttaacccggtaaacgggtaaccggttaaggggtttaaaccgggttcccgggttaccgtttaaaccggttttcccggttaagggttttaccccgggtttaggggttaaccccgggggtacccggggggttaaacgggaaaccccgtaacgggttcccgggtacccggttaaaccccggtttcccgggtaaacgggttacccccgaacccgggaaccccggttaaccgggtcccccggttacccccccgggg

SEQ ID NO: 21028 - DNA, 197 bp, Homo sapiens
  misc_feature: GYAE6OF01EX90L.49.53.E09.1.454.CMB.1.raw
  modified_base (173)..(197): a, c, t, g, unknown or other
  misc_feature (173)..(197): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggacctacttcctctctcgactctgagcgggctggcaaggcgcatagnnnnnnnnnnnnnnnnnnnnnnnnn

SEQ ID NO: 21029 - DNA, 690 bp, Homo sapiens
  misc_feature: GYAE6OF01DHJ53.49.53.E09.1.454.CMB.1.raw
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (517)..(517): a, c, t, g, unknown or other
  misc_feature (517)..(517): n is a, c, g, or t
  modified_base (533)..(533): a, c, t, g, unknown or other
  misc_feature (533)..(533): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgaggcctctatgagctgacacacgcccaccgtcggtgtctgtcgtcctcgaggaccaggaccggccaagtacnccacctgcctgtagganatgctattcgaccaaagctaaattcgtcggtaccttacgtcggtaccagacaagaacgccgacggccgacggtccccttggtcttgattacctaattttaaacgtaaacgttacgtttaggaggtaccgggtacccgtacggaaccgggaccctaggaacgtcgttaacttccgtcgttcggctaccgacgtctacgacggacaacaacgtcgtacgtacgtacgactacgtacgtaggtcgggacggtcggacgaaggacggacgtaggctagactagtcgtntacgacgtacacgtanacgaacgtaggtacgtaggtaccttacttcggtacggttacgttccgggttacggggacgggaaccgggttaaccaacggttcccgtacggttaccccggtttaacggaccggtaaccgaacccgggttacccaaacgggtccccgttacccccggg

SEQ ID NO: 21030 - DNA, 680 bp, Homo sapiens
  misc_feature: GYAE6OF01A0E0A.49.53.E09.1.454.CMB.1.raw
  modified_base (252)..(252): a, c, t, g, unknown or other
  misc_feature (252)..(252): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacacgcccaccctggtgtctgtcgtcctcgaggacaggaccggccagtactccacctgctcgtggagatgctattcgaccaaagcaatntgtcttacgtacggtaccagacaaggaacgccgacggccgacggtcccctgtcttgattactaatttaataaagttacgtttaggacggtacggtcctacgaccgggtaccccgtggaccgtcgtacttcgtacgtcggcctccgacgtcctacgacgtacgaaccaactacgtaccgtacgttacgactacgtacggaggtacgggacggtacccgggacgagggaacggtacggacgtctaggtaactttattacgttgtaacaatacaacgaacgtacctaccgttagttacggttaacttaggttacgttacggttaaccggacgtacggaacccgaacggttaccggtacccgtaacccgggttccgtacgggaccaacccggaaccccgaacccgtacccctaaccctaccgttcgtacccg

SEQ ID NO: 21031 - DNA, 177 bp, Homo sapiens
  misc_feature: GYAE6OF01EPR1J.49.53.E09.1.454.CMB.1.raw
  modified_base (174)..(177): a, c, t, g, unknown or other
  misc_feature (174)..(177): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctggagcgggctggcaaggcgcatagnnnn

SEQ ID NO: 21032 - DNA, 688 bp, Homo sapiens
  misc_feature: GYAE6OF01AQJW1.49.53.E09.1.454.CMB.1.raw
  modified_base (235)..(235): a, c, t, g, unknown or other
  misc_feature (235)..(235): n is a, c, g, or t
tcagagtcgagagacacgaccggtgctcgatttagagagagtgtgttggggtttgggggtgggtccaggaggcagaactctgggtgtctcaccatggcctggatccctctacttcctccccctcctcactctctgcacagactctgaggcctcctatgagctgacacacgcccacccgtcggtgtctgtcgtcctcgaggaccaggaccggccagtactccacctgctcgtggantgctattcgacaaagcaatatcgtacttacgtcggaacccagacaagaacgccgaggcccgacggtcccctgtcttagactacttaagtttaacgtaaacgtcgttaggacggacggtccgtaccggaccggtacccgtgacgtcgtacttccgtcgtcggtctccgagtctacgacgacgaacacgtacgtacgtacgttacacgtactcggtaggtacgggacggtcccgggaacgagggacgggacggacgttaccgagttaaccttactttacggcgttacgagttacagaccgtaagacggttaggtacggttccgacgtttaccttcgggttcggttccggttaaccggggtccggggtaaaccggggacgtaacccggaggtcccgaaccggtttcccgacggttacccgggacgacccgacccgggtccgacccggttcccccgg

SEQ ID NO: 21033 - DNA, 827 bp, Homo sapiens
  misc_feature: GYAE6OF01EETAB.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacacgccaccctcggtgtctgtgtcctcgaggacagacggccaagtactccacgtcgctctagggagatgcctagttcggacctaaaagcaatatcgtcttaactcggtaaccagacgaagaacgccgacggacccaccgggtcccccttggttacgtttaggattaccgttaaattttaaacgttaaaaggtaccttttagggaacgggtacgggtccctacggaaccgggtacccctaggacgtccgtaagtttcctcgtcggtcctacccgagtacctacgacggacccgtaactaaaccgtacgttaccgtaaccggtttacgaacccgtaagtacccggtaaggggtcgggtaaccgggtaccccggggaaggaagggaacgggtaacccggaggttaccgtaacggtaaccgtttaatttaccggtagttaccctaaggttacctaaacgttaccgaaacggtaccggtaaaggtttaccgggttagggtacccctttacgttccgggttacggtttaacggtttaccgggtaccggggggtacggggtaaaccggtaaaccccggttacggtacccggtaccccggttacccggttaaacccgggtcggtaaccccgtccgggtaaaccccggtacgggtccccggtaccccccggg

SEQ ID NO: 21034 - DNA, 177 bp, Homo sapiens
  misc_feature: GYAE6OF01DCQMR.49.53.E09.1.454.CMB.1.raw
  modified_base (174)..(177): a, c, t, g, unknown or other
  misc_feature (174)..(177): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcggctggcaaggcgacatagnnnn

SEQ ID NO: 21035 - DNA, 842 bp, Homo sapiens
  misc_feature: GYAE6OF01E2OPD.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggccctcctatgagctgacacagcccaccctcggtgtctgtcgtcctcgagacagacggccagtactcacctcgctcgtggagtatcgctattcgacccaaaagcaaattatcgcttacgtacgggtaacccagacgaagaacggcccgacggacccacggtcccccctgttccttagtattacctaattttaaataaacgtaccgttttaggaacggtacgggtaccctaccgaaccggggtacccccgtaggacggtccgtaactttcctcggtcggccctccgacgtcctacgacggtaccgaaaccaaacgtaccgttaccgtaccggtttacgaacccgtacgttaccgtaacggggttcggggtaaccgggttccccggggaacggtaacggggaacggggaacccgggaagggtacccgttaacggttaaacccgtttaacgtttaacccggttacggttaaccgtaccggtaccttaaacgtaacccggtaaacgtaacccggttaaggggtttaacggtcccggggtaaccttacccggtttacgttcgggttaccggtttaaacgggtcccgggggtacggggtaacccgggaaacccgtaaacgggtcccgttaaccgggaaccccgttaccggggtaacgtacccgaacccggtaccccggtacgggtcccccgttacccccggg

SEQ ID NO: 21036 - DNA, 181 bp, Homo sapiens
  misc_feature: GYAE6OF01BV3JT.49.53.E09.1.454.CMB.1.raw
  modified_base (173)..(181): a, c, t, g, unknown or other
  misc_feature (173)..(181): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctctctcgactctgagcgggctgggcaaggcgcatagnnnnnnnnn

SEQ ID NO: 21037 - DNA, 192 bp, Homo sapiens
  misc_feature: GYAE6OF01AK16J.49.53.E09.1.454.CMB.1.raw
  modified_base (138)..(138): a, c, t, g, unknown or other
  misc_feature (138)..(138): n is a, c, g, or t
  modified_base (172)..(192): a, c, t, g, unknown or other
  misc_feature (172)..(192): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggacctacttccnctctcgacctgaggcggctggcaaggcgcatagnnnnnnnnnnnnnnnnnnnnn

SEQ ID NO: 21038 - DNA, 737 bp, Homo sapiens
  misc_feature: GYAE6OF01BE1S3.49.53.E09.1.454.CMB.1.raw
  modified_base (181)..(181): a, c, t, g, unknown or other
  misc_feature (181)..(181): n is a, c, g, or t
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgacggcctctagtgagctgacacacgccacccgtggtntctgtcgtcctcgaggacacggaccggcctagtactccaccgttgccgttagtgggaagtnttgactagttacgacctaaaaggctaaatntacgtacttacgtacggaccagacgtaacggaacgcccgaacggcccgtacccggtccccgttgttacgttacgtaattaccgttaaattttaagtaaacggttccgtttagggaacgggtccggtacccgtaccgggtaaccggggtaaccccgtggtaaccggtcgttacgtttccgtcggtccggtcctaccgaccggtctacgacgtaccgaactaaacggtcgtaaccgttacggttaccacgtactcggtaggtacgggtaccgggacggtaacggaaggaacgggtaccggaacgtcgttaacgtaacgttacgttacgttacgtacgtactacgtaactacggtaacgtacggtaaggtcggttacgtaccgttacgttcgtacggttacggtcggttaccggacgggtacgacgtcgcgttcgacgtccgtaggtcaccgccacggtctaccccgg

SEQ ID NO: 21039 - DNA, 177 bp, Homo sapiens; identical to SEQ ID NO: 20980
  misc_feature: GYAE6OF01CW9L8.49.53.E09.1.454.CMB.1.raw
  modified_base (172)..(177): a, c, t, g, unknown or other
  misc_feature (172)..(177): n is a, c, g, or t

SEQ ID NO: 21040 - DNA, 694 bp, Homo sapiens
  misc_feature: GYAE6OF01D9DHY.49.53.E09.1.454.CMB.1.raw
  modified_base (226)..(226): a, c, t, g, unknown or other
  misc_feature (226)..(226): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctctatgagctgacacagccacccgtggtgtctgtcgtcctcgaggacacgacggccagtactcacctgctctagganagtcgactatcgaccaaagcaattagtcgtacttacgtcgtaccagacgaagaacgccgacggccgacggtccccttggttctagtacttacttaatttaaagtaacggttcttaggacggtacgggtcctacggaccggtaccctgacgtcgttactcgtcggtcgtcctacgactcgtaccgacgacgaacctacgtacgtaccgtaacgttcgaactagtacgtaaggtcggaacggtcggagaacggtaaggacggacgtcgtacgttaacgtcttacgtcgtaactcgttacgaagtccggaaacgtaagttaagggtcgttaccggtacttacggttttacgtacggtttacggtttacggccggggtaccgggaaaccgggtacctaaggttacccggtacggttaccccgacggtttacggaaccccgtacgaaccccgggtacgtccgtaaccccccgg

SEQ ID NO: 21041 - DNA, 174 bp, Homo sapiens
  misc_feature: GYAE6OF01AP88D.49.53.E09.1.454.CMB.1.raw
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatag

SEQ ID NO: 21042 - DNA, 721 bp, Homo sapiens
  misc_feature: GYAE6OF01C390O.49.53.E09.1.454.CMB.1.raw
  modified_base (184)..(184): a, c, t, g, unknown or other
  misc_feature (184)..(184): n is a, c, g, or t
  modified_base (236)..(236): a, c, t, g, unknown or other
  misc_feature (236)..(236): n is a, c, g, or t
  modified_base (328)..(328): a, c, t, g, unknown or other
  misc_feature (328)..(328): n is a, c, g, or t
tcagagtcgagagacacgaccggtgctcgatttagagagagtgtgttgggtttgggggtgggtccaggaggcagaactctgggtgtctcaccatggcctggatccctctacttctcccccctcctcactctctgcacagactctgaggccctcctatgagctagacacacgcccacccgtggtntctgtcgtcctcgaggacaggacggccagtactccacctgccttcgtggganatgctacttgaccaaaagctaatatcgtcttacgtcgtaccagacaagaacgccgacggccgaccggtcccctgttctgatactaatttaanaaagtctttaggacgacggcctacgaccgggtccctaggacgtaccgtattccgtacggtcggtcctaccgtacgcctacgtaacgacccgtaaacaaccgtacggttaccctaccgggttacaaacctaacggtcgaaacggggttccgggtaccggggacccggtaaggaaccgggtaagggaccgggaacgggttacgtaacgggttaaacctttacgtttaccgtaggcctaacgggtactaagtaccgaagtaccgttaggtacggtcgactttaccgttcgtaggttaccgttcgggtacgggtaacgggaaccggtaacaccggtgtccggtaccccgtcccggttaggacccgacccggtaccggaccgttcccggtacccccgg

SEQ ID NO: 21043 - DNA, 759 bp, Homo sapiens
  misc_feature: GYAE6OF01C3Y68.49.53.E09.1.454.CMB.1.raw
  modified_base (127)..(127): a, c, t, g, unknown or other
  misc_feature (127)..(127): n is a, c, g, or t
tcagagtcgagagacacgaccggtgctcgatttagagagagtgtgttggggtttgggggtgggtcaggaggcagaactcgtgggtgtctcaccatggcctggactcctctacttcctcccctcctcnctctctgcacagactcgtggacggtcctctagtgacgctgacacacgccctaccgttcggtgttctgtcgtcctcgaacggacgaggaccggcctagtactccacgtgcctgtaggagtatcgcgtacttacgaaccgtaaagtactaaattcgttacgtaccgtttaacggtacggtaaccgaacgaacgaaacggaaccgaccggaaccggtcccgaccggtccccgtttagttacgttacgtaacttaactttaaacgtttaaacgttaaacgttacgtttagggacggtacgggttccgtaaccgggaccggtaccgtacggtaacgtcgttacgtttccgtcggttacgccgtaacgcgtccgtaacggaacgtaccgaaacgtaacggtacgtaccgttacgtaacacgtacgtacgggtacggtcggtacgggtcgaaggacggaacggacggtacgacgttacgttacgtacttcggtactacgacgtacacgaacggtaggtagtaagggtacgtcgttaaccgttgttaggttccgttaacggcgggtaccggacgggaacggacttacggaccgtcgtacccggtagtaccgggaccaccggcggaccgtcccgtccccgg

SEQ ID NO: 21044 - DNA, 697 bp, Homo sapiens
  misc_feature: GYAE6OF01A486C.49.53.E09.1.454.CMB.1.raw
  modified_base (181)..(181): a, c, t, g, unknown or other
  misc_feature (181)..(181): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacacgcccaccctcggtntctgtcgtcctcaggacagacggccagtatcacctgctcgtggagatcgctattcgaccaaagcaatatcgtcttacgtggtaccagcaagaacgccgacggccgacggcccctgtcttgatactatttaacgtaaagtactttaggaggacggacctcgaccgggacccctaggacgtacgtacttccgtcgtcggccgtaccgacgtcctacgaacgtacccgaacgtaaactacggtcctaacgttacccgaactacgtaccgtaaggtaggggtaccggtacccgggacggtaagggaacgggtaccgggaaggtccgtaacggtacttacgttaacgttcggtacctaggtacctagttaacgacggaacgttagtaacgggttcggtaccttacggttgttccgttacggttacggtacggggtaaccggggaccggtaaccggacgggtactacccggtaccggtaccgttgggaccctaccggaccccgtacggtcccgtacccccgg

SEQ ID NO: 21045 - DNA, 816 bp, Homo sapiens
  misc_feature: GYAE6OF01AO5CT.49.53.E09.1.454.CMB.1.raw
  modified_base (613)..(613): a, c, t, g, unknown or other
  misc_feature (613)..(613): n is a, c, g, or t
  modified_base (717)..(717): a, c, t, g, unknown or other
  misc_feature (717)..(717): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggccctctatgagctgacacacgcccacccgtcggtgtctgtcgtcctcgaggacaggaccggcctagtactccacctgctcgtaggatatcgacgtattacgaccaaagactaaaattgtcgttaccttacgtacggtaccacggacgaacggaacggccgacgggaccccgtaccggtcccccttggttacttagtaaccttactttaaacgttttaaacggttaaaacggttaccggtttagggaacgggtaccgggtacccgtaccgggtaacccggggtaccccgtaggtaacggtccggtttaactttccgtaccggtacgggtaccctacccgtacgtcctaccggaacgtacccgtaaaccgtaacggttaccgtacgttaaccgggtacacctaccggttacggtacgggtaccgggtacggtacccgggacggtaacgggacggggtactaccgggnttaccggttacttacgttaccgtagtacctaacggtactacgtacggaacgtaaggtagtacgggtccttaacggttactttcggtaggttcgggttaccgggnggtaaccggggaacggacccgtaaggttccgtaaccgggttacccgttccgggtaaccgtaccggacccggacccgtacgggtccccgttaacccccgg

SEQ ID NO: 21046 - DNA, 176 bp, Homo sapiens
  misc_feature: GYAE6OF01BITTE.49.53.E09.1.454.CMB.1.raw
  modified_base (173)..(176): a, c, t, g, unknown or other
  misc_feature (173)..(176): n is a, c, g, or t
tcagagtcgagagacacgaccggtgctcgatttagagagagtgtgttgggtttgggggaagaggaagactgacggtcccccaggagttcaggtgctgggcacagcgccctgggctgcctggtcaaaggactacttcctctctcgactctgagcgggctggcaaggcgcatagnnnn

SEQ ID NO: 21047 - DNA, 696 bp, Homo sapiens
  misc_feature: GYAE6OF01APRSQ.49.53.E09.1.454.CMB.1.raw
  modified_base (230)..(230): a, c, t, g, unknown or other
  misc_feature (230)..(230): n is a, c, g, or t
  modified_base (541)..(541): a, c, t, g, unknown or other
  misc_feature (541)..(541): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgacggcctcctatgagctgacacagcccaccctcggtgtctgtcgtcctgaggacacgaccggccagtatccacctgcctcgtggaanagtgctattcggaccaaagacaagttatcgtacttacgtacggtaaccagacaagaacgccgacggaccgtaccggtcccctgttcttagacttactaattttaacgtaaacgtacgtttaggacggtaccgggtcccgtacggaacgggtaccccaggtacgacgttacgttctcgtcggtactccgagtcctacgacgacgaactaacgtcgtacctacgttacgactacgcgtagggtcggaccggtcggacgtacgggaacggacggtacgtgtaacgttactacgttacgtacgttacgtaacgtntactacgacggtaacgtagggtacgtacgtaccgtagttccgttcggttagttaccgggtacgggacgggtaacggacccgtaaggtcccgaaccgggttacccttaccgggtacggtacccgacccggtaccgtaccggtacccggtccccccg

SEQ ID NO: 21048 - DNA, 178 bp, Homo sapiens; identical to SEQ ID NO: 20465
  misc_feature: GYAE6OF01BMIGR.49.53.E09.1.454.CMB.1.raw
  modified_base (173)..(178): a, c, t, g, unknown or other
  misc_feature (173)..(178): n is a, c, g, or t

SEQ ID NO: 21049 - DNA, 821 bp, Homo sapiens
  misc_feature: GYAE6OF01BCA2H.49.53.E09.1.454.CMB.1.raw
tcagagtcgagagacacgaccggtgctcgatttagagagagtgtgttgggtttgggggtgggtccaggaggcagaactcgtgggtgtctcaccatggcctggactccctctacttcctcccctcctcactctctgcacagactctgacggcctctatgagctgacacacgccaccgtggtgtctgtcgtcctgagacgagcggcagtactccactgctcgtaggagtatcgactaagttacgaacgaaagactaaagtagtcgtaccttacgtacggtacaacgacgaacggaacgccgaacggccgtacggtaccccgttagtttaccgtagtaacttacttaaagtttaaactaaacggttacgtttaggaacggtcgggtacctacggaaccggacccgtagacggtcttaacgtttccgtaccggtcggtacccttaccgaccgtacgtaaccgtaacggaaccgtaaaccgtaacgtaacggttaccgttaaccggttaacgaaccgttaacgtacggtaacgggttaccggggtaccgggtaccggggaacggtaaacgggtaacggggtaacgaaccggggttacgtaaccgggtaaactttaacggttaaccgtttacgtaacggttaacgtaccgtaacgttaacgaacgtaaccggtaggttaaccgggttcgtacccgttaccgttttcgaacgggtttcgtaaccgggtttacgggacggggtaaaccggtaaccggtaacggtacccggacgttaaaccggtcggttaaccggacgaaaccggacccggtaccgtccggtaaccccgg

SEQ ID NO: 21050 - DNA, 181 bp, Homo sapiens
  misc_feature: GYAE6OF01EEBHW.49.53.E09.1.454.CMB.1.raw
  modified_base (173)..(181): a, c, t, g, unknown or other
  misc_feature (173)..(181): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactacttcctctctcgactctgagcggctggcaaggcgcatagnnnnnnnnn

SEQ ID NO: 21051 - DNA, 196 bp, Homo sapiens
  misc_feature: GYAE6OF01CLV5V.49.53.E09.1.454.CMB.1.raw
  modified_base (138)..(138): a, c, t, g, unknown or other
  misc_feature (138)..(138): n is a, c, g, or t
  modified_base (177)..(196): a, c, t, g, unknown or other
  misc_feature (177)..(196): n is a, c, g, or t
tcagagtcgagagacacgaccggtgctcgatttagagagagtgtgttggggtttgggggaagaggaagactgacggtcccccaggagttcaggtgctgggcacagcggccctggctgcctggtcaaggactacttccnctcgtcgactctgaggtccgggctggcaaggcgcatagnnnnnnnnnnnnnnnnnnnn

SEQ ID NO: 21052 - DNA, 721 bp, Homo sapiens
  misc_feature: GYAE6OF01A6JV7.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcgaggacagacggccagtactcacctgctcgtggagtatgcagttcgaccaaagctaatatcgtacttacgtacggtaccagacgaagacgccgacggaccgaccggtccccgttgttacgttagacttacttaagtttaaagtaaacgtacgtttaggaacgggtaccggtcccgtacggaccgggtacccgtaggacgtacgtcttccgtcgtcggtcctcgacgtcgtacgacgaccgaacaacgtacgtaccgtacgttaccgacctacgtacgacggtcggaacgggtccggaacgaacgggacgggacggacggtacgtacgtaacttacgttacgtacgtacgtacgtacgtaactacgaacgtaacgtaggtacggttacgtaccgttacgttccgttcggttacggttacggttaccgggaccgggtaaccgggtaaccgtacggtaccggtaccggtaccccggtaccggtaaccgggtacccgtaacccggtacccggtaacgggttccccgtacccggg

SEQ ID NO: 21053 - DNA, 228 bp, Homo sapiens
  misc_feature: GYAE6OF01DXC7D.49.53.E09.1.454.CMB.1.raw
  modified_base (96)..(96): a, c, t, g, unknown or other
  misc_feature (96)..(96): n is a, c, g, or t
  modified_base (175)..(175): a, c, t, g, unknown or other
  misc_feature (175)..(175): n is a, c, g, or t
  modified_base (183)..(228): a, c, t, g, unknown or other
  misc_feature (183)..(228): n is a, c, g, or t
tcagagtcgagagacacgaccggtgctcgatttagagagagtgtgttggggttgggggaagaggaagactgaccggtccccccaggagttcaggtnctgggcacagcggccctgggctgcctggtacaaggactacttcctctctcgactcgtgaggcgggctagggcaaaggcncaatagcnnnnnnnnnnnnnnnnnnnnnnnnnnnnnnnnnnnnnnnnnnnnnn

SEQ ID NO: 21054 - DNA, 174 bp, Homo sapiens; identical to SEQ ID NO: 20544
  misc_feature: GYAE6OF01B9BK9.49.53.E09.1.454.CMB.1.raw
  modified_base (174)..(174): a, c, t, g, unknown or other
  misc_feature (174)..(174): n is a, c, g, or t

SEQ ID NO: 21055 - DNA, 178 bp, Homo sapiens; identical to SEQ ID NO: 20465
  misc_feature: GYAE6OF01EJ2T9.49.53.E09.1.454.CMB.1.raw
  modified_base (173)..(178): a, c, t, g, unknown or other
  misc_feature (173)..(178): n is a, c, g, or t

SEQ ID NO: 21056 - DNA, 737 bp, Homo sapiens
  misc_feature: GYAE6OF01CBOWQ.49.53.E09.1.454.CMB.1.raw
  modified_base (222)..(222): a, c, t, g, unknown or other
  misc_feature (222)..(222): n is a, c, g, or t
  modified_base (329)..(329): a, c, t, g, unknown or other
  misc_feature (329)..(329): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagctctggaggcctctatgagctgacacacgccacccgtcggtgtctggtcgtccctgaggacagacggccagtatcacctgctgnggagatgcagttgaccaaaagcaatatgactttacgaggtaccagacgaacgaaacgccgaacggccgtaacgggccccttaggtcctttagacttctaagtttaanaaagtacgtttagagggtaacggtccacggtaccggtaccccgagacgtacggacttttcacgtcggcttaccgaacggtctacgtaagaacccggtaacaaacgtacggtaactaaccggtttacggaaccctaagttacggaacggtttacggggtaccgggtacccggggtaagaacgggaaaccgggaaggaacgggtacgttaacgggtaaactttaacgtttaacccgttaggtaaccgtaacgtttacggaacttaacccgaaggtaaccggttaaagtacgggttacggaactacgttcgtaggtaacgttcggtaacggtcgggaacggtaccgaaggtaccgacgtaccgtacccgtaggtaacctaccggacccgtaaagggtcccgtaaccccggg

SEQ ID NO: 21057 - DNA, 774 bp, Homo sapiens
  misc_feature: GYAE6OF01AY7H5.49.53.E09.1.454.CMB.1.raw
  modified_base (136)..(136): a, c, t, g, unknown or other
  misc_feature (136)..(136): n is a, c, g, or t
  modified_base (168)..(168): a, c, t, g, unknown or other
  misc_feature (168)..(168): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
tcagagtcgagagacacgaccggtgctcgatttagagagagtgtgttgggtttggggtggtccaggaggcagaactctgggtgtctcaccatggcctggatccctctacttcctccccctcctcactctctgcacngacctctgaggtccctcctatgagctgacacngccacccgtcggtgtctggtcgtcctcgaggacaggacggcctagtactccactgctcgtgganactgctatcgaccaaagtcaatntgtacttacgtcggtacagcaaggacgccgaggcccgacggtccccctagtaccgtttgaacttacgtaacttttaagtaaacgtacgttttaggacggtacggtccgtacggaccgggtacccctaggtacgtacgtacgtttccgtcgtcgggtccctaaccgcgtaccgttacgaacgtaccgactaaaccgttacgtaaccgtccggttaacgacccgtagtaccgtagggtacggtacgggtacccggacgaacggggaacggtaccgggtaacggcgtttaacggaacctttacggttacgttaccgtacgacggttacctaaagttaccgaaggttaaccgtacggtttaacggccggttacgttacccgttggttacccggttagtttaaacccggggtccggtacgggggtaaaccgaccccggtaaacggtcccggttaccggttaccccgttaccgggttaacggtccgtaacccgggtcccgtaaacccggttccgtaccccccggg

SEQ ID NO: 21058 - DNA, 196 bp, Homo sapiens
  misc_feature: GYAE6OF01D8CG2.49.53.E09.1.454.CMB.1.raw
  modified_base (181)..(196): a, c, t, g, unknown or other
  misc_feature (181)..(196): n is a, c, g, or t
tcagagtcgagagacacgaccggtgctcgatttagagagagtgtgttgggttgggggaagaggaagactgaccggtcccccaggagttcaggtgctgggcacagccggccctgggctgccctgggtacaaggactacttccgtctcgtcgactctgacgcggctggacaaggcgacatagnnnnnnnnnnnnnnnn

SEQ ID NO: 21059 - DNA, 174 bp, Homo sapiens; identical to SEQ ID NO: 20265
  misc_feature: GYAE6OF01EYD4V.49.53.E09.1.454.CMB.1.raw
  modified_base (173)..(174): a, c, t, g, unknown or other
  misc_feature (173)..(174): n is a, c, g, or t

SEQ ID NO: 21060 - DNA, 693 bp, Homo sapiens
  misc_feature: GYAE6OF01AXLBX.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgacggcctcctatgagctgacacgacgcccacccgtcggtgtcgtgtcgtcctcgaggacacggaccggccagtactccacctgccttcgtgggatagtcgcctagttcgaaccaaagctaattatcgtacttacgtacgtacagacgaacggacgccgacggaccgtccggtccctgtcgttagtacttaacttaaacgtttaagtaacggttacgttaggaacggtaccggtaccgtaccggaccggtacccgtaggtacgtacgtacgttccgtcgtcgcctacgcgcacgacgacgaacacgtacgtctacgtacgacgtagcgacgggtcggacggtacggacggaacggacggacgtacgtacgtaacgtacgttacgttcgtacgtacgtacgtacgtacgagtacgagttacggtcgttacgtcgttacgttacggttcgtacggttacgggtaccgggacgggtaaccggacggtacggtaccggtaccggttaccgtaccggtaccggacccgaccggtacccgaccggtcccgtccccg

SEQ ID NO: 21061 - DNA, 797 bp, Homo sapiens
  misc_feature: GYAE6OF01CSYEE.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgacggcctcctagtgagctgacacacgcccacccgtcggtgtctgtcgtcctcaggacagccggccagtactcaccgtgactcgtaggagatgctagttcgaccaaagctaaattatgtaccttacgtcggtaccagacaaggaacgccgacggcccgaccggtccccttgtccttgtacttcttaatttaaactaaaggttacgtttaggacggtaacgggtccgtaccggaccgggtacccctaggacgtccgttacttccgtcggtcgtccgtaccgtacgtcctacgaaccgtaccgaaaccgtaaacgtcgttaccgtacggttaccaacccgttattaccgggaccggggtaggtaccccggggtaccgggacgaaagggggtaccgggaaccggaaggtcccgttaacggaaacttttacgtaccgtttacggtacctacgggtccttaaacgaccggaaggttaaccgtaagggtttaccggtggttacccgttacggtttacggttcggtttaccggtaccggggtttaccggggaccggggtaaggaaacccccgtgggttaaccccgtcgggttaacccccggtcgttaaaccggcccggtaacccggtaccccggtaaccgggtccccggttaccccccgg

SEQ ID NO: 21062 - DNA, 705 bp, Homo sapiens
  misc_feature: GYAE6OF01C4D7L.49.53.E09.1.454.CMB.1.raw
  modified_base (226)..(226): a, c, t, g, unknown or other
  misc_feature (226)..(226): n is a, c, g, or t
  modified_base (269)..(269): a, c, t, g, unknown or other
  misc_feature (269)..(269): n is a, c, g, or t
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgaggcctcctatgagctgacacagccaccctcggtgtctgtcgtcctcaggacaggacggccagtactcacctgctcgtgganatgctatgaccaaaagctaaatatgtacttacgcggtacaganagaacgccgaggccgacggccccttagttcttgactactaatttaaataaacgtagttttaggaacggtacgggacctacggaccgggtaccccgttggaacgtcgtaacttccgtgtcggaccttccgaacgtcctacacgacgaaccaacgtacgtacgtaccgtagacctagtacgtaggtacggtacggtacggacgaggtacgggaacggtacggtaccgtacgtaacgttaacgttaccgtagtacgtagtacgtaagtaccgaggtaaaccgtagtacggtacgttactacgttcgttacggttcgtaaccgggtttcggggacgggttaaaccgggaaccgtaacggtcccgttaaccgggtaccccgtttaacgggttaccggaccggtaacccggacccgggttaaccgtcccggtaacccccggg

SEQ ID NO: 21063 - DNA, 811 bp, Homo sapiens
  misc_feature: GYAE6OF01CGLUV.49.53.E09.1.454.CMB.1.raw
  modified_base (184)..(184): a, c, t, g, unknown or other
  misc_feature (184)..(184): n is a, c, g, or t
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
tcagagtcgagagacacgaccggtgctcgatttagagagagtgtgttgggtttgggggtgggtccaggaggcagaactctgggtgtctcaccatggcctggactccctctacttcctccccctcctcactctctgcacagactctgaggcctcctatgagctgaacacacgccacacgtcggtntctgtcgtcctgaggacaggcgcagtacnccactgctcgtagganatgctagtcgaaccaaagacaatgtcgtaccttacgtacggtaaccagacaaggaacgccgacggccaccggtccctgtacttgtactattaacgtttaagtaaacgttcgtttaggacggtaccggcctacgggaaccggtacccgtaggacgtaacgttcgtttccgtccggtagtaccctaccgtacgtccgtaaccgacggtacccgaaaacgtaaacgttaccggtaacgttaaccgttaccggaaacctacggtaaccggtacggggttaaccggggtaccgggtacccggggaacggaaacggggtaaccggggacggaaccgggttacctaaggttaacctttaacgtttaccggtagttaacccgtacggtaaccgtaacgtaaccggaaacggtaacggttaacgggtacggtacgttacccgttacgtttccggttaccgggttaccgggttacggggtaccgggtaaccggggtaaccggaacccggtaacgttcccgggtaaccggtttaaccccgggtacggttaaccgtacccggaaccccggtacggggaacccgttacccccggg

SEQ ID NO: 21064 - DNA, 187 bp, Homo sapiens
  misc_feature: GYAE6OF01B7BG1.49.53.E09.1.454.CMB.1.raw
  modified_base (176)..(187): a, c, t, g, unknown or other
  misc_feature (176)..(187): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaaggactacttcctctctcgactctgagcgggctggcaaggcgcatagnnnnnnnnnnnn

SEQ ID NO: 21065 - DNA, 770 bp, Homo sapiens
  misc_feature: GYAE6OF01DVT45.49.53.E09.1.454.CMB.1.raw
  modified_base (184)..(184): a, c, t, g, unknown or other
  misc_feature (184)..(184): n is a, c, g, or t
  modified_base (229)..(229): a, c, t, g, unknown or other
  misc_feature (229)..(229): n is a, c, g, or t
  modified_base (266)..(266): a, c, t, g, unknown or other
  misc_feature (266)..(266): n is a, c, g, or t
  modified_base (620)..(620): a, c, t, g, unknown or other
  misc_feature (620)..(620): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggccctctatgagctgacacagcccctaccctcgggttntccgttgtcctcctaggaccgacgaacggccgactagtcctaccncgtctccgttggaggaatgcacttagacgaaacgaanactaatagtcgtcttaacggtaccgacgacgaagaacggccgtaccgacggacccgtaccggtcccctttgttagtacggttaactaaaccgttttaaagtttaaaacggtaaacggttttacggtaagggaaccggggtacccgtaccggtaaccccggggtaacccggtacccgtaggtaccgtcgtttactcccgttgtaccgtaccctcgtactacgacgtacgaacaacgactacgtacgtactacgcctagtaccgggtagggttacggaccgggtacggaagggaacggacgggtaacggtcgtacgttaagttaactttacgttcgacgtaacgtcgtataaccgngtaacgtaggtagtcgtcgtaccttgttccgttacgttacgggtaccgggtaacgggaccgggtaaccgtaaccgtacggtcggtacccccggtacgttaacggccggtaacccgtcccggaaaccgggtcccttcccggtacccccggg

SEQ ID NO: 21066 - DNA, 176 bp, Homo sapiens; identical to SEQ ID NO: 20768
  misc_feature: GYAE6OF01CC9YP.49.53.E09.1.454.CMB.1.raw
  modified_base (174)..(176): a, c, t, g, unknown or other
  misc_feature (174)..(176): n is a, c, g, or t

SEQ ID NO: 21067 - DNA, 795 bp, Homo sapiens
  misc_feature: GYAE6OF01CFHSR.49.53.E09.1.454.CMB.1.raw
  modified_base (234)..(234): a, c, t, g, unknown or other
  misc_feature (234)..(234): n is a, c, g, or t
  modified_base (255)..(255): a, c, t, g, unknown or other
  misc_feature (255)..(255): n is a, c, g, or t
  modified_base (601)..(601): a, c, t, g, unknown or other
  misc_feature (601)..(601): n is a, c, g, or t
tcagagtcgagagacacgaccggtgctcgatttagagagagtgtgttgggtttgggggtgggtccaggaggcagaactctgggtgtctcaccatggcctggactccctctacttcctccccctctcactctctgcacagactctgaggcctctatgagctgacacacgcccacccgtcggtgtctgtcgtccctacgaggacaggacggcctagtactccacgtgctcgtgganatgctattcgacaaagcaatntgtacttactcggtaaccagacgaagaacgtccgacggacccgtaccggtccccttacggtcttagtacttaccttaattttaaacgtaaacggttacgttttaggacgggtaccggtacccgttacccggaaccgggtaccccctaggacggtaccgttacgtttacccgtcgtccgggtaccttaccgaccgtacccgtacgaacgggtaccgaaaccgtaaacgtaccgttaaccgtaccggtttaccgaaccgttacgtacggtaacgggttacggggtacccgggtccgggaacgaacgggtacgggaacgggacgtacgtacgttaacgtagttaccgtntaccgtaagttcgactacgaacggtacgtacggtaacggtcgtaccgttaccgttcgtaggttaccggtaccgttacggggtaaccgggaccgggttaacgaaccggttcccgttaaacccgggtacccgttacccgggtacgttaacccgggacccgttaacccgggaacggttcccccgtaaccccccgggg

SEQ ID NO: 21068 - DNA, 793 bp, Homo sapiens
  misc_feature: GYAE6OF01B0SXY.49.53.E09.1.454.CMB.1.raw
  modified_base (229)..(229): a, c, t, g, unknown or other
  misc_feature (229)..(229): n is a, c, g, or t
tcagagtcgagagacacgaccggtgctcgatttagagagagtgtgttgggtttggggtgggtccaggaggcagaactctgggtgtctcaccatggcctggatccctctacttcctcccctcctcactctctgcacagactctgacggcctcctatgagctgacacagcccaccctggtgtctgtcgtccctgaggacagccggtccagtactcacctgcctgtggaatntcgactatttacggaccaaaaagctaaaatgttagacctttacgtacggtaaccagcaaggaacgccgaacggccgtaacggcccttggttctttagacttacctaattttaataaacgtacgttttagaacgggtacgggtacccttacggacgggtaccccgtaggtaacgtacggtacctttcgtcggttcggtaccgttacccgaggtacccttaccgaacggaaccgttaaccgaaaccgtaacgttacgttaaccggtttaccgaaccgtaagttacccgtaaggggttaccgggaaccgggttacccggggaaccgaaggggaaacgggaaccgggttacggaccggtaacgttaaccgtttaacgtttaccgttacggtacgtaacggttacaacgttaccggaacgtaacccgtagggacggttaacggtccgttaacgttcggttacggttacggtttaccggtaccggggacgggtaaccggaacacggtcgtacccggtaccgttaccgtacgggttacaaccgggtcccgaaagggtccccgttaccccgg

SEQ ID NO: 21069 - DNA, 174 bp, Homo sapiens; identical to SEQ ID NO: 20960
  misc_feature: GYAE6OF01A7FCQ.49.53.E09.1.454.CMB.1.raw
  modified_base (174)..(174): a, c, t, g, unknown or other
  misc_feature (174)..(174): n is a, c, g, or t

SEQ ID NO: 21070 - DNA, 641 bp, Homo sapiens
  misc_feature: GYAE6OF01A6KSX.49.53.E09.1.454.CMB.1.raw
  modified_base (188)..(188): a, c, t, g, unknown or other
  misc_feature (188)..(188): n is a, c, g, or t
tcagagtcgagagacacgaccggtgctcgatttagagagagtgtgttgggtttgggggtgggtccaggaggcagaactctgggtgtctcaccatggcctggatcctctacttctcccctcctcactctctgcacagactctgaggcctcctatgagctgacacagccaccctcggtgtctgtgtcctnaggacaggacggccagtatcacctgctctggagatgcattcggaccaaaagcaattatgtcttacgtcggtaaccagcaaggaagccgtacggaccgacgccccttgtctgactactatttaagtaaagtcgtttaggagtacgggcctacggacgggacccctggacgtcgtacttcctacgtcggctccacgtcctacgacgacgaacgaaccgtacgtaccgtacgtcgaccgtatacgaggtcgggtacggtaccgggacgaacggaggacgtaggacgtagtacgtttactactgtacagttcatccgtagacgtaggtagtcgacgttacttctggtttacggttacggttaccgggacgggtaacgggacccgaaggttcccgtaccgggttaccccgtacggttaccggacgaccgtaccccggtagggtccccgttaccccggg

SEQ ID NO: 21071 - DNA, 180 bp, Homo sapiens
  misc_feature: GYAE6OF01A357J.49.53.E09.1.454.CMB.1.raw
  modified_base (172)..(180): a, c, t, g, unknown or other
  misc_feature (172)..(180): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcggctggcaaggcgcatagnnnnnnnnn

SEQ ID NO: 21072 - DNA, 625 bp, Homo sapiens
  misc_feature: GYAE6OF01BVT5F.49.53.E09.1.454.CMB.1.raw
  modified_base (222)..(222): a, c, t, g, unknown or other
  misc_feature (222)..(222): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctgganatgctattgaccaaaagcaaattatgcttactggtaccagcaagaagccgacggccaacggcccctgtcttgatctaatttataaagtactttggagacgggcctacgacgggacccctgagcgattctcgtggcctcagctcacgcgacaacagtctacgttcgaacctatcaggtggacggtccgggcaaggacgggacgagggctagacgttattacgtcgttacgagtctatacgaagtaacgtaggtacggttcggccttaccgtttcgtacgtttacggttaccgttcgggggtaaccgggaccgggggtaacctaaacgggtccggttaccggtaacccgttaccgggttacggtaacccgaccggaccccggtaaccggcccggttaccccccgg

SEQ ID NO: 21073 - DNA, 295 bp, Homo sapiens
  misc_feature: GYAE6OF01ACFBD.49.53.E09.1.454.CMB.1.raw
  modified_base (216)..(218): a, c, t, g, unknown or other
  misc_feature (216)..(218): n is a, c, g, or t
  modified_base (220)..(295): a, c, t, g, unknown or other
  misc_feature (220)..(295): n is a, c, g, or t
tcagagtcgagagacacgaccggtgctcgatttagagagagtgtggtttggggtttggggggaagaggaagactgaccggtccccccagggagttcaggtgcgtgggcaacgaggccggtcccgtggggctcgccgtggtacgaaaggtaccttaccttccctctctacgtactcgaggcggccggtcgtacggaacggtaacggcgactaagtgnnntnnnnnnnnnnnnnnnnnnnnnnnnnnnnnnnnnnnnnnnnnnnnnnnnnnnnnnnnnnnnnnnnnnnnnnnnnnnn

SEQ ID NO: 21074 - DNA, 198 bp, Homo sapiens
  misc_feature: GYAE6OF01DIPEI.49.53.E09.1.454.CMB.1.raw
  modified_base (175)..(175): a, c, t, g, unknown or other
  misc_feature (175)..(175): n is a, c, g, or t
  modified_base (181)..(183): a, c, t, g, unknown or other
  misc_feature (181)..(183): n is a, c, g, or t
  modified_base (185)..(198): a, c, t, g, unknown or other
  misc_feature (185)..(198): n is a, c, g, or t
tcagagtcgagagacacgaccggtgctcgatttagagagagtgtgttgggtttgggggaagaggaagactgaccggtccccccaggagttcaggtcgctgggcacagccggccctgggctgcctggtcaaggaccttacttcctctctcgactctggagcgggctggcaagggcncaatgnnncnnnnnnnnnnnnnn

SEQ ID NO: 21075 - DNA, 172 bp, Homo sapiens; identical to SEQ ID NO: 20291
  misc_feature: GYAE6OF01DWHR6.49.53.E09.1.454.CMB.1.raw

SEQ ID NO: 21076 - DNA, 178 bp, Homo sapiens
  misc_feature: GYAE6OF01BC1N7.49.53.E09.1.454.CMB.1.raw
  modified_base (174)..(178): a, c, t, g, unknown or other
  misc_feature (174)..(178): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnn

SEQ ID NO: 21077 - DNA, 889 bp, Homo sapiens
  misc_feature: GYAE6OF01DZ334.49.53.E09.1.454.CMB.1.raw
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgacggcctctatgagtctgacacacgccctacccgtggtgtctgtctcctgagacaggaccggccaagtatccgtacctgctcgtagganagtcgctagttcgaccgaaagntaatatcgtacttacgtacggacagacgaagaccgccgaacggcccgaccggtccccttgttcgtttaggtactttaacgttaattttaaacgtaaacgtttacgttaggtaacgggtaccggtcccgtaaccggaaccccgggtaacccgtggaacggtaccgttccgttcgtaccggtcgtcctaccggtacgtacgtaccgaacgtaacccgaactaaaccggttaccgttaaccgttaccggttaaccgaacgttacgtaaccgggtagggtaccgggtaccggggtacccgggaacggaacgggtacggggtaaaccgggtcgggttacgttaacccgggtaaacttttaccgtttacggtccgtagtaccggttacaacggtacgtaaccgtaagggttaacggtttaacggtccggtttaccgtttacccgtttacgggttaacggtttacccgggtaaaccggggttaaccccgggggtaaccgggggtaaccgggtaaaacccccggtcgggttacccccggttaacccggttaaccccgggggtttaacccgtaaccgggttaaccccgggaaccccgggttacccccggttaaaccccgggtcccccgtttccccccccgggg

SEQ ID NO: 21078 - DNA, 741 bp, Homo sapiens
  misc_feature: GYAE6OF01CJF9Z.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacacgcccacccgtcggtgtctgtcgtcctcgaggacacgaccggccagtactccacctgcctcgtggagatgactagttcgaaccaaagctaatagtgtacttacgtcggtaccagacaagaacgccgacggccgacggtcccctgttctgacttcttaagtttaataaagtcgtttaggacggtcggtcccgtacggaaccgggtcccgtaggtacgacgttacttcgtccgtcggtccctacctacggtcctacgacggaccgaaacgaacgtacgtacccgtacgttaccgaacccttaacgtcggacgggtacgggtaccgggtacccgggtaacgaacggggaacgggaccggacggtacgttaaacggtacctttacgtttacgtacgttacgtaacgttacacgttaacgaacggtacgtaagggttcgtacgtaccttacgtttcgttacggttaccggttaccggtaccgggggtaacggtaccggaaccgttacggtcccgttacggtaccccgttaacggtccggtaaccggtacccgacccggtacggtcccccgtacccccgg

SEQ ID NO: 21079 - DNA, 200 bp, Homo sapiens
  misc_feature: GYAE6OF01BLAA8.49.53.E09.1.454.CMB.1.raw
  modified_base (176)..(200): a, c, t, g, unknown or other
  misc_feature (176)..(200): n is a, c, g, or t
tcagagtcgagagacacgaccggtgctcgatttagagagagtgtgttgggttggggggaagaggaagactgacggtccccccaggagttcaggtgctgggcacagcggccctgggctgcctggtcaaggactacttcctctctcgactctgagcgggctgggcaaggcgtcatagnnnnnnnnnnnnnnnnnnnnnnnnn

SEQ ID NO: 21080 - DNA, 187 bp, Homo sapiens
  misc_feature: GYAE6OF01CH1RV.49.53.E09.1.454.CMB.1.raw
  modified_base (172)..(187): a, c, t, g, unknown or other
  misc_feature (172)..(187): n is a, c, g, or t
tcagagtcgagagacacgaccggtgctcgatttagagagagtgtgttgggtttgggggaagaggaagactgacggtcccccaggagttcaggtgctgggcacagcggccctgggctgcctgtcaaggactacttcctctctcgactctgagcgggctggcaaggcgcatagnnnnnnnnnnnnnnnn

SEQ ID NO: 21081 - DNA, 656 bp, Homo sapiens
  misc_feature: GYAE6OF01DTY4N.49.53.E09.1.454.CMB.1.raw
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
tcagagtcgagagacacgaccggtgctcgatttagagagagtgtgttggggtttgggggtgggtccaggaggcagaactctgggtgtctcaccatggcctggatccctctacttcctccccctcctcactctctgcacagactctgacggcctctatgagctagacacacgcccaccgttggtgtctggtcgttacctcgaggacaggacggccaagtctcacctgctgtganagtgactagtcgaccaaagctaatntgtcttacgacgtacagacagacgccgacggccacggtccttgtcttacgattacttaatttaaagtaagtacgtttagggacggtacggtccgtacggacccggtaccgngacgcgtacttcacgtcgtcctacgtacnccgtagacgacaacgaacgtacgtaccgtacggttacgacgtagtacggacggttagggaaccggtcgggagaacgggaacgggacggacggtactacgtacgttaacttcgtgtactacgtactacgtacgagaccgttaggtacgtcgtaacttcgttaccgttgtacggttacggtccgggaagggtaccggaacggtacgcggttaccggtccgacgttacggacccgacggacccgtaggccctaacccccgg

SEQ ID NO: 21082 - DNA, 229 bp, Homo sapiens
  misc_feature: GYAE6OF01EZBV2.49.53.E09.1.454.CMB.1.raw
  modified_base (143)..(143): a, c, t, g, unknown or other
  misc_feature (143)..(143): n is a, c, g, or t
  modified_base (153)..(153): a, c, t, g, unknown or other
  misc_feature (153)..(153): n is a, c, g, or t
  modified_base (181)..(229): a, c, t, g, unknown or other
  misc_feature (181)..(229): n is a, c, g, or t
tcagagtcgagagacacgaccggtgctcgatttagagagagtgtgttgggttgggggaagaggaagactgaccggtcccccaggagttcaggtgcgtgggtcacgagtccggccctgggctgcctggtcaaggactacttccnctctcgactntggaggcgggctggcaaggcgctagtgnnnnnnnnnnnnnnnnnnnnnnnnnnnnnnnnnnnnnnnnnnnnnnnnn

SEQ ID NO: 21083 - DNA, 191 bp, Homo sapiens
  misc_feature: GYAE6OF01AMAJJ.49.53.E09.1.454.CMB.1.raw
  modified_base (176)..(191): a, c, t, g, unknown or other
  misc_feature (176)..(191): n is a, c, g, or t
tcagagtcgagagacacgaccggtgctcgatttagagagagtgtgttgggtttgggggaagaggaagactgacggtcccccaggagttcaggtgcgtgggcacaggccggccctgggctgcctggtcaaggactacttcctcgtagcactctgagcgggctggcaaggcgcatagnnnnnnnnnnnnnnnn

SEQ ID NO: 21084 - DNA, 649 bp, Homo sapiens
  misc_feature: GYAE6OF01EMJLU.49.53.E09.1.454.CMB.1.raw
  modified_base (232)..(232): a, c, t, g, unknown or other
  misc_feature (232)..(232): n is a, c, g, or t
  modified_base (335)..(335): a, c, t, g, unknown or other
  misc_feature (335)..(335): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaaccctcggtgtcctgtcgtcctgagacagaccggccagtactcgacctgctccgtggagatncattcgaccaaaagcaatatgtcttactggtaaccagacagaacgccgaggaccacggccccttgtcttgattactattttaaataaagtacgtttggaacgnggtcctacgacggaccctggacgcgtattcctgtcgcctccgagtctcgaacgaccgaacaacgacgtacgtaccgtgacctagtcgaggtcggtaccggcggacaagggaggaaccggtagggacttaccgtaatttactttaccgtacgtactacgtaactacgtacgaaaagttccgtaaggtacggtcgtactacccgtttagtcggttaacgttcgggtacgggaccggtaaacgggaccgacgtccggtaccggttaccggtaaccggtacgtaccaacccggttaacgtcccggtcccgtcccccgg

SEQ ID NO: 21085 - DNA, 721 bp, Homo sapiens
  misc_feature: GYAE6OF01BDJXW.49.53.E09.1.454.CMB.1.raw
  modified_base (236)..(236): a, c, t, g, unknown or other
  misc_feature (236)..(236): n is a, c, g, or t
  modified_base (542)..(542): a, c, t, g, unknown or other
  misc_feature (542)..(542): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacaggctctgacggcctctatgagctgacacacgcccacccgtggtgtcaggtcgtaccccgaggaccaggccggcctaggactcacctgctcgtaggganatcgactacgttaccgaaccaaaccgtagttagttcgtacgttttacgttacggtaaccaggacgaacggaacggcccggaccgaccggtccccgttggttcgttggtacgtagttagtaaagtaacgtaacgtacgtacggaacggtacccggccgtacggacggtacctccggagtacggtccttaacgttccgttcggtcggtcccgttacggaacggttaccgggaaacggtaacgtaccggtaccacgttacgttcgacctagtacgacggtgtaccgtaccggaggtacgaggaggacgngtactatagttaatcgttacgactagaccgaacgtacgaatacgtagttacggttattaggttcgtacgtcgtaacgtcggaccgtaaccgtacgttacccggtccgttcggtaaccggccgacggaaccccggaaccctaccccgtacccgtacgtacctcccgttaccgttaccccg

SEQ ID NO: 21086 - DNA, 767 bp, Homo sapiens
  misc_feature: GYAE6OF01EBD1L.49.53.E09.1.454.CMB.1.raw
  modified_base (253)..(253): a, c, t, g, unknown or other
  misc_feature (253)..(253): n is a, c, g, or t
tcagagtcgagagacacgaccggtgctcgatttagagagagtgtgttgggtttgggggtgggtccaggaggcagaactctgggtgtctcaccagtggcctggatccctctacttctcccctctcactctctgcacagactctgacggcctctatgagctgacacagccacccgtggtgtctgtagtcctgaggacaggaccggccagtactcacctgcttcgtggacgatgctagttcgacctaaagctaatntgtcttactcggtaccagcaagaacgccgacggccgacggccccttagtcttagattactaattttaagtaaacgtcgtttaggacggacggtcctacggaccgggtaccctggacgtcgtacttccgttcgcggtcctaccgacgtacgtaccgaagtacccgaaacgaacgtacggttaccgtaacggttttacgaacctaaggtttaccggaaggggttacgggtaaaccgggttcccggggaacgaaggggaaaccgggaaccgggttagggtcctaacgggttaactttaaacggttacgttcggtaaccgtaggtactaaacggtaccgaacggtaaccggtaaggttcgggtacggtaccttacggtttccgtcgggttaaccgttacgggtacccggggaccggggtaaacggtaacccgaacggttcccgttaaaccgggtcccggttaaccgtaccggtaaccggtaacccgaacccgggtaacgggtcccctaacccccgggg

SEQ ID NO: 21087 - DNA, 670 bp, Homo sapiens
  misc_feature: GYAE6OF01CTU34.49.53.E09.1.454.CMB.1.raw
tcagagtcgagagacacgaccggtgctcgatttagagagagtgtgttgggtttgggggtgggtccaggaggcagaactcgtgggtgtctcaccatcggcctggactccctctacttcctcccctcctcactctctgcacagactctgacggcctcctatgagctgacacacgcccacccgtggtcgtctgtcgtcctcgaggacaggaccggcctagtactccaccgtgtcctagtggagtatacgctattcggaaccaaaagactaatatcgtacttacgtacggacaaggacaagacgaccgacggccgaccggtccccgttgtccttagattactaatttaataacgttacgttaggaacgggacggtaccctacggaccgggtaccctaggacggtcgtacgttccgtcgttacggccttaccgacgtccacgaccgacgaaacaacgtcgtacgtacgtacactagacgtagggtcggaacgggtcggacgaagggacggacggacgtacgagttaacgttatacgtgtacgacgtactactcgaacgtacgtaggttaagccgtaactccgttgtacgtacgtaccgggtcgggaacgggaccgaggacgtccgtaccggtaccgttacgtacggcaacccgggtccaacggtccgtaccccgg

SEQ ID NO: 21088 - DNA, 177 bp, Homo sapiens
  misc_feature: GYAE6OF01B5ANQ.49.53.E09.1.454.CMB.1.raw
  modified_base (171)..(177): a, c, t, g, unknown or other
  misc_feature (171)..(177): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggctacttcctctctcgactctgagcgggctggcaaggcgcatagnnnnnnn

SEQ ID NO: 21089 - DNA, 177 bp, Homo sapiens
  misc_feature: GYAE6OF01BGKC3.49.53.E09.1.454.CMB.1.raw
  modified_base (175)..(177): a, c, t, g, unknown or other
  misc_feature (175)..(177): n is a, c, g, or t
tcagagtcgagagacacgaccggtgctcgatttagagagagtgtgttgggtttgggggaagaggaagactgaccggtccccccaggagttcaggtgctgggcacagcggccctgggctgcctggtcaaggactacttcctctctcgactctgagcgggctggcaaggcgcatagnnn

SEQ ID NO: 21090 - DNA, 787 bp, Homo sapiens
  misc_feature: GYAE6OF01COL95.49.53.E09.1.454.CMB.1.raw
tcagagtcgagagacacgaccggtgctcgatttagagagagtgtggttgggtttgggggtgggtccaggaggcagaactctgggtgtctcaccatggcctggatccctctacttcctcccctcctcactctctgcacagactctgacggcctcctatgagcctgacacacgccacccgtcggtgtctgtcgtcctcgaggacagaccggcagtactcaccgtgctcgtaggacgtattgacctattacggaaccaaaaggctaaagttacgttacgttaccgtttaacgtacggtaaccacgaacgaacggaaccggaccggaacggacccgtaccggtccccgttgttacgttacgtaacttaactttaaagttttaaacgtaaacgttacggttaacggaacgggtaccggtacccgtaaccggtacccggtacccgtaggtacgtccgttacttcgtcgtcgtaccgtacgacgtaccgtacgacgaccaacgtaacgtacgtaccgtacgtacgactacgtacggtacggtacgggaccggtacggagaacggtacggtacgtacgtacgttaacgtaacttacgttacgtcgtacgtacgtactaacgtacgtaacggtacgttacggtacggtaccgttacgttcgtttacggtacggttacggttacggtaccgggaaccgggtaacggtacgtaccggttcccggtaaccggttacccggttaccggtaaccggtacccggtacccggtaaccccggtccggttccccggtacccccgg

SEQ ID NO: 21091 - DNA, 730 bp, Homo sapiens
  misc_feature: GYAE6OF01ES2NJ.49.53.E09.1.454.CMB.1.raw
  modified_base (186)..(186): a, c, t, g, unknown or other
  misc_feature (186)..(186): n is a, c, g, or t
  modified_base (235)..(235): a, c, t, g, unknown or other
  misc_feature (235)..(235): n is a, c, g, or t
tcagagtcgagagacacgaccggtgctcgatttagagagagtgtgttgggttgggggtgggtccaggaggcagaactctgggtgtctcaccagtggcctggatccctctacgttcctcccctcctcactctctgacacagacttctggacggcctcctatggacgctgaacacagcccacctggtntctgtcgtacctcgaggaccaggacggccaagtctcacctgctctgganagtgactagtcgacctaaaggcaagtgtcgacttacgtggtaaccagcgaagacgaccgacggccgaacgccccgttgtcgtagtattaacctagtttaaataaaacggtcttttaggaaacgtcgggtaccttacgaccggggtaacccttggaacgtcggtaacttctcgtacggtcttccgaacgttccgaccaacgggacgaaacccctaaagtccgttaacctaccgggtttaacaaccccgtaattacgaacggtaggtaacccgggttcgggaaccaagggaaagacccgtaggtccgtaacgtaagttaacgttacgtcgtttaaccgacgttacgtaacgttacgaaccggtaagttaacgttaaggggtccgttacgttaacccgtttgtaaccggtttaacgggtttcggaacgggttacggggaaaccgtaccgaaaggtcctaccgtacggttaccagtccaacgtacgaacgccgtacccg

SEQ ID NO: 21092 - DNA, 709 bp, Homo sapiens
  misc_feature: GYAE6OF01EFQTN.49.53.E09.1.454.CMB.1.raw
  modified_base (160)..(160): a, c, t, g, unknown or other
  misc_feature (160)..(160): n is a, c, g, or t
  modified_base (184)..(184): a, c, t, g, unknown or other
  misc_feature (184)..(184): n is a, c, g, or t
  modified_base (439)..(439): a, c, t, g, unknown or other
  misc_feature (439)..(439): n is a, c, g, or t
  modified_base (489)..(489): a, c, t, g, unknown or other
  misc_feature (489)..(489): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctggagcctcctaatganctagacacacgcccacccgtggtntctggtctcctacgacggaccagaccggacagtactctaccgtgccttacgtagggatatcggactattcggaaccaaaagctaaatagtcgtaccttacgtacgtaaccgagcaaagaacgccgacggccgaccggtccccttgtctttgacttacttaaagtttagaaacgttcgttagggacgtacggtacctacggtaaccgggacctggacgtcgttaattccggtcgttaccggccttaccgacgtccngacgtacgaactaacgtcgtacgtacggtacaaccgtagcggtaacgggnggtaacccggggtacggacgaacgggacgggaccgtacggttacgtactaagttttaccgtcggttacgtctaaccgagttaaccgtacgaaggacgtttaggtcggttagcccttacgttgtacgttcgggtacgacgggggtaacgaccgggtaataccggtgccgtacccggttacgagttacccggaaccgtacggtcccgtccggtaccccccgg

SEQ ID NO: 21093 - DNA, 772 bp, Homo sapiens
  misc_feature: GYAE6OF01EYYF1.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgacggcctcctatgagctgacacacgcccacccgtcggtgtctggtcgtcctcgagggacaggacggccagtactcaccgtgctcgtggacgtatcgctattcgaaccgaaaagtcctaaattacgtcgtactttacgtacggtaaccagcgaagaacgccgacggtaccgacggtaccccgttgtcgtttacgacttacttaaattttaaacgtaaacgttaccgtttaggaacgggtaccgtaccgttacggacggtaccccgtagacgtcgtactttccgtacgtcggtaccctacgacgtcctaaccggaacgtaccgaaaccgtaacgtacgttaccgtaaccggtacgaacctagtacggaacgggtacggacgggtacccggaggaacggtacggacggtacggtacgtacgtaagtttaaccgttacgtgttaacctcgtaactacgttacgaacgaggttaaggtacgggttactaccgtttaccttggtttaaccgggttcggtttaaccgggaccggggaacgggttaacccggaaacgtaacgggtcccggtaacggttacccccgtaaggtaaccggtccgaacccgggtacccgtaacggtccccgtacccccggg

SEQ ID NO: 21094 - DNA, 666 bp, Homo sapiens
  misc_feature: GYAE6OF01D1DOR.49.53.E09.1.454.CMB.1.raw
  modified_base (230)..(230): a, c, t, g, unknown or other
  misc_feature (230)..(230): n is a, c, g, or t
tcagagtcgagagacacgaccggtgctcgatttagagagagtgtgttgggtttgggggtgggtccaggaggcagaactctgggtgtctcaccatggcctggactcctctacttctccccctctcacttctcgtgacacagactcgtgaggcctctatgagctgacacagcccaccgtggtgtctgtcgtcctacaggacagacggccaagtactcacctgcctcgtgganatgacctagttggaccaaaagcaaattagtcgtcttaacgtaggtaccagacaagaacgccgaggccaggcccccttgtcttagacttacattttaataaaagctttaggagagggccctacgacgggtaacccctgacgcgtattccgtcttcggccttccgagtccgtcacggacgaacaaactaggtactaacgttgaacctatcgaacggttggaacggtcccgggacgaaggaacgggacgaaggtcctaacggtacttaattaccgtagtactagttaccaagtcaaacgagaacgttaagtggacctacgtttcgtacgttacgtagttaccggggacgggtaacgggaacccaaggtccgtaacggtaacccgttacccggtaaggtacccaaccgggttaccccgaaaggggtcccttaaccccggg

SEQ ID NO: 21095 - DNA, 852 bp, Homo sapiens
  misc_feature: GYAE6OF01DDVFE.49.53.E09.1.454.CMB.1.raw
  modified_base (259)..(259): a, c, t, g, unknown or other
  misc_feature (259)..(259): n is a, c, g, or t
  modified_base (293)..(293): a, c, t, g, unknown or other
  misc_feature (293)..(293): n is a, c, g, or t
tcagagtcgagagacacgaccggtgctcgatttagagagagtgtgttggggtttgggggtgggtccaggaggcagaactctgggtgtctcaccatggcctggactccctctacttcctcccctcctcactctctgcacagactctgacggcctcctatgacgtcagaaccacacgccctacccgtcgggtgtcgttggtcgttcccacgaacggacgacggaccggacctagtactcctaccgtcgtcttagtaggganagtcgtactacgtacggaaccaaagactaaattncgttacttacgtacggtaaccagacgaaggaacgacggaccggcccgaccggtccttcgttctacgtacttacttaaatttaaagtaacgttaggttacggacgggtaccggtacccgtacgggacccggtaccgtaaggccgtacgtttacttcctcggtcggtacctaccgtcgaccgacgacgaacccgtaacgaacgtaccgttaacgtacccgtaacgaacctaacggtcgggtaacggggtacgggaaccggggtaccgggaaacgggaaacggggacgggaaaccgggtacggtacgttaacgttaaaccgtttacgttaacgttacgggttaacgtacggtaaacctaggtaaccctaacgggtaaacgtacgggtttaccggtacggttaacccgtttagtttacccggttacggtttaccgggttaccggggtaccgggggtaaaccgggaaaccgggtacccggtaacgtacccgggttacccggtaaccggttacccggtacgggtacccgaaaccggccccggtaaccggtccccgtacccccggg

SEQ ID NO: 21096 - DNA, 191 bp, Homo sapiens
  misc_feature: GYAE6OF01C2UMF.49.53.E09.1.454.CMB.1.raw
  modified_base (178)..(191): a, c, t, g, unknown or other
  misc_feature (178)..(191): n is a, c, g, or t
tcagagtcgagagacacgaccggtgctcgatttagagagagtgtgttgggtttgggggaagaggaagactgaccggtccccccaggagttcaggtgctgggcacagccggccctgggctgcctggtcaaggtactacttcctctctcgactctgagcgggctggcaaggcgacatagnnnnnnnnnnnnnn

SEQ ID NO: 21097 - DNA, 754 bp, Homo sapiens
  misc_feature: GYAE6OF01ARU2P.49.53.E09.1.454.CMB.1.raw
  modified_base (433)..(433): a, c, t, g, unknown or other
  misc_feature (433)..(433): n is a, c, g, or t
tcagagtcgagagacacgaccggtgctcgatttagagagagtgtgttgggtttgggggtgggtccaggaggcagaactctgggtgtctcaccatggctggatccctctacttctcccctcctcactctctgcacagtacctctgacggcctacctatggacgctcgacacgacgtcccaccgtcggtgtcgtgtcgtcctagacggacaggaccggcctagtactccaccgttcgacctcgtaggagactgacctagtacgacctaaagactaaatgtcgtacttacgtacggtaacacgtcgaacgtaacgccgtacggacctaccggtaccccttgttacttacggacttacgtaattttaaaggtaacgttacgtttacggaggtaccggcgtaaccgggaccggtacccgtagacgtcggtactttacncggtcggtaccctccgacgtaccgtaagaaccgtcgaaacctaacgtgtacccgtaacggtaagacctactacgggtagtacggggtctaccggggaacgagggtaacccggcggtacgggtaccttgtaaacgttattaccgtagttaccgtacttacgacgaacgttaccggaacgttaggttcgttccgtaaccggttactttccggtacggtttaccggtttacggaccgggggtaggaaaccgggttaagtaccgtcggtaaacccgttcgtaaccgttcggtaacccgaagggtacccctccgtcggtcccccgg

SEQ ID NO: 21098 - DNA, 742 bp, Homo sapiens
  misc_feature: GYAE6OF01BHRS4.49.53.E09.1.454.CMB.1.raw
  modified_base (177)..(177): a, c, t, g, unknown or other
  misc_feature (177)..(177): n is a, c, g, or t
  modified_base (223)..(223): a, c, t, g, unknown or other
  misc_feature (223)..(223): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctggaggcctctatgagctgacacagccaccctggtntctgtgtcctgaggacagacggccagtactcacctgctcgtggganatgctagttcgaccaaaagctaaatatcgtacttacgtcggtaaccagacgaaggaacgccgacggccacggtccccttgttctacgtattacttaattttaacgtaaagttacgttttggaacggtacgggtacccgtaccggaccgggtacccctagggacgtacgttacttcgtacgtcggtacctccgacgtcctacgaacggtaccgaaacaacgtacggtactaaccggttacgacctacgttacggtacggtacgggtacgggtacccgggaagaacgggtaagggaccggaggtacgtacggtaacgttacttaacgtcggttactacgttacaacgtacgtaacgtacggtaagtttacgtacggttactaccgttttcgttacggttaccggttacgggtaccggggtacggtaacggggaaccctaaccgggtcgtacccggggttaccgttaccggtaccgggttaccgaacccgggtacccgtaaccgggttcccgtacccccggg

SEQ ID NO: 21099 - DNA, 182 bp, Homo sapiens
  misc_feature: GYAE6OF01DWP0C.49.53.E09.1.454.CMB.1.raw
  modified_base (174)..(182): a, c, t, g, unknown or other
  misc_feature (174)..(182): n is a, c, g, or t
tcagagtcgagagacacgaccggtgctcgatttagagagagtgtgttgggtttgggggaagaggaagactgaccggtccccccaggagttcaggtgctgggcacagcggcctgggctgcctggtcaaggactacttcctctctcgactctgagcgggctggcaaggcgcatagnnnnnnnnn

SEQ ID NO: 21100 - DNA, 749 bp, Homo sapiens
  misc_feature: GYAE6OF01BMZA7.49.53.E09.1.454.CMB.1.raw
  modified_base (179)..(179): a, c, t, g, unknown or other
  misc_feature (179)..(179): n is a, c, g, or t
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgacggcctcctatgagctgacacagccaccctcggtntctgtcgtcctcgaggacagacggccagtatccacctgctctgganatgactattacgacctaaaagctaaagtctgtactttaacgtcggtaaccacgacaaggaaacncccgaacggcccgtaaccggtcccccttggttacctttacggaactttacttaaacgtttttaaagtaaaacggttaccgttttagggaaacgggtaccgggtcccgtaaccggaaccggggtacccctaggacggtacgttactttccgtcgtcgggcctaccgacgctacgacgaccgaacaacgtcgtacgtacgttacgacctagtccgaggtcggaacggtccggacgtaggacgggacgacggacgttacgaactttagttactacggttacacgttcaactacgaacgtacgtagggttacggtacggtaccttacggttcgtacggttaccggttacggtaccggggaacggtacccgggaacctaaacggtcccggttaaccggtaccccggttaacgttacgggcccctaaaccgggtacccgaacccgggtttcccggtaccccccggg

SEQ ID NO: 21101 - DNA, 185 bp, Homo sapiens
  misc_feature: GYAE6OF01EOV4K.49.53.E09.1.454.CMB.1.raw
  modified_base (173)..(185): a, c, t, g, unknown or other
  misc_feature (173)..(185): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctcgtagcactctggagcgggctggcaaggcgcatagnnnnnnnnnnnnn

SEQ ID NO: 21102 - DNA, 184 bp, Homo sapiens
  misc_feature: GYAE6OF01ARRWD.49.53.E09.1.454.CMB.1.raw
  modified_base (174)..(184): a, c, t, g, unknown or other
  misc_feature (174)..(184): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnnnnnnnn

SEQ ID NO: 21103 - DNA, 774 bp, Homo sapiens
  misc_feature: GYAE6OF01DEV5S.49.53.E09.1.454.CMB.1.raw
  modified_base (137)..(137): a, c, t, g, unknown or other
  misc_feature (137)..(137): n is a, c, g, or t
  modified_base (181)..(181): a, c, t, g, unknown or other
  misc_feature (181)..(181): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcanagtactctgacgcctctatgagctgacacgcgcccaccctggtntctggtctcctacgacggacacggaccggccaagtactccacctgcctgtaggantgcctagtcgaacctaaagcaattntcgtcttacgtacggtacagacaagacgacgacggccgacgtccctgtagttacattacgttaatttaacgtaagttacgttaggacggtacgggtcctaaggacccggtacccgtggtacggtcttaccgtttcgtcgtacgtaccgtccgacgtcccgtagaaccggaacgtaaacaacggttaacgtaccgttaaccggttaccgaaccgttacggtacggtaacggggtacggggtacccgggtcccgggaaagggaacggaccggggtacggaaccggtagttaacggtaacctttagtaccggttcgtaacccgtagttaactacgtaacggtaaacgagggtagtttaccggcgtttaaccttccgttacggtttacgggtacgttaccggggtaacggggacccggtaaaccgggtacgtaccggttccggttaaccccggaccgtttacgggtaacccgacccggtaaccggtacccccggaaggttcccccgtacccccgggg

SEQ ID NO: 21104 - DNA, 173 bp, Homo sapiens
  misc_feature: GYAE6OF01D9TU9.49.53.E09.1.454.CMB.1.raw
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatag

SEQ ID NO: 21105 - DNA, 777 bp, Homo sapiens
  misc_feature: GYAE6OF01EI3AT.49.53.E09.1.454.CMB.1.raw
  modified_base (284)..(284): a, c, t, g, unknown or other
  misc_feature (284)..(284): n is a, c, g, or t
tcagagtcgagagacacgaccggtgctcgatttagagagagtgtgttgggtttggggtgggtcaggagcagaactctgggtgtctcaccatggcctggactccctctacttcctcccctcctcactctctgcacagactcgtgacggtcccttcctagtgagtctagaccacgacgacccctacccgttcgggtgttccgttggttcgtcctagaacggacacggaccgaacctagtactcaccgttgtcttacgtggagtactgactagttcgaaaccgaaanactaaattcgttacgtacgttacgtacggtaaccgagacgaacgacgaccgacggaccgtaccgtcccgttacgttacgttagtacttactttaaacgtttaagttaacggttacggtttacggaacggtaccgggtaccgtaccggtaacccggtaccgtaggtaccgtacgttacgttccgtcgtccgtaccgtaccgtacgtacgtacgaaccgtaccgaaccgtaacgtacgttaccgtacgttaccgtaacgtagtacggagggtacgggtaccgggtacggaacgagggtaacggacggtacggtacgttacgtacgtttacgttacgttagtacgtacgtacgtaacgtagacggtagttagtacgtcgttacgttacgttcgttcggttacggttacgggtaccgggtacggtaccggtaggtacgtccgtaccggttacccggtacggtaccgtaccgaccggaccgtccggtcccggtccccg

SEQ ID NO: 21106 - DNA, 699 bp, Homo sapiens
  misc_feature: GYAE6OF01A8KV4.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctcgtggagatgctattcgacctaaaagcaaatatgtacttacgtggtaacccagacaagaacgaccgacggccgaccggtcccctgttcgttgatctaatttaagtaaagtacgtttgaggtacggcctacgacgggtacccctggacgcgtattcgtcgtcggtcctccgacgtcctccgaacggaccgaaaccaaacgtacgtaccgtaacgtttacgaacctacgttaccggtagggtcgggtacggtcccggggacgaacgggtaacgggaccggagggtacttacggtaacttttagtaccgttgtacgtactacagtacgagtaccgtaggttacggtacgtaccgttactttccggtgttaccggttaacggttccgggacggggtaaccgggtacccgacggtcccggttaccggtaaccccggttggttaacccggtcaacccgggacccggtaccggtcccggtccccccggg

SEQ ID NO: 21107 - DNA, 188 bp, Homo sapiens
  misc_feature: GYAE6OF01AYKX2.49.53.E09.1.454.CMB.1.raw
  modified_base (174)..(188): a, c, t, g, unknown or other
  misc_feature (174)..(188): n is a, c, g, or t
tcagagtcgagagacacgaccggtgctcgatttagagagagtgtgttggggtttgggggaagaggaagactgacggtccccccaggagttcaggtgctgggcacagcggccctgggctgcctggtcaaggctacttcctctctcgactctgagcgggctggcaaggcgcatagnnnnnnnnnnnnnnn

SEQ ID NO: 21108 - DNA, 205 bp, Homo sapiens
  misc_feature: GYAE6OF01EBYWH.49.53.E09.1.454.CMB.1.raw
  modified_base (173)..(173): a, c, t, g, unknown or other
  misc_feature (173)..(173): n is a, c, g, or t
  modified_base (179)..(205): a, c, t, g, unknown or other
  misc_feature (179)..(205): n is a, c, g, or t
tcagagtcgagagacacgaccggtgctcgatttagagagagtgtggttgggggtttgggggaagaggaagactgacggtccccccaggagttcaggtgctgggcacagccggccctgggctgcctggtcaaggactacttcctctctcgactctgaggcgggctggcaaggcncatagnnnnnnnnnnnnnnnnnnnnnnnnnnn

SEQ ID NO: 21109 - DNA, 733 bp, Homo sapiens
  misc_feature: GYAE6OF01AZUO0.49.53.E09.1.454.CMB.1.raw
  modified_base (225)..(225): a, c, t, g, unknown or other
  misc_feature (225)..(225): n is a, c, g, or t
tcagagtcgagagacacgaccggtgctcgatttagagagagtgtgttgggtttgggggtgggtccaggaggcagaactctgggtgtctcaccatggcctggatccctctacttctccccctctcactctctgcacagactctgaggtcctctatgagtctgacacacgccaccgtggtgtctgtcgtcctgaggcaggacgcagtctccactgtctcgtgggatntcgactattcgaacaaagtcaattcgtcgtaccttacgtacggtaaccagacaacgaacgcccgacggacccgtaccggtccccgttaggttcctttaggacttacgttaatttaacgtaaacgttcgttaggacgacggtcctacggacggtaccctggacgtcgtacttcggtacgtcgactaccgagtcctacgacgtacgaaacgtacgtagtacctacggtacaacctgtacggaggttacggaccgggtacggaacgtacgggacggacgacggttaccgtaagtaaccgtttagtacgttgtacaacggttctaacgtacggtaacggtaacgttacggtaaccgttggaccctttagttttccggttaaagggttcccgttaaggggtacccgggtaaacggggtaccgggtaacccgacggttccggtaacccgggttaccccgttacgggtaaccggtaccgaaccgggtacccgcgggttcccccgtaacccccggg

SEQ ID NO: 21110 - DNA, 180 bp, Homo sapiens
  misc_feature: GYAE6OF01DXG92.49.53.E09.1.454.CMB.1.raw
  modified_base (170)..(170): a, c, t, g, unknown or other
  misc_feature (170)..(170): n is a, c, g, or t
  modified_base (175)..(180): a, c, t, g, unknown or other
  misc_feature (175)..(180): n is a, c, g, or t
tcagagtcgagagacacgaccggtgctcgatttagagagagtgtgttgggttgggggaagaggaagactgaccggtcccccaggagttcaggtgctgggcacagcggccctgggctgcctggtcaaggactacttcctctctcgactctggagcgggctggacaaggcanatagnnnnnn

SEQ ID NO: 21111 - DNA, 824 bp, Homo sapiens
  misc_feature: GYAE6OF01AVV2Y.49.53.E09.1.454.CMB.1.raw
  modified_base (183)..(183): a, c, t, g, unknown or other
  misc_feature (183)..(183): n is a, c, g, or t
  modified_base (233)..(233): a, c, t, g, unknown or other
  misc_feature (233)..(233): n is a, c, g, or t
tcagagtcgagagacacgaccggtgctcgatttagagagagtgtgttgggtttgggggtgggtccaggaggcagaactctgggtgtctcaccatggcctggactccctctacttctccccctcctcactctctgcacagactctgacggcctcctatgagctgacacacgcccacccttggtntctgtcgtcctgaggacagaccggcagtactccaccgtgcttacgaggantgcctagttcgaaccaaagctaagtctgtactacgtacggtacagacgaacggacgtccgacggtacccgaccggtaccccttggttaccgtttagtacctttacttaaacgttttaagtaaaacggttcgttttaacgggtaacggacgggtacccttaaccgggaaccgggtaccccgttaggaccggttaaccgttacgtttccgttacggtccggtaccttacccgacgttcaccggtacgacccgaaacgtacgtaaccgtcgggtaacttccgtaaaccgtcgttacgggtacgggttacgggtaccggggtaccccggaagggtaccggaaacggggtcggaacccggtttagttacgtaaacctttcggttaccgttcgaaccgtacggtactacgaaggacgttaacggtacgttcggttagtaacccgttccgttggttacgttaccggggtttacctaacgggggaacccgggtaagggacccctttaagggtccccggttacccgggttaaacccggtttacccggttaacgggcccctaaacgggacccccggtacggggttccccctcccccggggg

SEQ ID NO: 21112 - DNA, 706 bp, Homo sapiens
  misc_feature: GYAE6OF01DX3ZM.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctcgtggagatgctattgaccaaagcaatatgctttacgtcggtaccagacaagaacgccgacggccgaccggccccttgtccttaggacttacgtttaatttaagtaaacgttacgtttaggacgggtacggtcccgtacgacccggacccgtggacgtacgttactttccgtacgtcgtcctaccgacggtcctacgacggacccaacgaaaccgtacgttaccgtaccggttactaaccgtacttaccggtaaggggttcgggaccggtccccggggagaacgggtaacggacggacggtcgtaacgttacttacgttacgttgtaccgtagtactacgtacgaacgaacgttaggtaggttcgaccttcgtttcgttcggttacgtacgggttccgggacgggtaaccggacggtacgtcggttaccggtaacccgtcggttacggacccggtacccggaaccggtaccggtcccgttaccccccggg

SEQ ID NO: 21113 - DNA, 181 bp, Homo sapiens
  misc_feature: GYAE6OF01B2AFV.49.53.E09.1.454.CMB.1.raw
  modified_base (174)..(181): a, c, t, g, unknown or other
  misc_feature (174)..(181): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggactactcctctctcgactctgaggcggctggcaaggcgacatagnnnnnnnn

SEQ ID NO: 21114 - DNA, 837 bp, Homo sapiens
  misc_feature: GYAE6OF01B1GFQ.49.53.E09.1.454.CMB.1.raw
  modified_base (158)..(158): a, c, t, g, unknown or other
  misc_feature (158)..(158): n is a, c, g, or t
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
tcagagtcgagagacacgaccggtgctcgatttagagagagtgtgttggggtttgggggtgggtccaggaggcagaactctgggtgtctcaccatggcctggatccctctacttctcccctcctcactctctgcacagactcgtgaggcctctatganctgacacagcccacccgttggtgtcgtgtcgtcctcgaggacagacggccagtactccacctgccgtntaggganatgctagttcgacctaaagctaatatcgtacttacgtaggtaaccaggacgaagacgccgacggcccgaccggtccccttgtcgtagtattacttaacgtttaaagtaaacgttacgttttaacgggaacgggtaccgggtacccgttaccggaacccggggtaccccgtaggacgtccggttaacgtttccgttccggtacggcccttacgcggtacgttaccgaacggacccgtaaactaaaccggtacgtaccgtaaccggtttacgaaaccgtacgttaccggtaaggggttacccgggtaacgggggttaccccgggaacgggtaacgggaacggggtaaaccggtacgggtaacggttaccggtaaacttttaacggttacccgttaggttaccgtaacgttacgtaactaccggtaacggaaccgttaagggttaccgggtcgtaccgttacgttacggttaccggttacggggttacggttacccggggggaggtaacccggggtaaacggtaccgggttacccgtaccgggttaacccgttaccggttacgggacccgtacccgggacccggtaacggtcccccggtacccccgg

SEQ ID NO: 21115 - DNA, 717 bp, Homo sapiens
  misc_feature: GYAE6OF01ESXE9.49.53.E09.1.454.CMB.1.raw
tcagagtcgagagacacgaccggtgctcgatttagagagagtgtgttggggtttgggggtgggtccaggaggcagaactctgggtgtctcaccatggcctggatccctctacttctccccctcctcactctctgcacagactctggaggcctcctatgagctgacacagcccacccgtggtgtctgtcgttcctcaggacaggacggccagtactcacctggcctcgtgggatagtcgactattcggaaccaaagacctaattatcgtactttaccgtacggtaacccagacgaaggaacgccgaacggacccgaccggtacccccgttgtcttaggacttactaactttaagtaaacgtacgtttaggaggtacgggccctacggaccgggtaccccctaggacggtacgtacttccgtcgtcggtccctaccggcgaccttacgacggtaccgaacctaacgtacgtacctacgttacgactacgtacgagggtacggtcgggtaccgggagaaggtacggacggaggtactggtaacttattaccgtgtacgtagtctatacgaacgagtagttacggtcgtaccgttacttcggtcggttaccgttacggtaccggggtacggaaccgggtaccgaacggttccggtaacccggtaccgttaccgggttaaccggcgtaacccggacccggtaacgtcccggtacccccccgg

SEQ ID NO: 21116 - DNA, 696 bp, Homo sapiens
  misc_feature: GYAE6OF01BHMPT.49.53.E09.1.454.CMB.1.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctggtgtctgtgtcctcaggaccagaccggccagtatccacctgcctcgtgganatgctattcgaccaaagcaatntgtacttacgtggtaccagcgaagaacgccgacggccgacggtccccttagttcgttagacttactaatttaacgtaaagttacgttttaggaaggtacgggtaccctacggtaccggggtacccccttagggaccgtccgtactttccgtacgtcgggcctccgacgtctacgacgtacgaaccaacgtacgtcgtaccgttacgacctattccgaggtagggtacgggtcccgggacgagggtacggaacggacgggtacgtacggtacttacttacgtgtactacgtactacgtacgaacggtaacgtacggttaggtcggtacctacgtttcgtcggttacgttacgggtaccgggacgggtacggggacccaacgggttccgacccggtacccgttaccggtacggtacccgaacgggtacccgtaccgggtcctcccccggg

SEQ ID NO: 21117 - DNA, 756 bp, Homo sapiens
  misc_feature: GYAE6OF01DZ5Q5.49.53.E09.1.454.CMB.1.raw
  modified_base (87)..(87): a, c, t, g, unknown or other
  misc_feature (87)..(87): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (608)..(608): a, c, t, g, unknown or other
  misc_feature (608)..(608): n is a, c, g, or t
tcagagtcgagagacacgaccggtgctcgatttagagagagtgtgttggggtttgggggtgggtccaggaggcagaactcgtgggtntctcaccatggcctggatccctctacttcctccccctcctcactctctgacacagacttcgtgacggtccctctatggatcctagacacacgccctaccctgggtntcttgtcgttccngaggacaggtaccgcctaagtctccactgctagtggatactgactagtacgaaccaaaggtctaaattcgttacgtaccgttacgttaccgggtaacccaggacgaaacggaaccggaccgaacggtccccgtaaccgggtccccctttggttccgtttaacgtactttaacgtttaaagttttaaagttaaaacggtttaccgttttacggggaacggttacccgggtaacccgttaccggggaacccgggtaaccccgttggaaccggtcttaacgtttctccggtcgttccgacctacggtccacggaaccgtaccaaacgacgtacgtacacgttacactacgtcgaggtaggccggtcggagaaggtacgcggagtctacggtacttacttacggtnttccgatacagtccaaggtaccgtagttacgtcgtacttccgtaggttcctaagggttccgtacggggaacggacgaaccggttgtaccggccggtttaaccgccgttaaacggacccgaggtaacccgtgtcccccggtaaccccgg

SEQ ID NO: 21118 - DNA, 183 bp, Homo sapiens
  misc_feature: GYAE6OF01B5957.49.53.E09.1.454.CMB.1.raw
  modified_base (176)..(183): a, c, t, g, unknown or other
  misc_feature (176)..(183): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgaggcgggctggcaaggcgacatagnnnnnnnn

SEQ ID NO: 21119 - DNA, 180 bp, Homo sapiens; identical to SEQ ID NO: 20243
  misc_feature: GYAE6OF01A1ZTQ.49.53.E09.1.454.CMB.1.raw
  modified_base (173)..(180): a, c, t, g, unknown or other
  misc_feature (173)..(180): n is a, c, g, or t

SEQ ID NO: 21120 - DNA, 775 bp, Homo sapiens
  misc_feature: GYAE6OF01A7VWF.49.53.E09.1.454.CMB.1.raw
  modified_base (197)..(197): a, c, t, g, unknown or other
  misc_feature (197)..(197): n is a, c, g, or t
  modified_base (241)..(241): a, c, t, g, unknown or other
  misc_feature (241)..(241): n is a, c, g, or t
tcagagtcgagagacacgaccggtgctcgatttagagagagtgtgttggggtttgggggtgggtccaggaggcagaactcgtgggtgtgtcaccatggcctggactccctctacttcctccccctcctcactctctgccacacgactcgtgacggtcccttctagtgagctacgacacacgccctacccgtcgggtnttctcgtccgtcctcgaggacacggaccggcagtactccactcnctcggtggagtatcgactagttacgaaccaaaagtactaattcgtacgttactttacgtaccggtaccacgacgaacggaacgccgacggccgtaccggtcccttgtcttagtacttacttaactttaacgtaacgttacgttacggaacggtaccggtaccgtaccgggaccggtaccgtggacgtccttacgtttccgtcgtcggtcctaccgagtcctacgacgtaccgaacctacgtacgtaccgtacggtacctactagtacgggacgggtacgggtaccgggtacgggacggaacgggtacgggtaccggtacggtaccgttaacgttaaccgtttagttaccgagttaccgaccgtacaacggtaccgaacggtaaccggttagggttcgtccgttacttacggtttcgtacgggttaccgggttaccgggtaccggggtaacgggtcccgtaacgtaccggtccgtaccggtaccggttaccggtaacggcccggtaaccggtacccgtccgggtcccgtccccgg

SEQ ID NO: 21121 - DNA, 830 bp, Homo sapiens
  misc_feature: GYAE6OF01EC7F4.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacaggacggccagtatcacctgctctggagatgccattcgaccaaaagacaaatagttgtactttaacgttcgggtaacccaagaccaaggaaacggacccgaacgggccccgaccgggccccccgtttgttccgtttaggactttacctaatttttaaagttaaaagtacgttttaggacggtaacgggcccgtacggaccgggtaccccgtagacgtacggtactttcctcgtcggtcctaccgacgtctcgacgaccgaactaacgtacgtaccgtacgttacgaacctatacgagggtggtacgggtaccccgggtagaacgggtaacgggaccggacgggtccgttaacggtaaccgtttaacgttttaccgtaggttacccgtaagtttaccgaacgttaaccgaacggtaaaccggttagggttaacggttaccgggtacccttaccgttttaccggttagtttacccgggtttaacggggttaccggggtaccggggggtaaacggtaaccccggtaacgggttccccggtaccccgggttaacccgggttaccccgggtttaaacgggttaccccgaaacccgggtaacccccggtaaaccgggttccccccggttaacccccccggg

SEQ ID NO: 21122 - DNA, 181 bp, Homo sapiens
  misc_feature: GYAE6OF01EEUZE.49.53.E09.1.454.CMB.1.raw
  modified_base (178)..(181): a, c, t, g, unknown or other
  misc_feature (178)..(181): n is a, c, g, or t
tcagagtcgagagacacgaccggtgctcgatttagagagagtgtgttgggtttggggggaagaggaagactgaccggtccccccaggagttcaggtgctgggcacagcggccctgggctgcctggtcaaggactacttcctctctcgactctggaggcgggctggcaaggcgcatagnnnn

SEQ ID NO: 21123 - DNA, 538 bp, Homo sapiens
  misc_feature: GYAE6OF01ERYBW.49.53.E09.1.454.CMB.1.raw
  modified_base (190)..(191): a, c, t, g, unknown or other
  misc_feature (190)..(191): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (228)..(230): a, c, t, g, unknown or other
  misc_feature (228)..(230): n is a, c, g, or t
  modified_base (232)..(232): a, c, t, g, unknown or other
  misc_feature (232)..(232): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (302)..(303): a, c, t, g, unknown or other
  misc_feature (302)..(303): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (393)..(394): a, c, t, g, unknown or other
  misc_feature (393)..(394): n is a, c, g, or t
  modified_base (398)..(398): a, c, t, g, unknown or other
  misc_feature (398)..(398): n is a, c, g, or t
tcagagtcgagagacacgaccggtgctcgattttagagagagtgtgggttgggttggggggaagacggaagactggacggtccccccaaggtagtttcaggtgctgggcacagcgcctggctgcctggtcaaggcttacttcctcgtctcgactcgtggaggtcgggtctggcaaggtcgtacagtacgnngacgntgntcagcgtnagtcgnggatcngatggtccnnntnatgncatctcgancctgacttaagcttagccttggcccnactgngnggtcgntgacggtngaacactngnnggttnagnaccgttancctncgaancacacgtttangatttggcttanacccgnttagggnaccgngtttatacccganacncgagtttnntacngactagatagtacgacgacgtacgcgtagagtacgacgcgtacgtacgtagtacgtacgtactcgtacgtacgtacgtacggtacggtacgacggtcgacgtacggtaccggtccgtacgtacgtacgtcgtaccgtacg

SEQ ID NO: 21124 - DNA, 688 bp, Homo sapiens
  misc_feature: GYAE6OF01B8HHC.49.53.E09.1.454.CMB.1.raw
  modified_base (182)..(182): a, c, t, g, unknown or other
  misc_feature (182)..(182): n is a, c, g, or t
  modified_base (219)..(219): a, c, t, g, unknown or other
  misc_feature (219)..(219): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggccctcctatgagctgacacagcccaccctcggtntcctgtcgtccctcgaggacaggaccggaccagtacnccacctcgtcctcgtggacgtagtcgactagttacgaaccaaaacgctaaattagttcgtacctttaacggtacggtaccacgacgaagaacgccgacggcccgtaccggtccccctgttaccttgtacttacttaatttaaacgtaaaggttaccgtttaggacgggtaccgggtcccgtacggacccgggtaccccgtaggacggtccgttacttccgtcgtacggcctaccgacgcctacgagaccgtaactaacgtcgtaacgtacgtacacctagtacgaggtcggacgggtaccggacgagggacggacggtagtaccgtagtacgttaactcgtagttccgattacaagtacgaagtacgtagtacgtcgtctacgttgtacgtacgttggcccgggagggaccgtacgtacgcgtccgtaacccgtggtaccgaccgaccgtaccgaccgtcccgtccccg

SEQ ID NO: 21125 - DNA, 179 bp, Homo sapiens
  misc_feature: GYAE6OF01CKH9F.49.53.E09.1.454.CMB.1.raw
  modified_base (173)..(179): a, c, t, g, unknown or other
  misc_feature (173)..(179): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctctctcgactctgacgcgggctggcaaggcgcatagnnnnnnn

SEQ ID NO: 21126 - DNA, 802 bp, Homo sapiens
  misc_feature: GYAE6OF01ED70A.49.53.E09.1.454.CMB.1.raw
  modified_base (87)..(87): a, c, t, g, unknown or other
  misc_feature (87)..(87): n is a, c, g, or t
  modified_base (164)..(164): a, c, t, g, unknown or other
  misc_feature (164)..(164): n is a, c, g, or t
  modified_base (749)..(749): a, c, t, g, unknown or other
  misc_feature (749)..(749): n is a, c, g, or t
tcagagtcgagagacacgaccggtgctcgatttagagagagtgtgttggggtttgggggtgggtccaggaggcagaactcgtgggtntctcaccatggcctggactccctctacttcctccccctcctcactctctgcacagactcgtggacggtcctactagnggacgtctaggaaccacgaccgcccctacccgttgggtctcttacggtcttaccctagtaacgacgacggacccggtacctaagtacctacccgccgtgtcgtacggtagggaactgtcggaacttacgtaccggaaaccaaaaggccttaaaaggtacttcggttacgttaacggacggtaaccgagacggaacggtaaccgccggtaacggccccgtaccggttccccgttagttaccgtagtaaccttaagttttaaacgttaaacgttaaacggttcggtttaacgaccggggttaccggccgtaaccggtaccggtaccgtaggaccgttcgtctttacggtccgtcggtaccgtacgaccgtccgtacggaacggtaccaaacgtacgtccgttacgaacgttacacgtacgtacggtacggggttacggaccgggtacggaacggaacgggacggtaacggcggtaactacggtatttaccgtgtacgtagtacctatacgtaacgacgtacggtacgtacgtcgttaccgtcgttagttacggtggtaaccgggtcggacgggtacacggtaccggngttccccgaggtacccgtaggaccccgtagacccggtccgcccgttaccccgg

SEQ ID NO: 21127 - DNA, 962 bp, Homo sapiens
  misc_feature: GYAE6OF01C27WB.49.53.E09.1.454.CMB.1.raw
  modified_base (136)..(136): a, c, t, g, unknown or other
  misc_feature (136)..(136): n is a, c, g, or t
  modified_base (142)..(142): a, c, t, g, unknown or other
  misc_feature (142)..(142): n is a, c, g, or t
  modified_base (162)..(162): a, c, t, g, unknown or other
  misc_feature (162)..(162): n is a, c, g, or t
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
tcagagtcgagagacacgaccggtgctcgatttagagagagtgtgttgggtttgggggtgggtccaggaggcagaactctgggtgtctcaccatggcctggatccctctacttcctccccctctcactctctgcanagctcngacgtcctctagcgagctanacacacgcctaccgtggtctctgttctcctcgagacaggtaccgctagtactccacgtncttcgtagggatactcgatacgttaacgaacctaaanactaaagtcttacgttaccgttaacgttacggaaccacgaacgaaacgtaaaccggcccgaaaccggaccgtaccccgtcccgttggttacctttaagttactaacctttaaagttttaaaaacgtacgggtttaacgttaggggaaccggggtaccggtaccccggtttaaccgggaaccccgggttaacccgtacgggtaccgttaaccgttcgtttaccgcgggtttcccgtacccgttacccgacggttaccctaccgtaaacggaacccgtaaaaccggtaacgtaaccgtttaccggtaccgtaacgtaacccttaacgggtaaccggtttacggggaccgggttacgggggtaaccccgggaacgggtaagggaaacccgggtacgggtaaccggttacggttaaccgggtttaaaccttacgtttaccggtaacgtacgttaacggttaacctaacgtaccggttaacggtaacgttaacggggttaccgtacggttaccgtttacgggttttcggttaaccgggtttaacgggtttccggttaaccgggggtaccggggtaaaacccgttaacggggtcccggttaaaacggttacccccccggggtttaaaggtacccccgggttaaaagggttacccccgggtaaaccgtaaaccccggggttcccccgttacccggggttaaccccccccgg

SEQ ID NO: 21128 - DNA, 183 bp, Homo sapiens; identical to SEQ ID NO: 20745
  misc_feature: GYAE6OF01AN4IG.49.53.E09.1.454.CMB.1.raw
  modified_base (173)..(183): a, c, t, g, unknown or other
  misc_feature (173)..(183): n is a, c, g, or t

SEQ ID NO: 21129 - DNA, 874 bp, Homo sapiens
  misc_feature: GYAE6OF01E31QN.49.53.E09.1.454.CMB.1.raw
tcagagtcgagagacacgaccggtgctcgatttagagagagtgtgttgggtttgggggctctgggagaggagcccagcactagaagtcggcggtgtttccattcggtgatcagcactgaacacagaggactcaccagtggtagtttgggctgagtcgttgggttttcctcgttgtcttacttttaaggaggttcgtcctagttcggtcgtagggtgacgtagttaacggtgggtacgggttcgggggattcggtggtcgggtcccggtaccggtgggaccggttccccgttaggacgtaccgttccttccgttggtacgccgtaacgtcccgtacggtacttacgtaaccggttacggtaaacttcgtcggtaccttacgtaccggtccgggtaccccgccggtacgggtccctaccggaacggggtcgggtaaccgggggttccgtagggggtaacgggttcggggttcgtacgtttagttttactacgtagttacgtagttacgttaacgtaagttagttagtacgttacggttacgacgtaacggtacccgttaacgggttaaccggcgtacttaccccgactaccgttaaccgtacgtaacggaacgttaaaccgtaaacctaaccgtaaaccgtaaccgtaacccgtatttaaccgtacgtaacgtaacgttaaccgtaacgtaaccaacgtaccgtaacggaagtaccggtacgaacgggtaaccggttacgtaccggttagttcggttaaagtttcgttaccggttagttaacgggtacgtttaaaggttacggtttaaggtacggttaaaggttaacgttttaacgggtttacggtttaaccgttaggtttaacgtacgttaacgg

SEQ ID NO: 21130 - DNA, 172 bp, Homo sapiens
  misc_feature: GYAE6OF01EVR6O.49.53.E09.1.454.CMB.1.raw
tcagagtcgagagacacgaccggtgctcgatttagagagagtgtgttgggtttgggggaagaggaagactgacggtccccccaggagttcaggtgctgggcacagcggccctgggctgcctggcaaggactacttcctctctcgactctgagcgggctggcaaggcgcatag

SEQ ID NO: 21131 - DNA, 727 bp, Homo sapiens
  misc_feature: GYAE6OF01EN6MV.49.53.E09.1.454.CMB.1.raw
  modified_base (225)..(225): a, c, t, g, unknown or other
  misc_feature (225)..(225): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtactcacctgctcgtgganatgctattcgaccaaagcaattatgtaccttacgtcgtaccagacaagaacgccgaggcccacggtccccttgtccttagacttacttaatttaaagtaaacgttacgtttaggaggtacgggtccctacggaccggtaccccgtagacgtcgtacttcctcgtcgtcctccgacgtcctacgacgtaccgaaacctaacgtacgttacctacggttacgaaccgtacgtaccggtagggtcgggtaccgggtacccgggaacgaagggtaacgggaaccggtagggtacctacggttaaccttaacgtttaccgttacgttaacgtacgttacaacttacgaacggtaacggttaacggttcggtacggttaccgttaccgttacgttacggttaccggttacgggttaccgggaccgggtaacgggaaccgtacggtccgtacccggtaccgttacccggtacgtacccgaccgtacccggtaacgtcccgttaccccgg

SEQ ID NO: 21132 - DNA, 183 bp, Homo sapiens
  misc_feature: GYAE6OF01CHVLY.49.53.E09.1.454.CMB.1.raw
  modified_base (173)..(183): a, c, t, g, unknown or other
  misc_feature (173)..(183): n is a, c, g, or t
tcagagtcgagagacacgaccggtgctcgatttagagagagtgtgttgggtttgggggaagaggaagactgacggtcccccaggagttcaggtgctgggcacagcgccctggctgcctggtcaaggactacttcctctctcgactctgagcgggctggcgaaggcgcagtagnnnnnnnnnnn

SEQ ID NO: 21133 - DNA, 883 bp, Homo sapiens
  misc_feature: GYAE6OF01CJZZU.49.53.E09.1.454.CMB.1.raw
  modified_base (87)..(87): a, c, t, g, unknown or other
  misc_feature (87)..(87): n is a, c, g, or t
  modified_base (200)..(200): a, c, t, g, unknown or other
  misc_feature (200)..(200): n is a, c, g, or t
tcagagtcgagagacacgaccggtgctcgatttagagagagtgtgttggggtttgggggtgggtccaggaggcagaactcgtgggtntctcaccatcggcctggactccctctacttcctcccctctcactctcgtgcacagactctggacggtccctactagtcggagtctagacacgtcgcccctacccggttggttntccgttggtaccgttcccgaggaaggtaccacgggtacccggcctaagtacctcccgtaacgtggtaccttcggtaagggactatcgtaccttagttaccggaaccgaaaagcgttaaagttcgtcggttaacctttacgggtaccgtaacccgaggtaacaacgggaaccgtccgaaccggacccgtcccggtccccttaggttactacgtaactttaacgttaaactttaaacgtaaacggtacgttagggacgggtccggtaccctacgggacccggtacctaggacgttctacgtcgtcgtcggtaccacggaccgttcaacgtaggaacctaaacgtaacggttcggttaaacctacgggttacgaaacccgttacggtacggtaccggggttacggggaccgggttaacccggaacgggaacggtaacggggaccgttcgggtaaaccgttcgttaaacttacggttacgtacgtaacggtctttaacgacgttaaacgaggtaacgggtttaaaggccggttcgtacgtttacccggtttacggtccgggttacgggtttaccggacccgggggacggtaaccgggtaacccgtacggtaccccggttacggtaccccgttaacggaccgggtccccgtaaaccggggcccctaaccgggtttccccacccccggg

SEQ ID NO: 21134 - DNA, 931 bp, Homo sapiens
  misc_feature: GYAE6OF01D7N7J.49.53.E09.1.454.CMB.1.raw
tcagagtcgagagacacgaccggtgctcgatttagagagagtgtgttgggtttgggggtgggtcaggaggcagaactctgggtgtctcaccatggcctggatccctctacttcctcccctcctcactctctgcacagactctggacggcctctatgagctgacacacgccacccgttcggtgttctggttcgtcctacgacggtaacacggtaccggacctaagttactacctaccgttcggccttcggtaacggggataacgttcggtaaccttaggtttaaccggaaaacccgtaaaaggtacctaaaatttaccgttacgttaaccgttttaacggttaccggtaaaccgtaacggaaccgaaacggtaaccggaacccggaccgggtaccccggtaaccccggggttccccgttttacgttaccggttttaacggtaaccgtttaacgtttaaaacgttttaaaacggtttaaaaacgggtttaccggttttaggggaaacgggtacccggggttaccccgttaacccgggaacccgggttaaccccggtagggtaaccgtaccggtttacgtttaccgtttaccggtcgttacccgtaccgtacggtccgttaacggaccgttaaccgaaaaccgttacggtaaccgtttaaccgtacggtaacctaaccgttacgttaaccgggtacggggtacggtaaccggggtcccgggaaacgtaacggggtaacgggaaccggtacgggtacgttaaccgtaacgttttacgttacgtcgttacgtaatacgataccggaacgtagttaacggtacggtacgtacctttgttcggttacgttacggttacggtagggtaccgggaagtaacgcgttccggacgttacccggtacgtaccggacgaacccgcgggtcctccggtaccccgg

SEQ ID NO: 21135 - DNA, 863 bp, Homo sapiens
  misc_feature: GYAE6OF01BSXX1.49.53.E09.1.454.CMB.1.raw
  modified_base (85)..(85): a, c, t, g, unknown or other
  misc_feature (85)..(85): n is a, c, g, or t
  modified_base (190)..(190): a, c, t, g, unknown or other
  misc_feature (190)..(190): n is a, c, g, or t
  modified_base (304)..(304): a, c, t, g, unknown or other
  misc_feature (304)..(304): n is a, c, g, or t
tcagagtcgagagacacgaccggtgctcgatttagagagagtgtgttgggtttgggggtgggtccaggaggcagaactctgggtntctcaccatggcctggactccctctaccttcctccccctccctcacctctctgcaacacgtactcgtggacggtcccttcctagtgaacgctagaccaaccaccncccctacccgtggttctctgttcgtcctcggaacggaacacgggaaccggtacctaaggttactacctcccgtgtcgtacggtgaacgtctcggtctagtaccgaacgaaacgntaaatcgtcgttaccttacgttacggaacctgacaaacggacgacccggtacgacccgccccgggttccttcggtacttacgtacttacgttaaagttttaataaacggttaacggtttgggaacgggtacccggtaccgtaaccgggaaccccggttaccgttaggaacccgttcgtttaacctcccggttggtaccccgtcccttaacgtccccggtaacctacggaacccgtaaacccgtaacgaaaacggttcccgttaaaccggttccgttaaaccgaaccgtccgtaaaccgggtcggggtaccgggtaacccgggtaccgggaaacgggtaaccgggaacgggtaacggtacggtaaccggttacgttaacgtttcgttaacgttccgtacgtcgtaacgttagaacgtacgtaacgttcggtaccggtcttacgttgtttccgttcggttacggttaccggtacgggtaacccgggcggtaaccgtacggtacccgtacgtacccgttaccgtcggacccgaacgaccggtcccggtcccgttacccccgg

SEQ ID NO: 21136 - DNA, 757 bp, Homo sapiens
  misc_feature: GYAE6OF01AX5H1.49.53.E09.1.454.CMB.1.raw
  modified_base (115)..(115): a, c, t, g, unknown or other
  misc_feature (115)..(115): n is a, c, g, or t
  modified_base (183)..(183): a, c, t, g, unknown or other
  misc_feature (183)..(183): n is a, c, g, or t
  modified_base (271)..(271): a, c, t, g, unknown or other
  misc_feature (271)..(271): n is a, c, g, or t
tcagagtcgagagacacgaccggtgctcgatttagagagagtgtgttgggtttgggggtgggtccaggaggcagaactctgggtgtctcaccatggcctggatccctctacttcncccctcctcactctctgcacagactctgaggcctcctatgagtctgacacacgccctacccgtcggtntctgtcgtcctcgaggacaggaccggccagtactccacccgtgccttcgtgggagtatcgcctagttcgaaccaaagtacctaaattntacgtaccttaccgtacgggtaacccaggaccgaaggaacggacccgaacgggtcccgacccggtcccccgttggtttcgttagtaacttacgttaaacgttttaaagtaaacggttacgtttagggaaccgggtacgggtacccctacgggacccgggtaccccgttaggacgtaccgtacgtttcgtcgtccggtcctaccgtacgccgtaccgacggaccgaaaccgtaactacgttacccgttacggtaccgaaccgtagtacggacggggttacgggaccgggtcccgggaaccgagggtaacgggacgggtacggcttaacggtacctttaagtccgttagtacctagtactacgtacgaacgtacgtaggtacgtcgtacttacgtcttaggtcggttacgtcggggacggtacggacctacggtccgtaccggtaccggtacgtacggcgacccggtccgtacggtcccgtaccccgg

SEQ ID NO: 21137 - DNA, 181 bp, Homo sapiens
  misc_feature: GYAE6OF01BBHKB.49.53.E09.1.454.CMB.1.raw
  modified_base (174)..(181): a, c, t, g, unknown or other
  misc_feature (174)..(181): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcagtagnnnnnnnn

SEQ ID NO: 21138 - DNA, 189 bp, Homo sapiens
  misc_feature: GYAE6OF01B7QYC.49.53.E09.1.454.CMB.1.raw
  modified_base (166)..(166): a, c, t, g, unknown or other
  misc_feature (166)..(166): n is a, c, g, or t
  modified_base (172)..(189): a, c, t, g, unknown or other
  misc_feature (172)..(189): n is a, c, g, or t
tcagagtcgagagacacgaccggtgctcgatttagagagagtgtggttgggtttgggggaagaggaagactgacggtcccccaggagttcaggtgctgggcacagcgccctggctgcctggtcaaggactacttcctctctcgactctgagcgggctggcaaggcncatagnnnnnnnnnnnnnnnnnn

SEQ ID NO: 21139 - DNA, 790 bp, Homo sapiens
  misc_feature: GYAE6OF01BAO2M.49.53.E09.1.454.CMB.1.raw
  modified_base (254)..(254): a, c, t, g, unknown or other
  misc_feature (254)..(254): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacacgccacccgtcggtgtctgtgtcctcgaggacaggaccggcctagtactccacctgctctggagatgctagttcgaccaagacaagtntcgacttacgtaggtaccagacaaggaagaccgacggccgaccggtaccccgttgttcgttagacttacttaacgttttaagtaaacgttacgtttaggaagggtacggtcccgttaccgggaacccgggtacccctagggtacgtaccgtacgtttccgtaccgtcgggtaccctacgtacgtccgtacgacggtaccgaacctaacgacgttaccgtacgttacgaaccgtacgtacggtaagggttcggtaacccggggtcgggacgtaaggggaacgggtacgggaacgtcggttaacgtaacctttacgttacgttcgtacgaaccgttctaacgaccggtaagaaccggtacggtttaaacgggtgtaaacccttccgtttacggtacgggtttaccggttccggttaccgggggtaaccggggttaacccgggtaacccgtaaggtaccccgggttacgaaaccccggtttacgggtacccggttaacgaaccccgggtacctaacccggggttccctaccccccgggg

SEQ ID NO: 21140 - DNA, 722 bp, Homo sapiens
  misc_feature: GYAE6OF01AK952.49.53.E09.1.454.CMB.1.raw
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
tcagagtcgagagacacgaccggtgctcgatttagagagagtgtggttggggtttggggggaagaggaagactggaccggtcccccaggtagttcgaggtgcgtacgggaccaacgacggccggtcccgtgggccttcgtccgttacggtacgaacggtaccttaccttcctctctcgacctcgtaggacggcggtcgtaggacgtaggccncgtagtacgntgnagtcattccgtgcgaagctgacctggcacgntncgcanctgcacagcgtcctgctcgcgtagttacnaacgtacggacctcgtggtacggcgtctacgtcctcggtacgttctaccgaagttcgaggtacgtacctaaggacgtcgtacgttcgtacgaaaccttactcggggtaacgtacctaagggaccctttacggtaccggtaccttacggtacggtttaggggacgttacgttaccccttagtaccgggtcccgtaagtttccgtactaaacgggaccgttaccctttagggtccctacgggaaataccttacgggttacgtacgtacgttacgtacggtacgtagtacgtacgtacgtacgacgtacgtaccgttacgtacgtacgtagtacgttacgtacgtacgtacgacgtagtaacgtcgtaccggtacgtacggtacgactacgtacgtacgtacgtacgtacgtaccgtaccgtccgtccgtacg

SEQ ID NO: 21141 - DNA, 898 bp, Homo sapiens
  misc_feature: GYAE6OF01BJGYV.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctagaccacacgcccctacccgtcggttcgtctggttcgtttccacggaaggaaccaaggacccggtacccaagttacctccacccgtgcccttaggtgggaatatcggactagttcgaacccaaaaggctaaattacttcgtaccttaaccgtcggtaacccaggaccaaggaacgccgaggcccgtacggccccttgtacctttgtaacttacgttaagttttaaagtaaacgtcgtttagggaacggacggccgtacggaccgggtaccccgtggtacggcgttacttccgtcgtcggtaccgtaccgacgtcctaccggaacgtaccgaaactaaccgtacggttacccgtaacggtttaccgaaccctaacgtacccggtaaggggttccggggtaacccggggtacccggggaacggaaaacgggggtaacccgggtaaccggggtaccgggttaaccgttaacggttaaacccgttttaacgtttaacggtttaaccgtaccggttaacggttaccgtaaacggtaccgtaaacgggtaaacggttggggtaaaccgggttcgtaaccgtttaccggttaccgttttagggttaccggttacggggtaaccgggttaaccgggggtaaccgggtaccggtaaacggtcccggttaaccggtttaccgggacccgttaccgggtacccgttaaccccgggtaccggtaaccggggttcccccgtacccccggg

SEQ ID NO: 21142 - DNA, 981 bp, Homo sapiens
  misc_feature: GYAE6OF01EM1CE.49.53.E09.1.454.CMB.1.raw
tcagagtcgagagacacgaccggtgctcgatttagagagagtgtgttgggtttgggggtgggtccaggaggcagaactcgtgggtgtctcaccatggcctggactccctctacttcctcccctcctcactctctgcacagactctaggacggccttctatcgacgctacgaccacgaccgaccctacccgttcggttcgttcgttgttcgttccctacgacggacgacggaccggaccgtaagtactccgtaccttcgtcctcggtaggaagtagtcgcctaagttaccggaacctaaaacgtactaaattacgttcgttaccgtttacggttaccggtaaccgtaacggaaccgaaacggaaccggacccggaaccgggaccccggtaccccgggttcccccgtttacggttttccgtttacgttaacctttaacgttttaaacgtttttaaacggtttaaaacggtttacggttttaagggaacgggtaccgggtacccggtaccgggtaacccgggtaaccccgttaggtaccggttaccgttacgtttaccgttccggttaccggtacccgtaccgtacgtaccgtaaccgtaacggaaacccgaaaccgtaaaccggtaaccggttaaccgttaacccgggttacgtaacccggttaacgtaaccggttacgggtacggggtaaccggggtacccgggaacggaacgggaacggggtacgggaacgggttacgttaccgttaaccgttacgttacgtttacgtacgtacgtacgtaacgtacggtaacgtaacggttaacgggttacggttacggtacgtttaccgttacggtttacggttacgggtttacgggtaccggggaaccggggtaaccgggtaaccggtaaccggttccggttacccggtacccggttacccggtttaaccggtaccggtacccgggtacccggtaacccgggttccccggtaccccgg

SEQ ID NO: 21143 - DNA, 178 bp, Homo sapiens; identical to SEQ ID NO: 20465
  misc_feature: GYAE6OF01AXFBN.49.53.E09.1.454.CMB.1.raw
  modified_base (173)..(178): a, c, t, g, unknown or other
  misc_feature (173)..(178): n is a, c, g, or t

SEQ ID NO: 21144 - DNA, 168 bp, Homo sapiens
  misc_feature: GYAE6OF02IZQKI.49.53.E09.1.454.CMB.1.raw
  modified_base (167)..(168): a, c, t, g, unknown or other
  misc_feature (167)..(168): n is a, c, g, or t
tcagagtcgagagacacgaccggtgctcgatttagagagagtgtgttggttgggaagaggaagactgacggtcccaggagttcaggtgctgggcacagcggccctgggctgcctggtcaaggactacttcctctctcgactctgagcgggctggcaaggcgcatagnn

SEQ ID NO: 21145 - DNA, 164 bp, Homo sapiens
  misc_feature: GYAE6OF02IAI5G.49.53.E09.1.454.CMB.1.raw
  modified_base (162)..(164): a, c, t, g, unknown or other
  misc_feature (162)..(164): n is a, c, g, or t
tcagagtcgagagacacgaccggtgctcgatttagagagagtgtgttggttggaagaggaagactgacggtcccaggagttcaggtgctggcacagcggcctggctgcctggtcaaggactacttcctctctcgactctgagcggctggcaaggcgcatagnnn

SEQ ID NO: 21146 - DNA, 171 bp, Homo sapiens
  misc_feature: GYAE6OF02HGLXK.49.53.E09.1.454.CMB.1.raw
  modified_base (170)..(171): a, c, t, g, unknown or other
  misc_feature (170)..(171): n is a, c, g, or t
tcagagtcgagagacacgaccggtgctcgatttagagagagtgtgttgggtttgggaagaggaagactgacggtccccaggagttcaggtgctgggcacagcggccctgggctgcctggtcaaggactacttcctctctcgactctgagcgggctggcaaggcgcatagnn

SEQ ID NO: 21147 - DNA, 173 bp, Homo sapiens; identical to SEQ ID NO: 20258
  misc_feature: GYAE6OF02ICJ2Y.49.53.E09.1.454.CMB.1.raw
  modified_base (172)..(173): a, c, t, g, unknown or other
  misc_feature (172)..(173): n is a, c, g, or t

SEQ ID NO: 21148 - DNA, 172 bp, Homo sapiens; identical to SEQ ID NO: 20254
  misc_feature: GYAE6OF02I93WO.49.53.E09.1.454.CMB.1.raw
  modified_base (171)..(172): a, c, t, g, unknown or other
  misc_feature (171)..(172): n is a, c, g, or t

SEQ ID NO: 21149 - DNA, 216 bp, Homo sapiens
  misc_feature: GYAE6OF02GVSX1.49.53.E09.1.454.CMB.1.raw
  modified_base (174)..(216): a, c, t, g, unknown or other
  misc_feature (174)..(216): n is a, c, g, or t
tcagagtcgagagacacgaccggtgctcgatttagagagagtgtgttgggttggggaagaggaagactgacggtccccaggagttcaaggtgctgggcacagcggccctgggctggcctggtcaaggactacttcctctctcgactccgtgagcgggctggcaaggcgcatagnnnnnnnnnnnnnnnnnnnnnnnnnnnnnnnnnnnnnnnnnnn

SEQ ID NO: 21150 - DNA, 173 bp, Homo sapiens; identical to SEQ ID NO: 20258
  misc_feature: GYAE6OF02HON05.49.53.E09.1.454.CMB.1.raw
  modified_base (172)..(173): a, c, t, g, unknown or other
  misc_feature (172)..(173): n is a, c, g, or t

SEQ ID NO: 21151 - DNA, 172 bp, Homo sapiens; identical to SEQ ID NO: 20230
  misc_feature: GYAE6OF02F9SFJ.49.53.E09.1.454.CMB.1.raw
  modified_base (171)..(172): a, c, t, g, unknown or other
  misc_feature (171)..(172): n is a, c, g, or t

SEQ ID NO: 21152 - DNA, 171 bp, Homo sapiens; identical to SEQ ID NO: 20210
  misc_feature: GYAE6OF02HYGYO.49.53.E09.1.454.CMB.1.raw
  modified_base (171)..(171): a, c, t, g, unknown or other
  misc_feature (171)..(171): n is a, c, g, or t

SEQ ID NO: 21153 - DNA, 169 bp, Homo sapiens; identical to SEQ ID NO: 20245
  misc_feature: GYAE6OF02G8E14.49.53.E09.1.454.CMB.1.raw
  modified_base (169)..(169): a, c, t, g, unknown or other
  misc_feature (169)..(169): n is a, c, g, or t

SEQ ID NO: 21154 - DNA, 174 bp, Homo sapiens; identical to SEQ ID NO: 20354
  misc_feature: GYAE6OF02HBUQO.49.53.E09.1.454.CMB.1.raw
  modified_base (171)..(174): a, c, t, g, unknown or other
  misc_feature (171)..(174): n is a, c, g, or t

SEQ ID NO: 21155 - DNA, 170 bp, Homo sapiens; identical to SEQ ID NO: 20218
  misc_feature: GYAE6OF02IGOBD.49.53.E09.1.454.CMB.1.raw
  modified_base (169)..(170): a, c, t, g, unknown or other
  misc_feature (169)..(170): n is a, c, g, or t

SEQ ID NO: 21156 - DNA, 181 bp, Homo sapiens
  misc_feature: GYAE6OF02HQWK4.49.53.E09.1.454.CMB.1.raw
  modified_base (171)..(181): a, c, t, g, unknown or other
  misc_feature (171)..(181): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnnnnnnnnnnn

SEQ ID NO: 21157 - DNA, 172 bp, Homo sapiens; identical to SEQ ID NO: 20254
  misc_feature: GYAE6OF02HFGHH.49.53.E09.1.454.CMB.1.raw
  modified_base (171)..(172): a, c, t, g, unknown or other
  misc_feature (171)..(172): n is a, c, g, or t

SEQ ID NO: 21158 - DNA, 203 bp, Homo sapiens
  misc_feature: GYAE6OF02GO54K.49.53.E09.1.454.CMB.1.raw
  modified_base (174)..(203): a, c, t, g, unknown or other
  misc_feature (174)..(203): n is a, c, g, or t
tcagagtcgagagacacgaccggtgctcgatttagagagagtgtgttgggtttaggggaaggaggaagactgacggtaccccaggagttcaggtgctgggcacagcggccctggctgccctggtcaaggactacttcctctctcgactctgagcgggctggcaaggcgcatagnnnnnnnnnnnnnnnnnnnnnnnnnnnnnn

SEQ ID NO: 21159 - DNA, 169 bp, Homo sapiens; identical to SEQ ID NO: 20245
  misc_feature: GYAE6OF02IWX6B.49.53.E09.1.454.CMB.1.raw
  modified_base (169)..(169): a, c, t, g, unknown or other
  misc_feature (169)..(169): n is a, c, g, or t

SEQ ID NO: 21160 - DNA, 184 bp, Homo sapiens
  misc_feature: GYAE6OF02G1AZN.49.53.E09.1.454.CMB.1.raw
  modified_base (169)..(184): a, c, t, g, unknown or other
  misc_feature (169)..(184): n is a, c, g, or t
tcagagtcgagagacacgaccggtgctcgatttagagagagtgtgttgggttgggaagaggaagactgacggtccccaggagttcaggtgctgggcacagcggccctgggctgcctggtcaaggactacttcctctctcgactctgagcgggctggcaaggcgcatagnnnnnnnnnnnnnnnn

SEQ ID NO: 21161 - DNA, 165 bp, Homo sapiens
  misc_feature: GYAE6OF02HR0MT.49.53.E09.1.454.CMB.1.raw
  modified_base (165)..(165): a, c, t, g, unknown or other
  misc_feature (165)..(165): n is a, c, g, or t
tcagagtcgagagacacgaccggtgctcgatttagagagagtgtgttggttgggaagaggaagactgacggtcccaggagttcaggtgctgggcacagcggcctggctgcctggtcaaggactacttcctcgtagcactctgagcgggctggcaaggcgcatagn

SEQ ID NO: 21162 - DNA, 169 bp, Homo sapiens
  misc_feature: GYAE6OF02IECQS.49.53.E09.1.454.CMB.1.raw
  modified_base (168)..(169): a, c, t, g, unknown or other
  misc_feature (168)..(169): n is a, c, g, or t
tcagagtcgagagacacgaccggtgctcgatttagagagagtgtgttgggtttgggaagaggaagactgacggtccccaggagttcaggtgctgggcacagcggcctggctgcctggtcaaggactacttcctctctcgactctgagcgggctggcaaggcgcatagnn

SEQ ID NO: 21163 - DNA, 171 bp, Homo sapiens; identical to SEQ ID NO: 20268
  misc_feature: GYAE6OF02GDZ2I.49.53.E09.1.454.CMB.1.raw
  modified_base (170)..(171): a, c, t, g, unknown or other
  misc_feature (170)..(171): n is a, c, g, or t

SEQ ID NO: 21164 - DNA, 171 bp, Homo sapiens; identical to SEQ ID NO: 20210
  misc_feature: GYAE6OF02GNO9P.49.53.E09.1.454.CMB.1.raw
  modified_base (171)..(171): a, c, t, g, unknown or other
  misc_feature (171)..(171): n is a, c, g, or t

SEQ ID NO: 21165 - DNA, 172 bp, Homo sapiens; identical to SEQ ID NO: 20400
  misc_feature: GYAE6OF02G3WJ2.49.53.E09.1.454.CMB.1.raw
  modified_base (172)..(172): a, c, t, g, unknown or other
  misc_feature (172)..(172): n is a, c, g, or t

SEQ ID NO: 21166 - DNA, 177 bp, Homo sapiens
  misc_feature: GYAE6OF02H9NMJ.49.53.E09.1.454.CMB.1.raw
  modified_base (171)..(177): a, c, t, g, unknown or other
  misc_feature (171)..(177): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctcgtagcactctgagcgggctggcaaggcgcatagnnnnnnn

SEQ ID NO: 21167 - DNA, 175 bp, Homo sapiens
  misc_feature: GYAE6OF02H03GU.49.53.E09.1.454.CMB.1.raw
  modified_base (173)..(175): a, c, t, g, unknown or other
  misc_feature (173)..(175): n is a, c, g, or t
tcagagtcgagagacacgaccggtgctcgatttagagagagtgtgttgggtttgtagggaagaggaagactgacggtccccaggagttcaggtgctgggcacagcggccctgggctgcctggtcaaggactacttcctctctcgactctgagcgggctggcaaggcgcatagnnn

SEQ ID NO: 21168 - DNA, 172 bp, Homo sapiens; identical to SEQ ID NO: 20400
  misc_feature: GYAE6OF02I8IR2.49.53.E09.1.454.CMB.1.raw
  modified_base (172)..(172): a, c, t, g, unknown or other
  misc_feature (172)..(172): n is a, c, g, or t

SEQ ID NO: 21169 - DNA, 171 bp, Homo sapiens; identical to SEQ ID NO: 20272
  misc_feature: GYAE6OF02HYS2I.49.53.E09.1.454.CMB.1.raw
  modified_base (171)..(171): a, c, t, g, unknown or other
  misc_feature (171)..(171): n is a, c, g, or t

SEQ ID NO: 21170 - DNA, 172 bp, Homo sapiens; identical to SEQ ID NO: 20400
  misc_feature: GYAE6OF02G2C5U.49.53.E09.1.454.CMB.1.raw
  modified_base (172)..(172): a, c, t, g, unknown or other
  misc_feature (172)..(172): n is a, c, g, or t

SEQ ID NO: 21171 - DNA, 188 bp, Homo sapiens
  misc_feature: GYAE6OF02HD89D.49.53.E09.1.454.CMB.1.raw
  modified_base (170)..(188): a, c, t, g, unknown or other
  misc_feature (170)..(188): n is a, c, g, or t
tcagagtcgagagacacgaccggtgctcgatttagagagagtgtgttgggtttgggaagaggaagactgacggtccccaggagttcaggtgctgggcacagcggccctgggctgcctggtcaaggactacttcctcgtagcactctgagcgggctggcaaggcgcatagnnnnnnnnnnnnnnnnnnn

SEQ ID NO: 21172 - DNA, 173 bp, Homo sapiens
  misc_feature: GYAE6OF02FY14Z.49.53.E09.1.454.CMB.1.raw
  modified_base (171)..(173): a, c, t, g, unknown or other
  misc_feature (171)..(173): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnnn

SEQ ID NO: 21173 - DNA, 173 bp, Homo sapiens; identical to SEQ ID NO: 20229
  misc_feature: GYAE6OF02IQR4E.49.53.E09.1.454.CMB.1.raw
  modified_base (173)..(173): a, c, t, g, unknown or other
  misc_feature (173)..(173): n is a, c, g, or t

SEQ ID NO: 21174 - DNA, 169 bp, Homo sapiens
  misc_feature: GYAE6OF02IE64Q.49.53.E09.1.454.CMB.1.raw
  modified_base (168)..(169): a, c, t, g, unknown or other
  misc_feature (168)..(169): n is a, c, g, or t
tcagagtcgagagacacgaccggtgctcgatttagagagagtgtgttgggtttggggaagaggaagactgacggtccccaggagttcaggtgctggcacagcggcctggctgcctggtcaaggactacttcctctctcgactctgagcgggctggcaaggcgcatagnn

SEQ ID NO: 21175 - DNA, 180 bp, Homo sapiens
  misc_feature: GYAE6OF02ID2F1.49.53.E09.1.454.CMB.1.raw
  modified_base (172)..(180): a, c, t, g, unknown or other
  misc_feature (172)..(180): n is a, c, g, or t
tcagagtcgagagacacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagnnnnnnnnn

SEQ ID NO: 21176 - DNA, 169 bp, Homo sapiens
  misc_feature: GYAE6OF02HZEIH.49.53.E09.1.454.CMB.1.raw
  modified_base (169)..(169): a, c, t, g, unknown or other
  misc_feature (169)..(169): n is a, c, g, or t
tcagagtcgagagacacgaccggtgctcgatttagagagagtgtgttgggtttgggaagaggaagactgacggtcccaggagttcaggtgctgggcacagcggccctgggctgcctggtcaaggactacttcctctctcgactctgagcgggctggcaaggcgcatagn

SEQ ID NO: 21177 - DNA, 169 bp, Homo sapiens
  misc_feature: GYAE6OF02H1E8Z.49.53.E09.1.454.CMB.1.raw
  modified_base (169)..(169): a, c, t, g, unknown or other
  misc_feature (169)..(169): n is a, c, g, or t
tcagagtcgagagacacgaccggtgctcgatttagagagagtgtgttgggtttgggaagaggaagactgacggtcccaggagttcaggtgctgggcacagcggccctgggctgcctggtcaaggactacttcctcgtagcactctgagcgggctggcaaggcgcatagn

SEQ ID NO: 21178 - DNA, 173 bp, Homo sapiens; identical to SEQ ID NO: 20229
  misc_feature: GYAE6OF02HRT0O.49.53.E09.1.454.CMB.1.raw
  modified_base (173)..(173): a, c, t, g, unknown or other
  misc_feature (173)..(173): n is a, c, g, or t

SEQ ID NO: 21179 - DNA, 171 bp, Homo sapiens; identical to SEQ ID NO: 20210
  misc_feature: GYAE6OF02IMWRE.49.53.E09.1.454.CMB.1.raw
  modified_base (171)..(171): a, c, t, g, unknown or other
  misc_feature (171)..(171): n is a, c, g, or t

SEQ ID NO: 21180 - DNA, 174 bp, Homo sapiens
  misc_feature: GYAE6OF02GXM20.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgggggaaggaggaagactgacggtcccccaggagttcaggtgctgggcacagcggccctgggctgcctggtcaaggactacttcctctctcgactctgagcgggctggcaaggcgcatagn

SEQ ID NO: 21181 - DNA, 173 bp, Homo sapiens; identical to SEQ ID NO: 20229
  misc_feature: GYAE6OF02FFM43.49.53.E09.1.454.CMB.1.raw
  modified_base (173)..(173): a, c, t, g, unknown or other
  misc_feature (173)..(173): n is a, c, g, or t

SEQ ID NO: 21182 - DNA, 171 bp, Homo sapiens; identical to SEQ ID NO: 20210
  misc_feature: GYAE6OF02F9EH4.49.53.E09.1.454.CMB.1.raw
  modified_base (171)..(171): a, c, t, g, unknown or other
  misc_feature (171)..(171): n is a, c, g, or t

SEQ ID NO: 21183 - DNA, 173 bp, Homo sapiens; identical to SEQ ID NO: 20229
  misc_feature: GYAE6OF02G1RC0.49.53.E09.1.454.CMB.1.raw
  modified_base (173)..(173): a, c, t, g, unknown or other
  misc_feature (173)..(173): n is a, c, g, or t

SEQ ID NO: 21184 - DNA, 172 bp, Homo sapiens; identical to SEQ ID NO: 20400
  misc_feature: GYAE6OF02IDYJL.49.53.E09.1.454.CMB.1.raw
  modified_base (172)..(172): a, c, t, g, unknown or other
  misc_feature (172)..(172): n is a, c, g, or t

SEQ ID NO: 21185 - DNA, 184 bp, Homo sapiens
  misc_feature: GYAE6OF02HXMGU.49.53.E09.1.454.CMB.1.raw
  modified_base (173)..(184): a, c, t, g, unknown or other
  misc_feature (173)..(184): n is a, c, g, or t
tcagagtcgagagacacgaccggtgctcgatttagagagagtgtgttgggtttgggggaagaggaagactgaaggtcccccaggagttcaggtgctgggcacagcggccctgggctgcctggtcaaggactacttcctctctcgactctgagcgggctggcaaggcgcatagnnnnnnnnnnnn

SEQ ID NO: 21186 - DNA, 173 bp, Homo sapiens; identical to SEQ ID NO: 20229
  misc_feature: GYAE6OF02H2U17.49.53.E09.1.454.CMB.1.raw
  modified_base (173)..(173): a, c, t, g, unknown or other
  misc_feature (173)..(173): n is a, c, g, or t

SEQ ID NO: 21187 - DNA, 182 bp, Homo sapiens
  misc_feature: GYAE6OF02I9963.49.53.E09.1.454.CMB.1.raw
  modified_base (177)..(178): a, c, t, g, unknown or other
  misc_feature (177)..(178): n is a, c, g, or t
  modified_base (180)..(182): a, c, t, g, unknown or other
  misc_feature (180)..(182): n is a, c, g, or t
tcagagtcgagagacacgaccggtgctcgatttagagagagtgtgtgggttggggaagacggagactgacggttccccaggagttcaggtgcgtggcacgagcggcctgggtctgcctggtctaaggcggtacttcgtcgtacgcatctgagcgggctggcaaggcggcagtagagnnannn

SEQ ID NO: 21188 - DNA, 170 bp, Homo sapiens
  misc_feature: GYAE6OF02IP62T.49.53.E09.1.454.CMB.1.raw
  modified_base (169)..(170): a, c, t, g, unknown or other
  misc_feature (169)..(170): n is a, c, g, or t
tcagagtcgagagacacgaccggtgctcgatttagagagagtgtgttgggttgggaagaggaagactgacggtccccaggagttcaggtgctgggcacagcggccctgggctgcttggtcaaggactacttcctctctcgactctgagcgggctggcaaggcgcatagnn

SEQ ID NO: 21189 - DNA, 171 bp, Homo sapiens; identical to SEQ ID NO: 20210
  misc_feature: GYAE6OF02HZO2D.49.53.E09.1.454.CMB.1.raw
  modified_base (171)..(171): a, c, t, g, unknown or other
  misc_feature (171)..(171): n is a, c, g, or t

SEQ ID NO: 21190 - DNA, 175 bp, Homo sapiens; identical to SEQ ID NO: 20458
  misc_feature: GYAE6OF02HD8RT.49.53.E09.1.454.CMB.1.raw
  modified_base (173)..(175): a, c, t, g, unknown or other
  misc_feature (173)..(175): n is a, c, g, or t

SEQ ID NO: 21191 - DNA, 171 bp, Homo sapiens; identical to SEQ ID NO: 20210
  misc_feature: GYAE6OF02F6V2K.49.53.E09.1.454.CMB.1.raw
  modified_base (171)..(171): a, c, t, g, unknown or other
  misc_feature (171)..(171): n is a, c, g, or t

SEQ ID NO: 21192 - DNA, 172 bp, Homo sapiens; identical to SEQ ID NO: 20400
  misc_feature: GYAE6OF02IRYPE.49.53.E09.1.454.CMB.1.raw
  modified_base (172)..(172): a, c, t, g, unknown or other
  misc_feature (172)..(172): n is a, c, g, or t

SEQ ID NO: 21193 - DNA, 173 bp, Homo sapiens; identical to SEQ ID NO: 20229
  misc_feature: GYAE6OF02GUCL8.49.53.E09.1.454.CMB.1.raw
  modified_base (173)..(173): a, c, t, g, unknown or other
  misc_feature (173)..(173): n is a, c, g, or t

SEQ ID NO: 21194 - DNA, 172 bp, Homo sapiens; identical to SEQ ID NO: 20400
  misc_feature: GYAE6OF02H3CIJ.49.53.E09.1.454.CMB.1.raw
  modified_base (172)..(172): a, c, t, g, unknown or other
  misc_feature (172)..(172): n is a, c, g, or t

SEQ ID NO: 21195 - DNA, 173 bp, Homo sapiens; identical to SEQ ID NO: 20229
  misc_feature: GYAE6OF02JDR39.49.53.E09.1.454.CMB.1.raw
  modified_base (173)..(173): a, c, t, g, unknown or other
  misc_feature (173)..(173): n is a, c, g, or t

SEQ ID NO: 21196 - DNA, 173 bp, Homo sapiens; identical to SEQ ID NO: 20258
  misc_feature: GYAE6OF02ILM08.49.53.E09.1.454.CMB.1.raw
  modified_base (172)..(173): a, c, t, g, unknown or other
  misc_feature (172)..(173): n is a, c, g, or t

SEQ ID NO: 21197 - DNA, 177 bp, Homo sapiens
  misc_feature: GYAE6OF02GSHTX.49.53.E09.1.454.CMB.1.raw
  modified_base (171)..(177): a, c, t, g, unknown or other
  misc_feature (171)..(177): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnnnnnnn

SEQ ID NO: 21198 - DNA, 184 bp, Homo sapiens
  misc_feature: GYAE6OF02HAM2U.49.53.E09.1.454.CMB.1.raw
  modified_base (172)..(184): a, c, t, g, unknown or other
  misc_feature (172)..(184): n is a, c, g, or t
tcagagtcgagagacacgaccggtgctcgatttagagagagtgtgttgggtttggggaaggaggaagactgacggtccccaggagttcaggtgctgggcacagcggccctgggctgcctggtcaaggactacttcctctctcgactctgagcgggctggcaaggcgcatagnnnnnnnnnnnnn

SEQ ID NO: 21199 - DNA, 175 bp, Homo sapiens; identical to SEQ ID NO: 20588
  misc_feature: GYAE6OF02GCUNE.49.53.E09.1.454.CMB.1.raw
  modified_base (172)..(175): a, c, t, g, unknown or other
  misc_feature (172)..(175): n is a, c, g, or t

SEQ ID NO: 21200 - DNA, 172 bp, Homo sapiens; identical to SEQ ID NO: 20400
  misc_feature: GYAE6OF02HLS6V.49.53.E09.1.454.CMB.1.raw
  modified_base (172)..(172): a, c, t, g, unknown or other
  misc_feature (172)..(172): n is a, c, g, or t

SEQ ID NO: 21201 - DNA, 174 bp, Homo sapiens; identical to SEQ ID NO: 20265
  misc_feature: GYAE6OF02HMDUL.49.53.E09.1.454.CMB.1.raw
  modified_base (173)..(174): a, c, t, g, unknown or other
  misc_feature (173)..(174): n is a, c, g, or t

SEQ ID NO: 21202 - DNA, 173 bp, Homo sapiens; identical to SEQ ID NO: 20576
  misc_feature: GYAE6OF02G3OZE.49.53.E09.1.454.CMB.1.raw
  modified_base (172)..(173): a, c, t, g, unknown or other
  misc_feature (172)..(173): n is a, c, g, or t

SEQ ID NO: 21203 - DNA, 174 bp, Homo sapiens
  misc_feature: GYAE6OF02H2PYK.49.53.E09.1.454.CMB.1.raw
  modified_base (172)..(174): a, c, t, g, unknown or other
  misc_feature (172)..(174): n is a, c, g, or t
tcagagtcgagagacacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagnnn

SEQ ID NO: 21204 - DNA, 171 bp, Homo sapiens; identical to SEQ ID NO: 20210
  misc_feature: GYAE6OF02G8NF1.49.53.E09.1.454.CMB.1.raw
  modified_base (171)..(171): a, c, t, g, unknown or other
  misc_feature (171)..(171): n is a, c, g, or t

SEQ ID NO: 21205 - DNA, 171 bp, Homo sapiens; identical to SEQ ID NO: 20210
  misc_feature: GYAE6OF02INL85.49.53.E09.1.454.CMB.1.raw
  modified_base (171)..(171): a, c, t, g, unknown or other
  misc_feature (171)..(171): n is a, c, g, or t

SEQ ID NO: 21206 - DNA, 174 bp, Homo sapiens; identical to SEQ ID NO: 20265
  misc_feature: GYAE6OF02HOU5I.49.53.E09.1.454.CMB.1.raw
  modified_base (173)..(174): a, c, t, g, unknown or other
  misc_feature (173)..(174): n is a, c, g, or t

SEQ ID NO: 21207 - DNA, 172 bp, Homo sapiens; identical to SEQ ID NO: 20254
  misc_feature: GYAE6OF02HSUM2.49.53.E09.1.454.CMB.1.raw
  modified_base (171)..(172): a, c, t, g, unknown or other
  misc_feature (171)..(172): n is a, c, g, or t

SEQ ID NO: 21208 - DNA, 172 bp, Homo sapiens; identical to SEQ ID NO: 20238
  misc_feature: GYAE6OF02HBC5Q.49.53.E09.1.454.CMB.1.raw
  modified_base (172)..(172): a, c, t, g, unknown or other
  misc_feature (172)..(172): n is a, c, g, or t

SEQ ID NO: 21209 - DNA, 173 bp, Homo sapiens; identical to SEQ ID NO: 20258
  misc_feature: GYAE6OF02F6QY3.49.53.E09.1.454.CMB.1.raw
  modified_base (172)..(173): a, c, t, g, unknown or other
  misc_feature (172)..(173): n is a, c, g, or t

SEQ ID NO: 21210 - DNA, 178 bp, Homo sapiens
  misc_feature: GYAE6OF02GHOIC.49.53.E09.1.454.CMB.1.raw
  modified_base (173)..(178): a, c, t, g, unknown or other
  misc_feature (173)..(178): n is a, c, g, or t
tcagagtcgagagacacgaccggtgctcgatttagagagagtgtgttgggtttgggggaagaggaagactgacggtcccccaggagttcaggtgctgggcacagcggccctggactgcctggtcaaggactacttcctctctcgactctgagcgggctggcaaggcgcatagnnnnnn

SEQ ID NO: 21211 - DNA, 188 bp, Homo sapiens
  misc_feature: GYAE6OF02G2251.49.53.E09.1.454.CMB.1.raw
  modified_base (174)..(188): a, c, t, g, unknown or other
  misc_feature (174)..(188): n is a, c, g, or t
tcagagtcgagagacacgaccggtgctcgatttagagagagtgtgttgggttgggggaagaggaagactgacggtcccccaggagttcaggtgctgggcacagcggccctgggcctgcctggtcaacggactacttcctctctcgactctgagcgggctggcaaggcgcatagnnnnnnnnnnnnnnn

SEQ ID NO: 21212 - DNA, 173 bp, Homo sapiens; identical to SEQ ID NO: 20229
  misc_feature: GYAE6OF02G069P.49.53.E09.1.454.CMB.1.raw
  modified_base (173)..(173): a, c, t, g, unknown or other
  misc_feature (173)..(173): n is a, c, g, or t

SEQ ID NO: 21213 - DNA, 172 bp, Homo sapiens; identical to SEQ ID NO: 20400
  misc_feature: GYAE6OF02F6ZL5.49.53.E09.1.454.CMB.1.raw
  modified_base (172)..(172): a, c, t, g, unknown or other
  misc_feature (172)..(172): n is a, c, g, or t

SEQ ID NO: 21214 - DNA, 171 bp, Homo sapiens; identical to SEQ ID NO: 20272
  misc_feature: GYAE6OF02HW0L9.49.53.E09.1.454.CMB.1.raw
  modified_base (171)..(171): a, c, t, g, unknown or other
  misc_feature (171)..(171): n is a, c, g, or t

SEQ ID NO: 21215 - DNA, 167 bp, Homo sapiens
  misc_feature: GYAE6OF02HUTW9.49.53.E09.1.454.CMB.1.raw
  modified_base (165)..(167): a, c, t, g, unknown or other
  misc_feature (165)..(167): n is a, c, g, or t
tcagagtcgagagacacgaccggtgctcgattagagagagtgtgttggttgggaagaggaagactgacggtcccaggagttcaggtgctgggcacagcggccctggctgcctggtcaaggactacttcctctctcgactctgagcgggctggcaaggcgcatagnnn

SEQ ID NO: 21216 - DNA, 173 bp, Homo sapiens; identical to SEQ ID NO: 20337
  misc_feature: GYAE6OF02FWSWW.49.53.E09.1.454.CMB.1.raw
  modified_base (173)..(173): a, c, t, g, unknown or other
  misc_feature (173)..(173): n is a, c, g, or t

SEQ ID NO: 21217 - DNA, 174 bp, Homo sapiens
  misc_feature: GYAE6OF02HMTN4.49.53.E09.1.454.CMB.1.raw
  modified_base (173)..(174): a, c, t, g, unknown or other
  misc_feature (173)..(174): n is a, c, g, or t
tcagagtcgagagacacgaccggtgctcgatttagagagagtgtgttgggtttgtggggaagaggaagactgacggtccccaggagttcaggtgctgggcacagcggccctgggctgcctggtcaaggactacttcctctctcgactctgagcgggctggcaaggcgcatagnn

SEQ ID NO: 21218 - DNA, 173 bp, Homo sapiens; identical to SEQ ID NO: 20229
  misc_feature: GYAE6OF02IUOAX.49.53.E09.1.454.CMB.1.raw
  modified_base (173)..(173): a, c, t, g, unknown or other
  misc_feature (173)..(173): n is a, c, g, or t

SEQ ID NO: 21219 - DNA, 173 bp, Homo sapiens; identical to SEQ ID NO: 20229
  misc_feature: GYAE6OF02GMAFY.49.53.E09.1.454.CMB.1.raw
  modified_base (173)..(173): a, c, t, g, unknown or other
  misc_feature (173)..(173): n is a, c, g, or t

SEQ ID NO: 21220 - DNA, 196 bp, Homo sapiens
  misc_feature: GYAE6OF02FPQPG.49.53.E09.1.454.CMB.1.raw
  modified_base (174)..(196): a, c, t, g, unknown or other
  misc_feature (174)..(196): n is a, c, g, or t
tcagagtcgagagacacgaccggtgctcgatttagagagagtgtgttgggtttgggggaagaggaagactgaccggtccccaggagttcaggtgctgggcactagcggccctgggctgcctggtcaaggactacttcctcgtagcactctgagcgggctggcaaggcgcatagnnnnnnnnnnnnnnnnnnnnnnn

SEQ ID NO: 21221 - DNA, 170 bp, Homo sapiens; identical to SEQ ID NO: 20211
  misc_feature: GYAE6OF02F7E06.49.53.E09.1.454.CMB.1.raw
  modified_base (170)..(170): a, c, t, g, unknown or other
  misc_feature (170)..(170): n is a, c, g, or t

SEQ ID NO: 21222 - DNA, 170 bp, Homo sapiens; identical to SEQ ID NO: 20211
  misc_feature: GYAE6OF02GSX0L.49.53.E09.1.454.CMB.1.raw
  modified_base (170)..(170): a, c, t, g, unknown or other
  misc_feature (170)..(170): n is a, c, g, or t

SEQ ID NO: 21223 - DNA, 171 bp, Homo sapiens; identical to SEQ ID NO: 20210
  misc_feature: GYAE6OF02F0DEA.49.53.E09.1.454.CMB.1.raw
  modified_base (171)..(171): a, c, t, g, unknown or other
  misc_feature (171)..(171): n is a, c, g, or t

SEQ ID NO: 21224 - DNA, 172 bp, Homo sapiens; identical to SEQ ID NO: 20400
  misc_feature: GYAE6OF02HPY3J.49.53.E09.1.454.CMB.1.raw
  modified_base (172)..(172): a, c, t, g, unknown or other
  misc_feature (172)..(172): n is a, c, g, or t

SEQ ID NO: 21225 - DNA, 173 bp, Homo sapiens; identical to SEQ ID NO: 20229
  misc_feature: GYAE6OF02GQFR3.49.53.E09.1.454.CMB.1.raw
  modified_base (173)..(173): a, c, t, g, unknown or other
  misc_feature (173)..(173): n is a, c, g, or t

SEQ ID NO: 21226 - DNA, 173 bp, Homo sapiens; identical to SEQ ID NO: 21172
  misc_feature: GYAE6OF02H4AF4.49.53.E09.1.454.CMB.1.raw
  modified_base (171)..(173): a, c, t, g, unknown or other
  misc_feature (171)..(173): n is a, c, g, or t

SEQ ID NO: 21227 - DNA, 184 bp, Homo sapiens
  misc_feature: GYAE6OF02I1A2D.49.53.E09.1.454.CMB.1.raw
  modified_base (176)..(184): a, c, t, g, unknown or other
  misc_feature (176)..(184): n is a, c, g, or t
tcagagtcgagagacacgaccggtgctcgatttagagagagtgtgttgggtttggggaagaggaagacgtgaacggtccccaggagttcaggtgcctagggcacacgcggccctgggctgcctggtcaaggactacttcctctctcgactctgagcgggctggcaaggcgcatagnnnnnnnnn

SEQ ID NO: 21228 - DNA, 223 bp, Homo sapiens
  misc_feature: GYAE6OF02FUIKR.49.53.E09.1.454.CMB.1.raw
  modified_base (174)..(223): a, c, t, g, unknown or other
  misc_feature (174)..(223): n is a, c, g, or t
tcagagtcgagagacacgaccggtgctcgatttagagagagtgtgttgggtttgggggaagaggaagactgacggtcccccaggagttcaggtgctgggcacagcggcctgggctggcctggtcaaggactacttcctctctcgactctgagcgggctggcaaggcgcatacgnnnnnnnnnnnnnnnnnnnnnnnnnnnnnnnnnnnnnnnnnnnnnnnnnn

SEQ ID NO: 21229 - DNA, 168 bp, Homo sapiens
  misc_feature: GYAE6OF02H1815.49.53.E09.1.454.CMB.1.raw
  modified_base (168)..(168): a, c, t, g, unknown or other
  misc_feature (168)..(168): n is a, c, g, or t
tcagagtcgagagacacgaccggtgctcgatttagagagagtgtgttgggttgggaagaggaagactgacggtccccaggagttcaggtgctgggcacagcggcctgggctgcctggtcaaggactacttcctctctcgactctgagcgggctggcaaggcgcatagn

SEQ ID NO: 21230 - DNA, 172 bp, Homo sapiens; identical to SEQ ID NO: 20254
  misc_feature: GYAE6OF02GQMPJ.49.53.E09.1.454.CMB.1.raw
  modified_base (171)..(172): a, c, t, g, unknown or other
  misc_feature (171)..(172): n is a, c, g, or t

SEQ ID NO: 21231 - DNA, 174 bp, Homo sapiens; identical to SEQ ID NO: 20265
  misc_feature: GYAE6OF02GW8LV.49.53.E09.1.454.CMB.1.raw
  modified_base (173)..(174): a, c, t, g, unknown or other
  misc_feature (173)..(174): n is a, c, g, or t

SEQ ID NO: 21232 - DNA, 170 bp, Homo sapiens
  misc_feature: GYAE6OF02F2ANG.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcactctgagcgggctggcaaggcgcatagn

SEQ ID NO: 21233 - DNA, 174 bp, Homo sapiens
  misc_feature: GYAE6OF02GACPP.49.53.E09.1.454.CMB.1.raw
  modified_base (173)..(174): a, c, t, g, unknown or other
  misc_feature (173)..(174): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaggctacttcctctctcgactctgagcgggctggcaaggcgcatagnn

SEQ ID NO: 21234 - DNA, 175 bp, Homo sapiens
  misc_feature: GYAE6OF02G0VHU.49.53.E09.1.454.CMB.1.raw
  modified_base (168)..(175): a, c, t, g, unknown or other
  misc_feature (168)..(175): n is a, c, g, or t
tcagagtcgagagacacgaccggtgctcgatttagagagagtgtgttggttgggaagaggaagactgacggtccccaggagttcaggtgctgggcacagcggccctgggctgcctggtcaaggactacttcctctctcgactctgagcgggctggcaaggcgcatagnnnnnnnn

SEQ ID NO: 21235 - DNA, 172 bp, Homo sapiens; identical to SEQ ID NO: 20400
  misc_feature: GYAE6OF02GJ8T5.49.53.E09.1.454.CMB.1.raw
  modified_base (172)..(172): a, c, t, g, unknown or other
  misc_feature (172)..(172): n is a, c, g, or t

SEQ ID NO: 21236 - DNA, 227 bp, Homo sapiens
  misc_feature: GYAE6OF02FY0ZA.49.53.E09.1.454.CMB.1.raw
  modified_base (177)..(227): a, c, t, g, unknown or other
  misc_feature (177)..(227): n is a, c, g, or t
tcagagtcgagagacacgaccggtgctcgatttagagagagtgtgttgggtttgggggaaggagggaagactgacggtcccccaggagttcaggtgctgggcacgagcggccctgggctgcctggtcaaggactacttccgtctctcgactctgagcgggctggcaaggcgcatagnnnnnnnnnnnnnnnnnnnnnnnnnnnnnnnnnnnnnnnnnnnnnnnnnnn

SEQ ID NO: 21237 - DNA, 204 bp, Homo sapiens
  misc_feature: GYAE6OF02GTB9U.49.53.E09.1.454.CMB.1.raw
  modified_base (171)..(204): a, c, t, g, unknown or other
  misc_feature (171)..(204): n is a, c, g, or t
tcagagtcgagagacacgaccggtgctcgatttagagagagtgtgttgggtttggggaagaggagactgacggtccccaggagttcaggtgctgggccacagcggccctgggctgcctggtcaaggactacttcctctctcgactctgagcgggctggcaaggcgcatagnnnnnnnnnnnnnnnnnnnnnnnnnnnnnnnnnn

SEQ ID NO: 21238 - DNA, 173 bp, Homo sapiens; identical to SEQ ID NO: 21172
  misc_feature: GYAE6OF02F8C5R.49.53.E09.1.454.CMB.1.raw
  modified_base (171)..(173): a, c, t, g, unknown or other
  misc_feature (171)..(173): n is a, c, g, or t

SEQ ID NO: 21239 - DNA, 184 bp, Homo sapiens; identical to SEQ ID NO: 20573
  misc_feature: GYAE6OF02GO9XX.49.53.E09.1.454.CMB.1.raw
  modified_base (173)..(184): a, c, t, g, unknown or other
  misc_feature (173)..(184): n is a, c, g, or t

SEQ ID NO: 21240 - DNA, 173 bp, Homo sapiens; identical to SEQ ID NO: 20229
  misc_feature: GYAE6OF02GQALQ.49.53.E09.1.454.CMB.1.raw
  modified_base (173)..(173): a, c, t, g, unknown or other
  misc_feature (173)..(173): n is a, c, g, or t

SEQ ID NO: 21241 - DNA, 174 bp, Homo sapiens; identical to SEQ ID NO: 20265
  misc_feature: GYAE6OF02IS6XP.49.53.E09.1.454.CMB.1.raw
  modified_base (173)..(174): a, c, t, g, unknown or other
  misc_feature (173)..(174): n is a, c, g, or t

SEQ ID NO: 21242 - DNA, 174 bp, Homo sapiens; identical to SEQ ID NO: 21203
  misc_feature: GYAE6OF02IFL50.49.53.E09.1.454.CMB.1.raw
  modified_base (172)..(174): a, c, t, g, unknown or other
  misc_feature (172)..(174): n is a, c, g, or t

SEQ ID NO: 21243 - DNA, 172 bp, Homo sapiens; identical to SEQ ID NO: 20400
  misc_feature: GYAE6OF02IKD0K.49.53.E09.1.454.CMB.1.raw
  modified_base (172)..(172): a, c, t, g, unknown or other
  misc_feature (172)..(172): n is a, c, g, or t

SEQ ID NO: 21244 - DNA, 172 bp, Homo sapiens
  misc_feature: GYAE6OF02G5KGY.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgtgggaagaggaagactgacggtccccaggagttcaggtgctgggcacagcggccctgggctgcctggtcaaggactacttcctctctcgactctgagcgggctggcaaggcgcatagn

SEQ ID NO: 21245 - DNA, 174 bp, Homo sapiens; identical to SEQ ID NO: 20265
  misc_feature: GYAE6OF02IAL6G.49.53.E09.1.454.CMB.1.raw
  modified_base (173)..(174): a, c, t, g, unknown or other
  misc_feature (173)..(174): n is a, c, g, or t

SEQ ID NO: 21246 - DNA, 173 bp, Homo sapiens; identical to SEQ ID NO: 20229
  misc_feature: GYAE6OF02I25Y6.49.53.E09.1.454.CMB.1.raw
  modified_base (173)..(173): a, c, t, g, unknown or other
  misc_feature (173)..(173): n is a, c, g, or t

SEQ ID NO: 21247 - DNA, 175 bp, Homo sapiens
  misc_feature: GYAE6OF02I6BJ0.49.53.E09.1.454.CMB.1.raw
  modified_base (171)..(175): a, c, t, g, unknown or other
  misc_feature (171)..(175): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnnnnn

SEQ ID NO: 21248 - DNA, 174 bp, Homo sapiens
  misc_feature: GYAE6OF02I4BM7.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgggggaagaggaagactgacggtcccccaggagttcaggtgctgggcacagcggccctgggctgccttggtcaaggactacttcctctctcgactctgagcgggctggcaaggcgcatagn

SEQ ID NO: 21249 - DNA, 173 bp, Homo sapiens; identical to SEQ ID NO: 20229
  misc_feature: GYAE6OF02H2V34.49.53.E09.1.454.CMB.1.raw
  modified_base (173)..(173): a, c, t, g, unknown or other
  misc_feature (173)..(173): n is a, c, g, or t

SEQ ID NO: 21250 - DNA, 169 bp, Homo sapiens
  misc_feature: GYAE6OF02FVWSU.49.53.E09.1.454.CMB.1.raw
  modified_base (169)..(169): a, c, t, g, unknown or other
  misc_feature (169)..(169): n is a, c, g, or t
tcagagtcgagagacacgaccggtgctcgatttagagagagtgtgttgggttggggaagaggaagactgacggtccccaggagttcaggtgctgggcacagcggccctggctgcctggtcaaggactacttcctctctcgactctgagcgggctggcaaggcgcatagn

SEQ ID NO: 21251 - DNA, 174 bp, Homo sapiens; identical to SEQ ID NO: 20265
  misc_feature: GYAE6OF02F4Z0R.49.53.E09.1.454.CMB.1.raw
  modified_base (173)..(174): a, c, t, g, unknown or other
  misc_feature (173)..(174): n is a, c, g, or t

SEQ ID NO: 21252 - DNA, 174 bp, Homo sapiens; identical to SEQ ID NO: 20265
  misc_feature: GYAE6OF02HWLQZ.49.53.E09.1.454.CMB.1.raw
  modified_base (173)..(174): a, c, t, g, unknown or other
  misc_feature (173)..(174): n is a, c, g, or t

SEQ ID NO: 21253 - DNA, 169 bp, Homo sapiens
  misc_feature: GYAE6OF02HTTAP.49.53.E09.1.454.CMB.1.raw
  modified_base (167)..(169): a, c, t, g, unknown or other
  misc_feature (167)..(169): n is a, c, g, or t
tcagagtcgagagacacgaccggtgctcgatttagagagagtgtgttggtttgggaagaggaagactgacggtcccaggagttcaggtgctgggcacagcggcctgggctgcctggtcaaggactacttcctctctcgactctgagcgggctggcaaggcgcatagnnn

SEQ ID NO: 21254 - DNA, 176 bp, Homo sapiens; identical to SEQ ID NO: 20270
  misc_feature: GYAE6OF02FZXJ2.49.53.E09.1.454.CMB.1.raw
  modified_base (173)..(176): a, c, t, g, unknown or other
  misc_feature (173)..(176): n is a, c, g, or t

SEQ ID NO: 21255 - DNA, 188 bp, Homo sapiens
  misc_feature: GYAE6OF02GFK1E.49.53.E09.1.454.CMB.1.raw
  modified_base (174)..(188): a, c, t, g, unknown or other
  misc_feature (174)..(188): n is a, c, g, or t
tcagagtcgagagacacgaccggtgctcgatttagagagagtgtgttgggtttgggggaagaggaagactgacggtcccccaggagttcaggtgctgggccacagcggccctggactgcctggtcaaggactacttcctctctcgactctgagcgggctggcaaggcgcatagnnnnnnnnnnnnnnn

SEQ ID NO: 21256 - DNA, 186 bp, Homo sapiens; identical to SEQ ID NO: 20381
  misc_feature: GYAE6OF02JELH0.49.53.E09.1.454.CMB.1.raw
  modified_base (173)..(186): a, c, t, g, unknown or other
  misc_feature (173)..(186): n is a, c, g, or t

SEQ ID NO: 21257 - DNA, 173 bp, Homo sapiens; identical to SEQ ID NO: 21172
  misc_feature: GYAE6OF02HOSOP.49.53.E09.1.454.CMB.1.raw
  modified_base (171)..(173): a, c, t, g, unknown or other
  misc_feature (171)..(173): n is a, c, g, or t

SEQ ID NO: 21258 - DNA, 191 bp, Homo sapiens
  misc_feature: GYAE6OF02JG3B0.49.53.E09.1.454.CMB.1.raw
  modified_base (178)..(191): a, c, t, g, unknown or other
  misc_feature (178)..(191): n is a, c, g, or t
tcagagtcgagagacacgaccggtgctcgatttagagagagtgtgttgggtttgggggtaaggaggaaggacgtgacggtcccccaggagttcaggtgctggacacagcggccctgggcctgcctggtcaaggactacttcctctctcgactctgagcgggctggcaaggcgcatagnnnnnnnnnnnnnn

SEQ ID NO: 21259 - DNA, 171 bp, Homo sapiens
  misc_feature: GYAE6OF02HUVGI.49.53.E09.1.454.CMB.1.raw
  modified_base (170)..(171): a, c, t, g, unknown or other
  misc_feature (170)..(171): n is a, c, g, or t
tcagagtcgagagacacgaccggtgctcgatttagagagagtgtgttggtttggggaagaggaagactgacggtccccaggagttcaggtgctgggcacagcggccctgggctgcctggtcaaggactacttcctctctcgactctgagcgggctggcaaggcgcatagnn

SEQ ID NO: 21260 - DNA, 171 bp, Homo sapiens
  misc_feature: GYAE6OF02HQ2AV.49.53.E09.1.454.CMB.1.raw
  modified_base (171)..(171): a, c, t, g, unknown or other
  misc_feature (171)..(171): n is a, c, g, or t
tcagagtcgagagacacgaccggtgctcgatttagagagagtgtgttgggtttggggaagaggaagactgacggtccccaggagttcaggtgctgggcacagcgaccctgggctgcctggtcaaggactacttcctctctcgactctgagcgggctggcaaggcgcatagn

SEQ ID NO: 21261 - DNA, 173 bp, Homo sapiens; identical to SEQ ID NO: 20229
  misc_feature: GYAE6OF02IXHX7.49.53.E09.1.454.CMB.1.raw
  modified_base (173)..(173): a, c, t, g, unknown or other
  misc_feature (173)..(173): n is a, c, g, or t

SEQ ID NO: 21262 - DNA, 180 bp, Homo sapiens
  misc_feature: GYAE6OF02HHH3K.49.53.E09.1.454.CMB.1.raw
  modified_base (173)..(180): a, c, t, g, unknown or other
  misc_feature (173)..(180): n is a, c, g, or t
tcagagtcgagagacacgaccggtgctcgatttagagagagtgtgttgggtttgggggaagaggaagactgacggtcccccaggagttcaggtgctgggcacagcggccctggactgcctggtcaaggactacttcctctctcgactctgagcgggctggcaaggcgcatagnnnnnnnn

SEQ ID NO: 21263 - DNA, 174 bp, Homo sapiens; identical to SEQ ID NO: 20265
  misc_feature: GYAE6OF02IBN0S.49.53.E09.1.454.CMB.1.raw
  modified_base (173)..(174): a, c, t, g, unknown or other
  misc_feature (173)..(174): n is a, c, g, or t

SEQ ID NO: 21264 - DNA, 174 bp, Homo sapiens; identical to SEQ ID NO: 20265
  misc_feature: GYAE6OF02IX0PN.49.53.E09.1.454.CMB.1.raw
  modified_base (173)..(174): a, c, t, g, unknown or other
  misc_feature (173)..(174): n is a, c, g, or t

SEQ ID NO: 21265 - DNA, 172 bp, Homo sapiens; identical to SEQ ID NO: 20254
  misc_feature: GYAE6OF02H7ELN.49.53.E09.1.454.CMB.1.raw
  modified_base (171)..(172): a, c, t, g, unknown or other
  misc_feature (171)..(172): n is a, c, g, or t

SEQ ID NO: 21266 - DNA, 172 bp, Homo sapiens
  misc_feature: GYAE6OF02IOPFO.49.53.E09.1.454.CMB.1.raw
  modified_base (171)..(172): a, c, t, g, unknown or other
  misc_feature (171)..(172): n is a, c, g, or t
tcagagtcgagagacacgaccggtgctcgatttagagagagtgtgttgggttggggaagaggaagactgacggtcccccaggagttcaggtgctgggcacagcggccctgggctgcctggtcaaggactacttcctctctcgactctgagcgggctggcaaggcgcatagnn

SEQ ID NO: 21267 - DNA, 172 bp, Homo sapiens; identical to SEQ ID NO: 20400
  misc_feature: GYAE6OF02IKQL5.49.53.E09.1.454.CMB.1.raw
  modified_base (172)..(172): a, c, t, g, unknown or other
  misc_feature (172)..(172): n is a, c, g, or t

SEQ ID NO: 21268 - DNA, 730 bp, Homo sapiens
  misc_feature: GYAE6OF02GNBJF.49.53.E09.1.454.CMB.1.raw
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
tcagagtcgagagacacgaccggtgctcgatttagagagagtgtgttgggtttgggggaagagagactgacggttccccgacgagttcgaacggtgcgtagggcccacagcggccctgggtcctgtccctggtcaaggactacttccgtctcctcgactcctggagacgggtctggtcaaaggccgctattacgngcacctgtcttgctcaggganagcgccacctctctcgcgacggcgacgccggagtagttagtaagtacgttagtcgtcgtacgaacgaacgaaaccgtacggaccgacggaccgtccgacggcctcctcactctatgtagtcgtactaccaacgtacggtacgacgtcggccgtccccgccgtacgttcgtagtcggcgtacggtcgggtcggtcggacgacgtacgttaccgtactctccgtaccgtcgacgacgacgaccgtacgacgtaccgtacgtaacgttagttttacggttacggtttacgttacgttacgtcgtacgtacgtacgtccgttccgtccgtcggtccgtaccgttaccggtttaccggggtaccgggggtaccgggtacggggtacgggtacgggaacgggacggtaacggtaacggtacggtacggtcgtacgaccgtaccgtacgttccgttaccgttccgttaccgttacgttccgttccccgtaccgtaccgttaccgtacgtacgtacgtaacg

SEQ ID NO: 21269 - DNA, 200 bp, Homo sapiens
  misc_feature: GYAE6OF02HXX1P.49.53.E09.1.454.CMB.1.raw
  modified_base (137)..(137): a, c, t, g, unknown or other
  misc_feature (137)..(137): n is a, c, g, or t
  modified_base (174)..(200): a, c, t, g, unknown or other
  misc_feature (174)..(200): n is a, c, g, or t
tcagagtcgagagacacgaccggtgctcgatttagagagagtgtgttgggtttgggggaagaggaagactgacggtccccaggagttcagggtgctgggcacagcggccctgggctgcctggtcaaggctacttccnctctcgactctgagcgggctggctaaggcgcataggnnnnnnnnnnnnnnnnnnnnnnnnnnn

SEQ ID NO: 21270 - DNA, 173 bp, Homo sapiens; identical to SEQ ID NO: 20229
  misc_feature: GYAE6OF02JCEA6.49.53.E09.1.454.CMB.1.raw
  modified_base (173)..(173): a, c, t, g, unknown or other
  misc_feature (173)..(173): n is a, c, g, or t

SEQ ID NO: 21271 - DNA, 170 bp, Homo sapiens
  misc_feature: GYAE6OF02HZXK6.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgtgggtttggggaagaggaagactgacggtccccaggagttcaggtgctgggcacagcggccctgggctgcctggtcaaggactacttcctctctcgactctgagcgggctggcaaggcgcatagn

SEQ ID NO: 21272 - DNA, 172 bp, Homo sapiens; identical to SEQ ID NO: 20254
  misc_feature: GYAE6OF02G6VSZ.49.53.E09.1.454.CMB.1.raw
  modified_base (171)..(172): a, c, t, g, unknown or other
  misc_feature (171)..(172): n is a, c, g, or t

SEQ ID NO: 21273 - DNA, 173 bp, Homo sapiens; identical to SEQ ID NO: 20229
  misc_feature: GYAE6OF02GEPUA.49.53.E09.1.454.CMB.1.raw
  modified_base (173)..(173): a, c, t, g, unknown or other
  misc_feature (173)..(173): n is a, c, g, or t

SEQ ID NO: 21274 - DNA, 174 bp, Homo sapiens; identical to SEQ ID NO: 20265
  misc_feature: GYAE6OF02GLMY4.49.53.E09.1.454.CMB.1.raw
  modified_base (173)..(174): a, c, t, g, unknown or other
  misc_feature (173)..(174): n is a, c, g, or t

SEQ ID NO: 21275 - DNA, 173 bp, Homo sapiens; identical to SEQ ID NO: 20229
  misc_feature: GYAE6OF02H2SK3.49.53.E09.1.454.CMB.1.raw
  modified_base (173)..(173): a, c, t, g, unknown or other
  misc_feature (173)..(173): n is a, c, g, or t

SEQ ID NO: 21276 - DNA, 173 bp, Homo sapiens; identical to SEQ ID NO: 20229
  misc_feature: GYAE6OF02GPRMG.49.53.E09.1.454.CMB.1.raw
  modified_base (173)..(173): a, c, t, g, unknown or other
  misc_feature (173)..(173): n is a, c, g, or t

SEQ ID NO: 21277 - DNA, 173 bp, Homo sapiens; identical to SEQ ID NO: 20229
  misc_feature: GYAE6OF02GR706.49.53.E09.1.454.CMB.1.raw
  modified_base (173)..(173): a, c, t, g, unknown or other
  misc_feature (173)..(173): n is a, c, g, or t

SEQ ID NO: 21278 - DNA, 213 bp, Homo sapiens
  misc_feature: GYAE6OF02H4FTB.49.53.E09.1.454.CMB.1.raw
  modified_base (178)..(179): a, c, t, g, unknown or other
  misc_feature (178)..(179): n is a, c, g, or t
  modified_base (181)..(213): a, c, t, g, unknown or other
  misc_feature (181)..(213): n is a, c, g, or t
tcagagtcgagagacacgaccggtgctcgatttagagagagtgtgttgggtttgggggaagaggaagactgacgggtcccccaggagttcaggtgctgggcacagcggccctgggctgcctggtcaagggactacttcctctctcgactctgagtcgggctggcaaggcgtccatagnntnnnnnnnnnnnnnnnnnnnnnnnnnnnnnnnnn

SEQ ID NO: 21279 - DNA, 175 bp, Homo sapiens; identical to SEQ ID NO: 20418
  misc_feature: GYAE6OF02JANJ3.49.53.E09.1.454.CMB.1.raw
  modified_base (173)..(175): a, c, t, g, unknown or other
  misc_feature (173)..(175): n is a, c, g, or t

SEQ ID NO: 21280 - DNA, 181 bp, Homo sapiens
  misc_feature: GYAE6OF02I0480.49.53.E09.1.454.CMB.1.raw
  modified_base (172)..(181): a, c, t, g, unknown or other
  misc_feature (172)..(181): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctctctcgactctgagcgggctggcaaggcgcatagnnnnnnnnnn

SEQ ID NO: 21281 - DNA, 170 bp, Homo sapiens
  misc_feature: GYAE6OF02FH1B2.49.53.E09.1.454.CMB.1.raw
  modified_base (170)..(170): a, c, t, g, unknown or other
  misc_feature (170)..(170): n is a, c, g, or t
tcagagtcgagagacacgaccggtgctcgatttagagagagtgtgttgggtttggggaagaggaagactgacggtccccaggagttcaggtgctgggcacagcggccctgggctgcctggtcaaggactacttcctctctcgactctgagcggctggcaaggcgcatagn

SEQ ID NO: 21282 - DNA, 171 bp, Homo sapiens; identical to SEQ ID NO: 20210
  misc_feature: GYAE6OF02GPO81.49.53.E09.1.454.CMB.1.raw
  modified_base (171)..(171): a, c, t, g, unknown or other
  misc_feature (171)..(171): n is a, c, g, or t

SEQ ID NO: 21283 - DNA, 209 bp, Homo sapiens
  misc_feature: GYAE6OF02GYZNO.49.53.E09.1.454.CMB.1.raw
  modified_base (175)..(209): a, c, t, g, unknown or other
  misc_feature (175)..(209): n is a, c, g, or t
tcagagtcgagagacacgaccggtgctcgatttagagagagtgtgttgggtttggggaagaggaagactgacggtccccgaggagttcaggtgctgggcacagcggccctgggctgcctggtcaaggtactacttacctctctcggactctgagcgggctggcaaggcgcatagnnnnnnnnnnnnnnnnnnnnnnnnnnnnnnnnnnn

SEQ ID NO: 21284 - DNA, 173 bp, Homo sapiens; identical to SEQ ID NO: 20337
  misc_feature: GYAE6OF02FULTY.49.53.E09.1.454.CMB.1.raw
  modified_base (173)..(173): a, c, t, g, unknown or other
  misc_feature (173)..(173): n is a, c, g, or t

SEQ ID NO: 21285 - DNA, 171 bp, Homo sapiens; identical to SEQ ID NO: 20210
  misc_feature: GYAE6OF02GLJ9V.49.53.E09.1.454.CMB.1.raw
  modified_base (171)..(171): a, c, t, g, unknown or other
  misc_feature (171)..(171): n is a, c, g, or t

SEQ ID NO: 21286 - DNA, 174 bp, Homo sapiens; identical to SEQ ID NO: 20265
  misc_feature: GYAE6OF02F7JL4.49.53.E09.1.454.CMB.1.raw
  modified_base (173)..(174): a, c, t, g, unknown or other
  misc_feature (173)..(174): n is a, c, g, or t

SEQ ID NO: 21287 - DNA, 195 bp, Homo sapiens
  misc_feature: GYAE6OF02FQKDZ.49.53.E09.1.454.CMB.1.raw
  modified_base (176)..(195): a, c, t, g, unknown or other
  misc_feature (176)..(195): n is a, c, g, or t
tcagagtcgagagacacgaccggtgctcgatttagagagagtgtgttgggtttgggggaacgaggaagactgacggtccccgaggagttcaggtgctgggcacagcggcctggctgcctcggtcaaggacctacttcctactctcgactctggagcgggctggcaaggcgcatagnnnnnnnnnnnnnnnnnnnn

SEQ ID NO: 21288 - DNA, 171 bp, Homo sapiens; identical to SEQ ID NO: 20210
  misc_feature: GYAE6OF02IKFY8.49.53.E09.1.454.CMB.1.raw
  modified_base (171)..(171): a, c, t, g, unknown or other
  misc_feature (171)..(171): n is a, c, g, or t

SEQ ID NO: 21289 - DNA, 205 bp, Homo sapiens
  misc_feature: GYAE6OF02G0817.49.53.E09.1.454.CMB.1.raw
  modified_base (176)..(205): a, c, t, g, unknown or other
  misc_feature (176)..(205): n is a, c, g, or t
tcagagtcgagagacacgaccggtgctcgatttagagagagtgtggttgggtttgggggaagaggaagactgacggtcccccaggagttcaggtgctgggcacagcggccctgggctgccgtggtcaaggactacttcctctctcgactctgagcgggctggcaaggcgcatacgnnnnnnnnnnnnnnnnnnnnnnnnnnnnnn

SEQ ID NO: 21290 - DNA, 175 bp, Homo sapiens; identical to SEQ ID NO: 20418
  misc_feature: GYAE6OF02G0INF.49.53.E09.1.454.CMB.1.raw
  modified_base (173)..(175): a, c, t, g, unknown or other
  misc_feature (173)..(175): n is a, c, g, or t

SEQ ID NO: 21291 - DNA, 171 bp, Homo sapiens; identical to SEQ ID NO: 20210
  misc_feature: GYAE6OF02HAJ88.49.53.E09.1.454.CMB.1.raw
  modified_base (171)..(171): a, c, t, g, unknown or other
  misc_feature (171)..(171): n is a, c, g, or t

SEQ ID NO: 21292 - DNA, 220 bp, Homo sapiens
  misc_feature: GYAE6OF02G3PS8.49.53.E09.1.454.CMB.1.raw
  modified_base (177)..(220): a, c, t, g, unknown or other
  misc_feature (177)..(220): n is a, c, g, or t
tcagagtcgagagacacgaccggtgctcgatttagagagagtgtgttgggtttgggggaagaggaagactgacggttcccccaggagttcgaggtgctgggcacgagcggccctgggctagcctggtcaaggactacttcctctctcgactctgagcgggctggcaaggcgcatagnnnnnnnnnnnnnnnnnnnnnnnnnnnnnnnnnnnnnnnnnnnn

SEQ ID NO: 21293 - DNA, 488 bp, Homo sapiens
  misc_feature: GYAE6OF02I971A.49.53.E09.1.454.CMB.1.raw
  modified_base (385)..(385): a, c, t, g, unknown or other
  misc_feature (385)..(385): n is a, c, g, or t
  modified_base (408)..(408): a, c, t, g, unknown or other
  misc_feature (408)..(408): n is a, c, g, or t
  modified_base (436)..(436): a, c, t, g, unknown or other
  misc_feature (436)..(436): n is a, c, g, or t
tcagagtcgagagacacgaccggtgctcgatttagagagagtgtgttgggtttggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggnagaggacgaggctgactattacngtcagtcatcagacagtagtgcacttcngtcgtattcggcggaagggaccaagctgaccgtctaggcagcccaggctccg

SEQ ID NO: 21294 - DNA, 199 bp, Homo sapiens
  misc_feature: GYAE6OF02H6MF2.49.53.E09.1.454.CMB.1.raw
  modified_base (195)..(199): a, c, t, g, unknown or other
  misc_feature (195)..(199): n is a, c, g, or t
tcagagtcgagagacacgaccggtgctcgatttagagagagtgtgttgggtttgggggaagaggaagactgacggtcccccaggagttcaggtgctgggcacagcggccctgggctcgcgtgtacgaagtacttacttcctctcgtcgtactcgtaggacggccggtcgtcggacgaacgggccgactaagtagnnnnn

SEQ ID NO: 21295 - DNA, 173 bp, Homo sapiens; identical to SEQ ID NO: 20229
  misc_feature: GYAE6OF02I1HKX.49.53.E09.1.454.CMB.1.raw
  modified_base (173)..(173): a, c, t, g, unknown or other
  misc_feature (173)..(173): n is a, c, g, or t

SEQ ID NO: 21296 - DNA, 175 bp, Homo sapiens
  misc_feature: GYAE6OF02IHLON.49.53.E09.1.454.CMB.1.raw
  modified_base (174)..(175): a, c, t, g, unknown or other
  misc_feature (174)..(175): n is a, c, g, or t
tcagagtcgagagacacgaccggtgctcgatttagagagagtgtgttggggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 21297 - DNA, 173 bp, Homo sapiens; identical to SEQ ID NO: 20229
  misc_feature: GYAE6OF02HN5US.49.53.E09.1.454.CMB.1.raw
  modified_base (173)..(173): a, c, t, g, unknown or other
  misc_feature (173)..(173): n is a, c, g, or t

SEQ ID NO: 21298 - DNA, 179 bp, Homo sapiens; identical to SEQ ID NO: 20397
  misc_feature: GYAE6OF02GMVIR.49.53.E09.1.454.CMB.1.raw
  modified_base (173)..(179): a, c, t, g, unknown or other
  misc_feature (173)..(179): n is a, c, g, or t

SEQ ID NO: 21299 - DNA, 188 bp, Homo sapiens
  misc_feature: GYAE6OF02HUGI0.49.53.E09.1.454.CMB.1.raw
  modified_base (174)..(188): a, c, t, g, unknown or other
  misc_feature (174)..(188): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggctaaggcgcatagnnnnnnnnnnnnnnn

SEQ ID NO: 21300 - DNA, 244 bp, Homo sapiens
  misc_feature: GYAE6OF02GXV2N.49.53.E09.1.454.CMB.1.raw
  modified_base (170)..(170): a, c, t, g, unknown or other
  misc_feature (170)..(170): n is a, c, g, or t
  modified_base (176)..(176): a, c, t, g, unknown or other
  misc_feature (176)..(176): n is a, c, g, or t
  modified_base (178)..(244): a, c, t, g, unknown or other
  misc_feature (178)..(244): n is a, c, g, or t
tcagagtcgagagacacgaccggtgctcgatttagagagagtgtgttgggttgggggaagaggaagaactgaccggtcccccagggagttcacggtgctgggcacagcggccctgggctgcctggtcaaggctacttcctctctcgactctgagcgggctgggcaaggcncatagntnnnnnnnnnnnnnnnnnnnnnnnnnnnnnnnnnnnnnnnnnnnnnnnnnnnnnnnnnnnnnnnnnnn

SEQ ID NO: 21301 - DNA, 175 bp, Homo sapiens; identical to SEQ ID NO: 20418
  misc_feature: GYAE6OF02HFC87.49.53.E09.1.454.CMB.1.raw
  modified_base (173)..(175): a, c, t, g, unknown or other
  misc_feature (173)..(175): n is a, c, g, or t

SEQ ID NO: 21302 - DNA, 173 bp, Homo sapiens; identical to SEQ ID NO: 20229
  misc_feature: GYAE6OF02HQLJ3.49.53.E09.1.454.CMB.1.raw
  modified_base (173)..(173): a, c, t, g, unknown or other
  misc_feature (173)..(173): n is a, c, g, or t

SEQ ID NO: 21303 - DNA, 174 bp, Homo sapiens; identical to SEQ ID NO: 20265
  misc_feature: GYAE6OF02IACMZ.49.53.E09.1.454.CMB.1.raw
  modified_base (173)..(174): a, c, t, g, unknown or other
  misc_feature (173)..(174): n is a, c, g, or t

SEQ ID NO: 21304 - DNA, 185 bp, Homo sapiens
  misc_feature: GYAE6OF02IPD87.49.53.E09.1.454.CMB.1.raw
  modified_base (174)..(185): a, c, t, g, unknown or other
  misc_feature (174)..(185): n is a, c, g, or t
tcagagtcgagagacacgaccggtgctcgatttagagagagtgtgttgggtttgggggaagagggaagactgacggtcccccaggagttcaggtgctgggcacagcggccctgggctgcctggtcaaggactacttcctctctcgactctgagcgggctggcaaggcgcatagnnnnnnnnnnnn

SEQ ID NO: 21305 - DNA, 172 bp, Homo sapiens; identical to SEQ ID NO: 20257
  misc_feature: GYAE6OF02HIWOG.49.53.E09.1.454.CMB.1.raw
  modified_base (170)..(172): a, c, t, g, unknown or other
  misc_feature (170)..(172): n is a, c, g, or t

SEQ ID NO: 21306 - DNA, 176 bp, Homo sapiens
  misc_feature: GYAE6OF02JH58C.49.53.E09.1.454.CMB.1.raw
  modified_base (176)..(176): a, c, t, g, unknown or other
  misc_feature (176)..(176): n is a, c, g, or t
tcagagtcgagagacacgaccggtgctcgatttagagagagtgtgttgggtttgggggtaaggaggaagactgacggtcccccacggagttcaggtgctgggcacagcggccctgggctgcctggtcaaggactacttcctctctcgactctgagcgggctggcaaggcgcatagn

SEQ ID NO: 21307 - DNA, 176 bp, Homo sapiens; identical to SEQ ID NO: 20270
  misc_feature: GYAE6OF02H65MN.49.53.E09.1.454.CMB.1.raw
  modified_base (173)..(176): a, c, t, g, unknown or other
  misc_feature (173)..(176): n is a, c, g, or t

SEQ ID NO: 21308 - DNA, 186 bp, Homo sapiens; identical to SEQ ID NO: 20381
  misc_feature: GYAE6OF02IAFVP.49.53.E09.1.454.CMB.1.raw
  modified_base (173)..(186): a, c, t, g, unknown or other
  misc_feature (173)..(186): n is a, c, g, or t

SEQ ID NO: 21309 - DNA, 174 bp, Homo sapiens; identical to SEQ ID NO: 20265
  misc_feature: GYAE6OF02FMRU1.49.53.E09.1.454.CMB.1.raw
  modified_base (173)..(174): a, c, t, g, unknown or other
  misc_feature (173)..(174): n is a, c, g, or t

SEQ ID NO: 21310 - DNA, 173 bp, Homo sapiens; identical to SEQ ID NO: 20229
  misc_feature: GYAE6OF02IUKMB.49.53.E09.1.454.CMB.1.raw
  modified_base (173)..(173): a, c, t, g, unknown or other
  misc_feature (173)..(173): n is a, c, g, or t

SEQ ID NO: 21311 - DNA, 174 bp, Homo sapiens; identical to SEQ ID NO: 21203
  misc_feature: GYAE6OF02GZOGA.49.53.E09.1.454.CMB.1.raw
  modified_base (172)..(174): a, c, t, g, unknown or other
  misc_feature (172)..(174): n is a, c, g, or t

SEQ ID NO: 21312 - DNA, 185 bp, Homo sapiens
  misc_feature: GYAE6OF02IXHV1.49.53.E09.1.454.CMB.1.raw
  modified_base (173)..(185): a, c, t, g, unknown or other
  misc_feature (173)..(185): n is a, c, g, or t
tcagagtcgagagacacgaccggtgctcgatttagagagagtgtgttgggtttgggggaaggaggaagactgacggtccccaggagttcaggtgctgggcacagcggccctgggctgcctggtcaaggactacttcctctctcgactctgagcgggctggcaaggcgcatagnnnnnnnnnnnnn

SEQ ID NO: 21313 - DNA, 179 bp, Homo sapiens
  misc_feature: GYAE6OF02INNP7.49.53.E09.1.454.CMB.1.raw
  modified_base (172)..(179): a, c, t, g, unknown or other
  misc_feature (172)..(179): n is a, c, g, or t
tcagagtcgagagacacgaccggtgctcgatttagagagagtgtgttgggtttgggggaagaggaagactgacggtcccccaggagttcaggtgctgggcacagcggcctgggctgcctggtcaaggactacttcctctctcgactctgagcgggctggcaaggcgcatagnnnnnnnn

SEQ ID NO: 21314 - DNA, 172 bp, Homo sapiens; identical to SEQ ID NO: 20400
  misc_feature: GYAE6OF02I2ZFY.49.53.E09.1.454.CMB.1.raw
  modified_base (172)..(172): a, c, t, g, unknown or other
  misc_feature (172)..(172): n is a, c, g, or t

SEQ ID NO: 21315 - DNA, 204 bp, Homo sapiens
  misc_feature: GYAE6OF02ISZ77.49.53.E09.1.454.CMB.1.raw
  modified_base (175)..(204): a, c, t, g, unknown or other
  misc_feature (175)..(204): n is a, c, g, or t
tcagagtcgagagacacgaccggtgctcgatttagagagagtgtgttgggtttgggggaagaggagactgacggtcccccaggagttcgaggtgctgggccacagcggccctgggctgccctggtcaaggactacttcctctctcgactctgagcgggctggcaaggcgcatagnnnnnnnnnnnnnnnnnnnnnnnnnnnnnn

SEQ ID NO: 21316 - DNA, 171 bp, Homo sapiens; identical to SEQ ID NO: 20210
  misc_feature: GYAE6OF02I94PZ.49.53.E09.1.454.CMB.1.raw
  modified_base (171)..(171): a, c, t, g, unknown or other
  misc_feature (171)..(171): n is a, c, g, or t

SEQ ID NO: 21317 - DNA, 174 bp, Homo sapiens; identical to SEQ ID NO: 20265
  misc_feature: GYAE6OF02FPSUL.49.53.E09.1.454.CMB.1.raw
  modified_base (173)..(174): a, c, t, g, unknown or other
  misc_feature (173)..(174): n is a, c, g, or t

SEQ ID NO: 21318 - DNA, 173 bp, Homo sapiens; identical to SEQ ID NO: 20229
  misc_feature: GYAE6OF02GMQW2.49.53.E09.1.454.CMB.1.raw
  modified_base (173)..(173): a, c, t, g, unknown or other
  misc_feature (173)..(173): n is a, c, g, or t

SEQ ID NO: 21319 - DNA, 174 bp, Homo sapiens; identical to SEQ ID NO: 20630
  misc_feature: GYAE6OF02G97TC.49.53.E09.1.454.CMB.1.raw
  modified_base (173)..(174): a, c, t, g, unknown or other
  misc_feature (173)..(174): n is a, c, g, or t

SEQ ID NO: 21320 - DNA, 174 bp, Homo sapiens; identical to SEQ ID NO: 20265
  misc_feature: GYAE6OF02GD1J1.49.53.E09.1.454.CMB.1.raw
  modified_base (173)..(174): a, c, t, g, unknown or other
  misc_feature (173)..(174): n is a, c, g, or t

SEQ ID NO: 21321 - DNA, 173 bp, Homo sapiens; identical to SEQ ID NO: 20229
  misc_feature: GYAE6OF02HLUJF.49.53.E09.1.454.CMB.1.raw
  modified_base (173)..(173): a, c, t, g, unknown or other
  misc_feature (173)..(173): n is a, c, g, or t

SEQ ID NO: 21322 - DNA, 173 bp, Homo sapiens; identical to SEQ ID NO: 20229
  misc_feature: GYAE6OF02F8G5D.49.53.E09.1.454.CMB.1.raw
  modified_base (173)..(173): a, c, t, g, unknown or other
  misc_feature (173)..(173): n is a, c, g, or t

SEQ ID NO: 21323 - DNA, 174 bp, Homo sapiens; identical to SEQ ID NO: 20265
  misc_feature: GYAE6OF02HE4OX.49.53.E09.1.454.CMB.1.raw
  modified_base (173)..(174): a, c, t, g, unknown or other
  misc_feature (173)..(174): n is a, c, g, or t

SEQ ID NO: 21324 - DNA, 238 bp, Homo sapiens
  misc_feature: GYAE6OF02GQ87K.49.53.E09.1.454.CMB.1.raw
  modified_base (176)..(177): a, c, t, g, unknown or other
  misc_feature (176)..(177): n is a, c, g, or t
  modified_base (179)..(179): a, c, t, g, unknown or other
  misc_feature (179)..(179): n is a, c, g, or t
  modified_base (181)..(182): a, c, t, g, unknown or other
  misc_feature (181)..(182): n is a, c, g, or t
  modified_base (184)..(184): a, c, t, g, unknown or other
  misc_feature (184)..(184): n is a, c, g, or t
  modified_base (186)..(186): a, c, t, g, unknown or other
  misc_feature (186)..(186): n is a, c, g, or t
  modified_base (188)..(238): a, c, t, g, unknown or other
  misc_feature (188)..(238): n is a, c, g, or t
tcagagtcgagagacacgaccggtgctcgatttagagagagtgtgttggggttgggggaagaggaagactgacggtcccccaggagttcgaggtgctacgggcacagcggccctgggctgcctggtcaaggctacttcctctctcgactctgagcgggactggcaaggcgcatagnngncnntncngnnnnnnnnnnnnnnnnnnnnnnnnnnnnnnnnnnnnnnnnnnnnnnnnnnn

SEQ ID NO: 21325 - DNA, 173 bp, Homo sapiens; identical to SEQ ID NO: 20229
  misc_feature: GYAE6OF02HKJW1.49.53.E09.1.454.CMB.1.raw
  modified_base (173)..(173): a, c, t, g, unknown or other
  misc_feature (173)..(173): n is a, c, g, or t

SEQ ID NO: 21326 - DNA, 173 bp, Homo sapiens; identical to SEQ ID NO: 20229
  misc_feature: GYAE6OF02GDMWU.49.53.E09.1.454.CMB.1.raw
  modified_base (173)..(173): a, c, t, g, unknown or other
  misc_feature (173)..(173): n is a, c, g, or t

SEQ ID NO: 21327 - DNA, 171 bp, Homo sapiens; identical to SEQ ID NO: 20326
  misc_feature: GYAE6OF02IZG05.49.53.E09.1.454.CMB.1.raw
  modified_base (171)..(171): a, c, t, g, unknown or other
  misc_feature (171)..(171): n is a, c, g, or t

SEQ ID NO: 21328 - DNA, 173 bp, Homo sapiens; identical to SEQ ID NO: 20229
  misc_feature: GYAE6OF02H2V1K.49.53.E09.1.454.CMB.1.raw
  modified_base (173)..(173): a, c, t, g, unknown or other
  misc_feature (173)..(173): n is a, c, g, or t

SEQ ID NO: 21329 - DNA, 178 bp, Homo sapiens
  misc_feature: GYAE6OF02G4CDT.49.53.E09.1.454.CMB.1.raw
  modified_base (173)..(178): a, c, t, g, unknown or other
  misc_feature (173)..(178): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnnnnn

SEQ ID NO: 21330 - DNA, 181 bp, Homo sapiens
  misc_feature: GYAE6OF02INS33.49.53.E09.1.454.CMB.1.raw
  modified_base (173)..(181): a, c, t, g, unknown or other
  misc_feature (173)..(181): n is a, c, g, or t
tcagagtcgagagacacgaccggtgctcgatttagagagagtgtgttgggtttgggggaagaggaagactgacggtcccccaggagttcaggtgctgggcacagcggccctgggatgcctggtcaaggactacttcctctctcgactctgagcgggctggcaaggcgcatagnnnnnnnnn

SEQ ID NO: 21331 - DNA, 173 bp, Homo sapiens; identical to SEQ ID NO: 20229
  misc_feature: GYAE6OF02FZ69X.49.53.E09.1.454.CMB.1.raw
  modified_base (173)..(173): a, c, t, g, unknown or other
  misc_feature (173)..(173): n is a, c, g, or t

SEQ ID NO: 21332 - DNA, 183 bp, Homo sapiens
  misc_feature: GYAE6OF02H5LQV.49.53.E09.1.454.CMB.1.raw
  modified_base (172)..(183): a, c, t, g, unknown or other
  misc_feature (172)..(183): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctctctcgactctgagcgggctggcaaggcgcatagnnnnnnnnnnnn

SEQ ID NO: 21333 - DNA, 173 bp, Homo sapiens; identical to SEQ ID NO: 20229
  misc_feature: GYAE6OF02HPQI9.49.53.E09.1.454.CMB.1.raw
  modified_base (173)..(173): a, c, t, g, unknown or other
  misc_feature (173)..(173): n is a, c, g, or t

SEQ ID NO: 21334 - DNA, 184 bp, Homo sapiens
  misc_feature: GYAE6OF02GRZCI.49.53.E09.1.454.CMB.1.raw
  modified_base (174)..(184): a, c, t, g, unknown or other
  misc_feature (174)..(184): n is a, c, g, or t
tcagagtcgagagacacgaccggtgctcgatttagagagagtgtgttgggtttgggggaagaggaagactgacggtccccaggagttcaggtgctgggccacagcggccctgggctgccctggtcaaggactacttcctctctcgactctgagcgggctggcaaggcgcatagnnnnnnnnnnn

SEQ ID NO: 21335 - DNA, 173 bp, Homo sapiens; identical to SEQ ID NO: 20337
  misc_feature: GYAE6OF02I97FN.49.53.E09.1.454.CMB.1.raw
  modified_base (173)..(173): a, c, t, g, unknown or other
  misc_feature (173)..(173): n is a, c, g, or t

SEQ ID NO: 21336 - DNA, 173 bp, Homo sapiens; identical to SEQ ID NO: 20229
  misc_feature: GYAE6OF02JB4SL.49.53.E09.1.454.CMB.1.raw
  modified_base (173)..(173): a, c, t, g, unknown or other
  misc_feature (173)..(173): n is a, c, g, or t

SEQ ID NO: 21337 - DNA, 182 bp, Homo sapiens
  misc_feature: GYAE6OF02H2NOZ.49.53.E09.1.454.CMB.1.raw
  modified_base (174)..(182): a, c, t, g, unknown or other
  misc_feature (174)..(182): n is a, c, g, or t
tcagagtcgagagacacgaccggtgctcgatttagagagagtgtgttgggtttgggggaagaggaagacgtgacggtcccccaggagttcaggtgctgggcacagcggccctgggctgcctggtcaaggactacttcctctctcgactctgagcgggctggcaaggcgcatagnnnnnnnnn

SEQ ID NO: 21338 - DNA, 173 bp, Homo sapiens
  misc_feature: GYAE6OF02HDM0H.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaggaagactgacggtcccccaggagttcaggtgctgggcacagcggccatgggctgcctggtcaaggactacttcctctctcgactctgagcgggctggcaaggcgcatagn

SEQ ID NO: 21339 - DNA, 178 bp, Homo sapiens; identical to SEQ ID NO: 20465
  misc_feature: GYAE6OF02IRRL5.49.53.E09.1.454.CMB.1.raw
  modified_base (173)..(178): a, c, t, g, unknown or other
  misc_feature (173)..(178): n is a, c, g, or t

SEQ ID NO: 21340 - DNA, 172 bp, Homo sapiens; identical to SEQ ID NO: 20400
  misc_feature: GYAE6OF02HSOJO.49.53.E09.1.454.CMB.1.raw
  modified_base (172)..(172): a, c, t, g, unknown or other
  misc_feature (172)..(172): n is a, c, g, or t

SEQ ID NO: 21341 - DNA, 173 bp, Homo sapiens; identical to SEQ ID NO: 20295
  misc_feature: GYAE6OF02G4Y28.49.53.E09.1.454.CMB.1.raw
  modified_base (172)..(173): a, c, t, g, unknown or other
  misc_feature (172)..(173): n is a, c, g, or t

SEQ ID NO: 21342 - DNA, 175 bp, Homo sapiens; identical to SEQ ID NO: 20418
  misc_feature: GYAE6OF02HV08Y.49.53.E09.1.454.CMB.1.raw
  modified_base (173)..(175): a, c, t, g, unknown or other
  misc_feature (173)..(175): n is a, c, g, or t

SEQ ID NO: 21343 - DNA, 193 bp, Homo sapiens
  misc_feature: GYAE6OF02ICBBW.49.53.E09.1.454.CMB.1.raw
  modified_base (173)..(193): a, c, t, g, unknown or other
  misc_feature (173)..(193): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnnnnnnnnnnnnnnnnnnnn

SEQ ID NO: 21344 - DNA, 209 bp, Homo sapiens
  misc_feature: GYAE6OF02IDLFE.49.53.E09.1.454.CMB.1.raw
  modified_base (173)..(209): a, c, t, g, unknown or other
  misc_feature (173)..(209): n is a, c, g, or t
tcagagtcgagagacacgaccggtgctcgatttagagagagtgtggttgggtttgggggaagaggaagacgtgacggtcccccaggagttcaggtgctgggcacagcggcctggctgcctggtcaaggactacttcctctctcgactctgagcgggctggcaaggcgcatagnnnnnnnnnnnnnnnnnnnnnnnnnnnnnnnnnnnnn

SEQ ID NO: 21345 - DNA, 174 bp, Homo sapiens; identical to SEQ ID NO: 20265
  misc_feature: GYAE6OF02I7JV9.49.53.E09.1.454.CMB.1.raw
  modified_base (173)..(174): a, c, t, g, unknown or other
  misc_feature (173)..(174): n is a, c, g, or t

SEQ ID NO: 21346 - DNA, 173 bp, Homo sapiens; identical to SEQ ID NO: 20229
  misc_feature: GYAE6OF02G89IA.49.53.E09.1.454.CMB.1.raw
  modified_base (173)..(173): a, c, t, g, unknown or other
  misc_feature (173)..(173): n is a, c, g, or t

SEQ ID NO: 21347 - DNA, 173 bp, Homo sapiens; identical to SEQ ID NO: 20229
  misc_feature: GYAE6OF02F86QU.49.53.E09.1.454.CMB.1.raw
  modified_base (173)..(173): a, c, t, g, unknown or other
  misc_feature (173)..(173): n is a, c, g, or t

SEQ ID NO: 21348 - DNA, 188 bp, Homo sapiens
  misc_feature: GYAE6OF02FUB40.49.53.E09.1.454.CMB.1.raw
  modified_base (175)..(188): a, c, t, g, unknown or other
  misc_feature (175)..(188): n is a, c, g, or t
tcagagtcgagagacacgaccggtgctcgatttagagagagtgtgttgggtttgggggaagaggaagactgacggtcccccaggagttcaggtgctgggcacagcggccctgggcctgcctggtcaacggactacttcctctctcgactctgagcgggctggcaaggcgcatagnnnnnnnnnnnnnn

SEQ ID NO: 21349 - DNA, 195 bp, Homo sapiens; identical to SEQ ID NO: 20647
  misc_feature: GYAE6OF02FWE3D.49.53.E09.1.454.CMB.1.raw
  modified_base (173)..(195): a, c, t, g, unknown or other
  misc_feature (173)..(195): n is a, c, g, or t

SEQ ID NO: 21350 - DNA, 174 bp, Homo sapiens; identical to SEQ ID NO: 20265
  misc_feature: GYAE6OF02GRNAV.49.53.E09.1.454.CMB.1.raw
  modified_base (173)..(174): a, c, t, g, unknown or other
  misc_feature (173)..(174): n is a, c, g, or t

SEQ ID NO: 21351 - DNA, 173 bp, Homo sapiens; identical to SEQ ID NO: 20229
  misc_feature: GYAE6OF02HELGN.49.53.E09.1.454.CMB.1.raw
  modified_base (173)..(173): a, c, t, g, unknown or other
  misc_feature (173)..(173): n is a, c, g, or t

SEQ ID NO: 21352 - DNA, 173 bp, Homo sapiens; identical to SEQ ID NO: 20337
  misc_feature: GYAE6OF02I2LAN.49.53.E09.1.454.CMB.1.raw
  modified_base (173)..(173): a, c, t, g, unknown or other
  misc_feature (173)..(173): n is a, c, g, or t

SEQ ID NO: 21353 - DNA, 174 bp, Homo sapiens; identical to SEQ ID NO: 20265
  misc_feature: GYAE6OF02F1I74.49.53.E09.1.454.CMB.1.raw
  modified_base (173)..(174): a, c, t, g, unknown or other
  misc_feature (173)..(174): n is a, c, g, or t

SEQ ID NO: 21354 - DNA, 197 bp, Homo sapiens
  misc_feature: GYAE6OF02H8UNT.49.53.E09.1.454.CMB.1.raw
  modified_base (172)..(197): a, c, t, g, unknown or other
  misc_feature (172)..(197): n is a, c, g, or t
tcagagtcgagagacacgaccggtgctcgatttagagagagtgtgttgggtttgggggaagaggaagactgacggtcccccaggagttcaggtgctgggcacagcggcctgggctgcctggtcaaaggactacttcctctctcgacctgagcgggctggcaaggcgcatagnnnnnnnnnnnnnnnnnnnnnnnnnn

SEQ ID NO: 21355 - DNA, 175 bp, Homo sapiens; identical to SEQ ID NO: 20418
  misc_feature: GYAE6OF02F0ZK4.49.53.E09.1.454.CMB.1.raw
  modified_base (173)..(175): a, c, t, g, unknown or other
  misc_feature (173)..(175): n is a, c, g, or t

SEQ ID NO: 21356 - DNA, 174 bp, Homo sapiens
  misc_feature: GYAE6OF02GQFBQ.49.53.E09.1.454.CMB.1.raw
  modified_base (173)..(174): a, c, t, g, unknown or other
  misc_feature (173)..(174): n is a, c, g, or t
tcagagtcgagagacacgaccggtgctcgatttagagagagtgtgttgggtttgggggaagaggaagactgacggtcccccaggagttcaggtgctgggcacagcggacctgggctgcctggtcaaggactacttcctctctcgactctgagcgggctggcaaggcgcatagnn

SEQ ID NO: 21357 - DNA, 184 bp, Homo sapiens
  misc_feature: GYAE6OF02JS7K5.49.53.E09.1.454.CMB.1.raw
  modified_base (174)..(184): a, c, t, g, unknown or other
  misc_feature (174)..(184): n is a, c, g, or t
tcagagtcgagagacacgaccggtgctcgatttagagagagtgtgttgggtttgggggaaggaggaagactgacggtcccccaggagttcaggtgctgggcacagcggccctgggctgcctggtcaaggactacttcctctctcgactctgagcgggctggcaaggcgcatagnnnnnnnnnnn

SEQ ID NO: 21358 - DNA, 174 bp, Homo sapiens; identical to SEQ ID NO: 20265
  misc_feature: GYAE6OF02G5Q9B.49.53.E09.1.454.CMB.1.raw
  modified_base (173)..(174): a, c, t, g, unknown or other
  misc_feature (173)..(174): n is a, c, g, or t

SEQ ID NO: 21359 - DNA, 174 bp, Homo sapiens; identical to SEQ ID NO: 20265
  misc_feature: GYAE6OF02FMBNW.49.53.E09.1.454.CMB.1.raw
  modified_base (173)..(174): a, c, t, g, unknown or other
  misc_feature (173)..(174): n is a, c, g, or t

SEQ ID NO: 21360 - DNA, 191 bp, Homo sapiens
  misc_feature: GYAE6OF02GPTNE.49.53.E09.1.454.CMB.1.raw
  modified_base (176)..(191): a, c, t, g, unknown or other
  misc_feature (176)..(191): n is a, c, g, or t
tcagagtcgagagacacgaccggtgctcgatttagagagagtgtggttgggtttgggggaagaggaagactgacggtcccccaggagttcaggtgctgggccacagcggccctgggcgtgcctggtcaaggactacttcctctctcgactctgagcgggctggcaaggcgcatagnnnnnnnnnnnnnnnn

SEQ ID NO: 21361 - DNA, 173 bp, Homo sapiens; identical to SEQ ID NO: 20229
  misc_feature: GYAE6OF02GYX6M.49.53.E09.1.454.CMB.1.raw
  modified_base (173)..(173): a, c, t, g, unknown or other
  misc_feature (173)..(173): n is a, c, g, or t

SEQ ID NO: 21362 - DNA, 173 bp, Homo sapiens; identical to SEQ ID NO: 20229
  misc_feature: GYAE6OF02I9HLL.49.53.E09.1.454.CMB.1.raw
  modified_base (173)..(173): a, c, t, g, unknown or other
  misc_feature (173)..(173): n is a, c, g, or t

SEQ ID NO: 21363 - DNA, 176 bp, Homo sapiens
  misc_feature: GYAE6OF02IJBGI.49.53.E09.1.454.CMB.1.raw
  modified_base (173)..(176): a, c, t, g, unknown or other
  misc_feature (173)..(176): n is a, c, g, or t
tcagagtcgagagacacgaccggtgctcgatttagagagagtgtgttgggtttggggaagaggaagactgacggtcccccaggagttcaggtgcgtgggcacagcggccctgggctgcctggtcaaggactacttcctctctcgactctgagcgggctggcaaggcgcatagnnnn

SEQ ID NO: 21364 - DNA, 173 bp, Homo sapiens; identical to SEQ ID NO: 20229
  misc_feature: GYAE6OF02HCH77.49.53.E09.1.454.CMB.1.raw
  modified_base (173)..(173): a, c, t, g, unknown or other
  misc_feature (173)..(173): n is a, c, g, or t

SEQ ID NO: 21365 - DNA, 203 bp, Homo sapiens
  misc_feature: GYAE6OF02ILV7Q.49.53.E09.1.454.CMB.1.raw
  modified_base (175)..(203): a, c, t, g, unknown or other
  misc_feature (175)..(203): n is a, c, g, or t
tcagagtcgagagacacgaccggtgctcgatttagagagagtgtgttgggtttgggggaacgaaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnnnnnnnnnn

SEQ ID NO: 21366 - DNA, 173 bp, Homo sapiens; identical to SEQ ID NO: 20229
  misc_feature: GYAE6OF02GQPHL.49.53.E09.1.454.CMB.1.raw
  modified_base (173)..(173): a, c, t, g, unknown or other
  misc_feature (173)..(173): n is a, c, g, or t

SEQ ID NO: 21367 - DNA, 174 bp, Homo sapiens; identical to SEQ ID NO: 20265
  misc_feature: GYAE6OF02HEGCM.49.53.E09.1.454.CMB.1.raw
  modified_base (173)..(174): a, c, t, g, unknown or other
  misc_feature (173)..(174): n is a, c, g, or t

SEQ ID NO: 21368 - DNA, 492 bp, Homo sapiens
  misc_feature: GYAE6OF02GA6W1.49.53.E09.1.454.CMB.1.raw
tcagagtcgagagacacgaccggtgctcgatttagagagagtgtgttgggtttggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagacttttgagagggcctcagggaccccctgagcgattctctggctccagctcagcgacaacagtcacgttgaccatcaagtggagtccgggcagaggacgaggctgactattactgtcagtcatcagacagtagtggcacttctgttcgtattcggcggagggaccaagctgaccgtctaggtcaggcccaggctccg

SEQ ID NO: 21369 - DNA, 178 bp, Homo sapiens; identical to SEQ ID NO: 20465
  misc_feature: GYAE6OF02GO202.49.53.E09.1.454.CMB.1.raw
  modified_base (173)..(178): a, c, t, g, unknown or other
  misc_feature (173)..(178): n is a, c, g, or t

SEQ ID NO: 21370 - DNA, 491 bp, Homo sapiens
  misc_feature: GYAE6OF02JB9AX.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcattataaagactttgagagggctcgagggacccctgagcgattctctggctccagctcagcgacaacagtcacgttgaccatcagtggagtccgggcaggaggacgaggctgactattactgtcagtcatcagacagtagtgctacttctgtcgtattcggcggacgggacaggctgaccgtcgtacgcacgccaggctaccgg

SEQ ID NO: 21371 - DNA, 174 bp, Homo sapiens; identical to SEQ ID NO: 20265
  misc_feature: GYAE6OF02G8183.49.53.E09.1.454.CMB.1.raw
  modified_base (173)..(174): a, c, t, g, unknown or other
  misc_feature (173)..(174): n is a, c, g, or t

SEQ ID NO: 21372 - DNA, 173 bp, Homo sapiens; identical to SEQ ID NO: 20229
  misc_feature: GYAE6OF02GLSO5.49.53.E09.1.454.CMB.1.raw
  modified_base (173)..(173): a, c, t, g, unknown or other
  misc_feature (173)..(173): n is a, c, g, or t

SEQ ID NO: 21373 - DNA, 173 bp, Homo sapiens; identical to SEQ ID NO: 20337
  misc_feature: GYAE6OF02IVARU.49.53.E09.1.454.CMB.1.raw
  modified_base (173)..(173): a, c, t, g, unknown or other
  misc_feature (173)..(173): n is a, c, g, or t

SEQ ID NO: 21374 - DNA, 173 bp, Homo sapiens; identical to SEQ ID NO: 20229
  misc_feature: GYAE6OF02HMK55.49.53.E09.1.454.CMB.1.raw
  modified_base (173)..(173): a, c, t, g, unknown or other
  misc_feature (173)..(173): n is a, c, g, or t

SEQ ID NO: 21375 - DNA, 494 bp, Homo sapiens
  misc_feature: GYAE6OF02HRIXA.49.53.E09.1.454.CMB.1.raw
tcagagtcgagagacacgaccggtgctcgatttagagagagtgtgttgggtttggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcagggacccctgagcgattctctggctccagctcagcgaacaacagtcacgttgaccatcagtggagtccgggcagaggacgaggctgactattactgtcagtcatcagacagtagtgcacttctgttcgtagttcgggacggagggaccaagctgaccgtctaggtcacgccaggcctccg

SEQ ID NO: 21376 - DNA, 173 bp, Homo sapiens; identical to SEQ ID NO: 20229
  misc_feature: GYAE6OF02HWICW.49.53.E09.1.454.CMB.1.raw
  modified_base (173)..(173): a, c, t, g, unknown or other
  misc_feature (173)..(173): n is a, c, g, or t

SEQ ID NO: 21377 - DNA, 173 bp, Homo sapiens; identical to SEQ ID NO: 20229
  misc_feature: GYAE6OF02F2LA4.49.53.E09.1.454.CMB.1.raw
  modified_base (173)..(173): a, c, t, g, unknown or other
  misc_feature (173)..(173): n is a, c, g, or t

SEQ ID NO: 21378 - DNA, 173 bp, Homo sapiens; identical to SEQ ID NO: 20229
  misc_feature: GYAE6OF02HAHKI.49.53.E09.1.454.CMB.1.raw
  modified_base (173)..(173): a, c, t, g, unknown or other
  misc_feature (173)..(173): n is a, c, g, or t

SEQ ID NO: 21379 - DNA, 174 bp, Homo sapiens; identical to SEQ ID NO: 20265
  misc_feature: GYAE6OF02G2ZBE.49.53.E09.1.454.CMB.1.raw
  modified_base (173)..(174): a, c, t, g, unknown or other
  misc_feature (173)..(174): n is a, c, g, or t

SEQ ID NO: 21380 - DNA, 215 bp, Homo sapiens
  misc_feature: GYAE6OF02HBUUB.49.53.E09.1.454.CMB.1.raw
  modified_base (176)..(215): a, c, t, g, unknown or other
  misc_feature (176)..(215): n is a, c, g, or t
tcagagtcgagagacacgaccggtgctcgatttagagagagtgtggttaggggttgggggaagaggaagactgacggtcccccaggagttcaggtgctgggcacagcggccctgggctgcctgggtcaaggactacttcctcgtagcactctgagcgggctggcaaggcgcatagnnnnnnnnnnnnnnnnnnnnnnnnnnnnnnnnnnnnnnnn

SEQ ID NO: 21381 - DNA, 172 bp, Homo sapiens
  misc_feature: GYAE6OF02GIUBB.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgctctgagcgggctggcaaggcgcatagn

SEQ ID NO: 21382 - DNA, 226 bp, Homo sapiens
  misc_feature: GYAE6OF02GLGT7.49.53.E09.1.454.CMB.1.raw
  modified_base (182)..(192): a, c, t, g, unknown or other
  misc_feature (182)..(192): n is a, c, g, or t
  modified_base (194)..(226): a, c, t, g, unknown or other
  misc_feature (194)..(226): n is a, c, g, or t
tcagagtcgagagacacgaccggtgctcgatttagagagagtgtgttgggtttgggggaagaggaagactgacggtcccccaggagttcacggtgcgtgggcacaacgcggccctgggctgccctggtccaaggactacttcctctctcgacctctgagccgggctaggcaaggcgcatagnnnnnnnnnnngnnnnnnnnnnnnnnnnnnnnnnnnnnnnnnnnn

SEQ ID NO: 21383 - DNA, 173 bp, Homo sapiens; identical to SEQ ID NO: 20229
  misc_feature: GYAE6OF02HU6N3.49.53.E09.1.454.CMB.1.raw
  modified_base (173)..(173): a, c, t, g, unknown or other
  misc_feature (173)..(173): n is a, c, g, or t

SEQ ID NO: 21384 - DNA, 174 bp, Homo sapiens; identical to SEQ ID NO: 20523
  misc_feature: GYAE6OF02G6COA.49.53.E09.1.454.CMB.1.raw
  modified_base (174)..(174): a, c, t, g, unknown or other
  misc_feature (174)..(174): n is a, c, g, or t

SEQ ID NO: 21385 - DNA, 174 bp, Homo sapiens; identical to SEQ ID NO: 20265
  misc_feature: GYAE6OF02HLCKY.49.53.E09.1.454.CMB.1.raw
  modified_base (173)..(174): a, c, t, g, unknown or other
  misc_feature (173)..(174): n is a, c, g, or t

SEQ ID NO: 21386 - DNA, 173 bp, Homo sapiens; identical to SEQ ID NO: 20229
  misc_feature: GYAE6OF02ICTMM.49.53.E09.1.454.CMB.1.raw
  modified_base (173)..(173): a, c, t, g, unknown or other
  misc_feature (173)..(173): n is a, c, g, or t

SEQ ID NO: 21387 - DNA, 174 bp, Homo sapiens; identical to SEQ ID NO: 20265
  misc_feature: GYAE6OF02G25C3.49.53.E09.1.454.CMB.1.raw
  modified_base (173)..(174): a, c, t, g, unknown or other
  misc_feature (173)..(174): n is a, c, g, or t

SEQ ID NO: 21388 - DNA, 197 bp, Homo sapiens
  misc_feature: GYAE6OF02G9H61.49.53.E09.1.454.CMB.1.raw
  modified_base (173)..(197): a, c, t, g, unknown or other
  misc_feature (173)..(197): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnnnnnn

SEQ ID NO: 21389 - DNA, 183 bp, Homo sapiens
  misc_feature: GYAE6OF02IEX0A.49.53.E09.1.454.CMB.1.raw
  modified_base (174)..(183): a, c, t, g, unknown or other
  misc_feature (174)..(183): n is a, c, g, or t
tcagagtcgagagacacgaccggtgctcgatttagagagagtgtggttgggtttgggggaagaggaagactgacggtcccccaggagttcaggtgctgggcacagcggccctgggctgcctggtcaaggactacttcctctctcgactctgagcgggctggcaaggcgcatagnnnnnnnnnn

SEQ ID NO: 21390 - DNA, 173 bp, Homo sapiens; identical to SEQ ID NO: 20229
  misc_feature: GYAE6OF02IL1C5.49.53.E09.1.454.CMB.1.raw
  modified_base (173)..(173): a, c, t, g, unknown or other
  misc_feature (173)..(173): n is a, c, g, or t

SEQ ID NO: 21391 - DNA, 174 bp, Homo sapiens; identical to SEQ ID NO: 20265
  misc_feature: GYAE6OF02HICG7.49.53.E09.1.454.CMB.1.raw
  modified_base (173)..(174): a, c, t, g, unknown or other
  misc_feature (173)..(174): n is a, c, g, or t

SEQ ID NO: 21392 - DNA, 174 bp, Homo sapiens; identical to SEQ ID NO: 20265
  misc_feature: GYAE6OF02FKE36.49.53.E09.1.454.CMB.1.raw
  modified_base (173)..(174): a, c, t, g, unknown or other
  misc_feature (173)..(174): n is a, c, g, or t

SEQ ID NO: 21393 - DNA, 227 bp, Homo sapiens
  misc_feature: GYAE6OF02IWNKI.49.53.E09.1.454.CMB.1.raw
  modified_base (204)..(209): a, c, t, g, unknown or other
  misc_feature (204)..(209): n is a, c, g, or t
  modified_base (211)..(211): a, c, t, g, unknown or other
  misc_feature (211)..(211): n is a, c, g, or t
  modified_base (213)..(214): a, c, t, g, unknown or other
  misc_feature (213)..(214): n is a, c, g, or t
  modified_base (216)..(216): a, c, t, g, unknown or other
  misc_feature (216)..(216): n is a, c, g, or t
  modified_base (219)..(227): a, c, t, g, unknown or other
  misc_feature (219)..(227): n is a, c, g, or t
tcagagtcgagagacacgaccggtgctcgatttagagagagtgtgttggggtttggggggaagaggaagactgacggtcccccacggagttcaggtggctgggcgacacgtcgggccctgggggctgcctggtacaaaggacttacgtcctcgtaggcactcgtggacgcggggctgggcctaagggccgacgaattaagtcannnnnngngnngnagnnnnnnnnn

SEQ ID NO: 21394 - DNA, 172 bp, Homo sapiens
  misc_feature: GYAE6OF02GP719.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcactctgagcgggctggcaaggcgcatagn

SEQ ID NO: 21395 - DNA, 172 bp, Homo sapiens; identical to SEQ ID NO: 20400
  misc_feature: GYAE6OF02G3CPL.49.53.E09.1.454.CMB.1.raw
  modified_base (172)..(172): a, c, t, g, unknown or other
  misc_feature (172)..(172): n is a, c, g, or t

SEQ ID NO: 21396 - DNA, 173 bp, Homo sapiens; identical to SEQ ID NO: 20229
  misc_feature: GYAE6OF02HZUJ4.49.53.E09.1.454.CMB.1.raw
  modified_base (173)..(173): a, c, t, g, unknown or other
  misc_feature (173)..(173): n is a, c, g, or t

SEQ ID NO: 21397 - DNA, 173 bp, Homo sapiens; identical to SEQ ID NO: 20229
  misc_feature: GYAE6OF02GBJ9K.49.53.E09.1.454.CMB.1.raw
  modified_base (173)..(173): a, c, t, g, unknown or other
  misc_feature (173)..(173): n is a, c, g, or t

SEQ ID NO: 21398 - DNA, 173 bp, Homo sapiens; identical to SEQ ID NO: 20229
  misc_feature: GYAE6OF02INV9E.49.53.E09.1.454.CMB.1.raw
  modified_base (173)..(173): a, c, t, g, unknown or other
  misc_feature (173)..(173): n is a, c, g, or t

SEQ ID NO: 21399 - DNA, 173 bp, Homo sapiens; identical to SEQ ID NO: 20229
  misc_feature: GYAE6OF02IS29O.49.53.E09.1.454.CMB.1.raw
  modified_base (173)..(173): a, c, t, g, unknown or other
  misc_feature (173)..(173): n is a, c, g, or t

SEQ ID NO: 21400 - DNA, 173 bp, Homo sapiens; identical to SEQ ID NO: 20229
  misc_feature: GYAE6OF02HQMCJ.49.53.E09.1.454.CMB.1.raw
  modified_base (173)..(173): a, c, t, g, unknown or other
  misc_feature (173)..(173): n is a, c, g, or t

SEQ ID NO: 21401 - DNA, 173 bp, Homo sapiens; identical to SEQ ID NO: 20229
  misc_feature: GYAE6OF02GN23L.49.53.E09.1.454.CMB.1.raw
  modified_base (173)..(173): a, c, t, g, unknown or other
  misc_feature (173)..(173): n is a, c, g, or t

SEQ ID NO: 21402 - DNA, 186 bp, Homo sapiens
  misc_feature: GYAE6OF02ILAON.49.53.E09.1.454.CMB.1.raw
  modified_base (173)..(186): a, c, t, g, unknown or other
  misc_feature (173)..(186): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnnnnnnnnnnnnn

SEQ ID NO: 21403 - DNA, 173 bp, Homo sapiens; identical to SEQ ID NO: 20229
  misc_feature: GYAE6OF02IP0C8.49.53.E09.1.454.CMB.1.raw
  modified_base (173)..(173): a, c, t, g, unknown or other
  misc_feature (173)..(173): n is a, c, g, or t

SEQ ID NO: 21404 - DNA, 175 bp, Homo sapiens; identical to SEQ ID NO: 20418
  misc_feature: GYAE6OF02HJNQN.49.53.E09.1.454.CMB.1.raw
  modified_base (173)..(175): a, c, t, g, unknown or other
  misc_feature (173)..(175): n is a, c, g, or t

SEQ ID NO: 21405 - DNA, 174 bp, Homo sapiens; identical to SEQ ID NO: 20265
  misc_feature: GYAE6OF02HEMD1.49.53.E09.1.454.CMB.1.raw
  modified_base (173)..(174): a, c, t, g, unknown or other
  misc_feature (173)..(174): n is a, c, g, or t

SEQ ID NO: 21406 - DNA, 178 bp, Homo sapiens
  misc_feature: GYAE6OF02HYUQB.49.53.E09.1.454.CMB.1.raw
  modified_base (172)..(178): a, c, t, g, unknown or other
  misc_feature (172)..(178): n is a, c, g, or t
tcagagtcgagagacacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnnnn

SEQ ID NO: 21407 - DNA, 173 bp, Homo sapiens; identical to SEQ ID NO: 20229
  misc_feature: GYAE6OF02H96LD.49.53.E09.1.454.CMB.1.raw
  modified_base (173)..(173): a, c, t, g, unknown or other
  misc_feature (173)..(173): n is a, c, g, or t

SEQ ID NO: 21408 - DNA, 180 bp, Homo sapiens
  misc_feature: GYAE6OF02GP27Q.49.53.E09.1.454.CMB.1.raw
  modified_base (173)..(180): a, c, t, g, unknown or other
  misc_feature (173)..(180): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatagnnnnnnnn

SEQ ID NO: 21409 - DNA, 173 bp, Homo sapiens; identical to SEQ ID NO: 20229
  misc_feature: GYAE6OF02IHOXO.49.53.E09.1.454.CMB.1.raw
  modified_base (173)..(173): a, c, t, g, unknown or other
  misc_feature (173)..(173): n is a, c, g, or t

SEQ ID NO: 21410 - DNA, 174 bp, Homo sapiens
  misc_feature: GYAE6OF02IPQPD.49.53.E09.1.454.CMB.1.raw
  modified_base (173)..(174): a, c, t, g, unknown or other
  misc_feature (173)..(174): n is a, c, g, or t
tcagagtcgagagacacgaccggtgctcgatttagagagagtgtgttgcgtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 21411 - DNA, 175 bp, Homo sapiens; identical to SEQ ID NO: 20418
  misc_feature: GYAE6OF02GB11Z.49.53.E09.1.454.CMB.1.raw
  modified_base (173)..(175): a, c, t, g, unknown or other
  misc_feature (173)..(175): n is a, c, g, or t

SEQ ID NO: 21412 - DNA, 173 bp, Homo sapiens; identical to SEQ ID NO: 20229
  misc_feature: GYAE6OF02FK04P.49.53.E09.1.454.CMB.1.raw
  modified_base (173)..(173): a, c, t, g, unknown or other
  misc_feature (173)..(173): n is a, c, g, or t

SEQ ID NO: 21413 - DNA, 174 bp, Homo sapiens; identical to SEQ ID NO: 20265
  misc_feature: GYAE6OF02F0V0O.49.53.E09.1.454.CMB.1.raw
  modified_base (173)..(174): a, c, t, g, unknown or other
  misc_feature (173)..(174): n is a, c, g, or t

SEQ ID NO: 21414 - DNA, 182 bp, Homo sapiens
  misc_feature: GYAE6OF02H38DS.49.53.E09.1.454.CMB.1.raw
  modified_base (172)..(182): a, c, t, g, unknown or other
  misc_feature (172)..(182): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcactctgagcgggctggcaaggcgcatagnnnnnnnnnnn

SEQ ID NO: 21415 - DNA, 221 bp, Homo sapiens
  misc_feature: GYAE6OF02HK64D.49.53.E09.1.454.CMB.1.raw
  modified_base (143)..(143): a, c, t, g, unknown or other
  misc_feature (143)..(143): n is a, c, g, or t
  modified_base (175)..(221): a, c, t, g, unknown or other
  misc_feature (175)..(221): n is a, c, g, or t
tcagagtcgagagacacgaccggtgctcgatttagagagagtgtgttggggttgggggaagaggaagactgacggtcccccaggtagttcaggtgctgggcacagcggcctgggctgcctggtcaaggctacttcctcggtancacgtctgagcgggctggcaaggcgcataggnnnnnnnnnnnnnnnnnnnnnnnnnnnnnnnnnnnnnnnnnnnnnnn

SEQ ID NO: 21416 - DNA, 175 bp, Homo sapiens; identical to SEQ ID NO: 20418
  misc_feature: GYAE6OF02IR7RX.49.53.E09.1.454.CMB.1.raw
  modified_base (173)..(175): a, c, t, g, unknown or other
  misc_feature (173)..(175): n is a, c, g, or t

SEQ ID NO: 21417 - DNA, 173 bp, Homo sapiens; identical to SEQ ID NO: 20229
  misc_feature: GYAE6OF02F9SEC.49.53.E09.1.454.CMB.1.raw
  modified_base (173)..(173): a, c, t, g, unknown or other
  misc_feature (173)..(173): n is a, c, g, or t

SEQ ID NO: 21418 - DNA, 173 bp, Homo sapiens; identical to SEQ ID NO: 20229
  misc_feature: GYAE6OF02FFZ1Q.49.53.E09.1.454.CMB.1.raw
  modified_base (173)..(173): a, c, t, g, unknown or other
  misc_feature (173)..(173): n is a, c, g, or t

SEQ ID NO: 21419 - DNA, 177 bp, Homo sapiens; identical to SEQ ID NO: 20482
  misc_feature: GYAE6OF02HMSDU.49.53.E09.1.454.CMB.1.raw
  modified_base (173)..(177): a, c, t, g, unknown or other
  misc_feature (173)..(177): n is a, c, g, or t

SEQ ID NO: 21420 - DNA, 210 bp, Homo sapiens
  misc_feature: GYAE6OF02ILH0R.49.53.E09.1.454.CMB.1.raw
  modified_base (176)..(210): a, c, t, g, unknown or other
  misc_feature (176)..(210): n is a, c, g, or t
tcagagtcgagagacacgaccggtgctcgatttagagagagtgtgttgggtttgggggaagaggaagactgacggtcccccaggagttcaggtgctgggcaccagcggccctgggctggcctggtcaaggactacttcctcgtagcactctgagcgggctggcaaggcgcatacgnnnnnnnnnnnnnnnnnnnnnnnnnnnnnnnnnnn

SEQ ID NO: 21421 - DNA, 174 bp, Homo sapiens
  misc_feature: GYAE6OF02G5SRV.49.53.E09.1.454.CMB.1.raw
tcagagtcgagagacacgaccggtgctcgatttagagagagtgtgttgggttgggggtaaggaggaagactgacggtcccccacggagttcaggtgctgggcacagcggccctgggctgcctggtcaaggactacttcctctctcgactctgagcgggctggcaaggcgcatag

SEQ ID NO: 21422 - DNA, 172 bp, Homo sapiens; identical to SEQ ID NO: 20254
  misc_feature: GYAE6OF02JDY5F.49.53.E09.1.454.CMB.1.raw
  modified_base (171)..(172): a, c, t, g, unknown or other
  misc_feature (171)..(172): n is a, c, g, or t

SEQ ID NO: 21423 - DNA, 175 bp, Homo sapiens; identical to SEQ ID NO: 20418
  misc_feature: GYAE6OF02JCADI.49.53.E09.1.454.CMB.1.raw
  modified_base (173)..(175): a, c, t, g, unknown or other
  misc_feature (173)..(175): n is a, c, g, or t

SEQ ID NO: 21424 - DNA, 172 bp, Homo sapiens; identical to SEQ ID NO: 20400
  misc_feature: GYAE6OF02FP9H9.49.53.E09.1.454.CMB.1.raw
  modified_base (172)..(172): a, c, t, g, unknown or other
  misc_feature (172)..(172): n is a, c, g, or t

SEQ ID NO: 21425 - DNA, 173 bp, Homo sapiens; identical to SEQ ID NO: 20229
  misc_feature: GYAE6OF02FOMI1.49.53.E09.1.454.CMB.1.raw
  modified_base (173)..(173): a, c, t, g, unknown or other
  misc_feature (173)..(173): n is a, c, g, or t

SEQ ID NO: 21426 - DNA, 175 bp, Homo sapiens; identical to SEQ ID NO: 20418
  misc_feature: GYAE6OF02FHTY9.49.53.E09.1.454.CMB.1.raw
  modified_base (173)..(175): a, c, t, g, unknown or other
  misc_feature (173)..(175): n is a, c, g, or t

SEQ ID NO: 21427 - DNA, 180 bp, Homo sapiens
  misc_feature: GYAE6OF02F0HWN.49.53.E09.1.454.CMB.1.raw
  modified_base (174)..(180): a, c, t, g, unknown or other
  misc_feature (174)..(180): n is a, c, g, or t
tcagagtcgagagacacgaccggtgctcgatttagagagagtgtggttgggtttgggggaagaggaagactgacggtcccccaggagttcaggtgctgggcacagcggccctgggctgcctggtcaaggactacttcctctctcgactctgagcgggctggcaaggcgcatagnnnnnnn

SEQ ID NO: 21428 - DNA, 173 bp, Homo sapiens; identical to SEQ ID NO: 20229
  misc_feature: GYAE6OF02HKKQD.49.53.E09.1.454.CMB.1.raw
  modified_base (173)..(173): a, c, t, g, unknown or other
  misc_feature (173)..(173): n is a, c, g, or t

SEQ ID NO: 21429 - DNA, 492 bp, Homo sapiens
  misc_feature: GYAE6OF02GM48X.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagacttttgagagggcctcagggacccctgagcgattctctggctccagctcagcgacaacagtcacgttgaccatcagtggagtccgggcagaggacgaggctgactattactgtcagtcatcagacagtagtggctacttctgtcgtattcggcggagggaccaagctgaccgtctaggtcagcccaggctccgg

SEQ ID NO: 21430 - DNA, 173 bp, Homo sapiens; identical to SEQ ID NO: 20229
  misc_feature: GYAE6OF02JEUQD.49.53.E09.1.454.CMB.1.raw
  modified_base (173)..(173): a, c, t, g, unknown or other
  misc_feature (173)..(173): n is a, c, g, or t

SEQ ID NO: 21431 - DNA, 175 bp, Homo sapiens; identical to SEQ ID NO: 20418
  misc_feature: GYAE6OF02GSV1D.49.53.E09.1.454.CMB.1.raw
  modified_base (173)..(175): a, c, t, g, unknown or other
  misc_feature (173)..(175): n is a, c, g, or t

SEQ ID NO: 21432 - DNA, 178 bp, Homo sapiens
  misc_feature: GYAE6OF02HV6BI.49.53.E09.1.454.CMB.1.raw
  modified_base (174)..(178): a, c, t, g, unknown or other
  misc_feature (174)..(178): n is a, c, g, or t
tcagagtcgagagacacgaccggtgctcgatttagagagagtgtgttgggtttgggggaagagggaagactgacggtcccccaggagttcaggtgctgggcacagcggccctgggctgcctggtcaaggactacttcctctctcgactctgagcgggctggcaaggcgcatagnnnnn

SEQ ID NO: 21433 - DNA, 180 bp, Homo sapiens
  misc_feature: GYAE6OF02HCLW7.49.53.E09.1.454.CMB.1.raw
  modified_base (170)..(180): a, c, t, g, unknown or other
  misc_feature (170)..(180): n is a, c, g, or t
tcagagtcgagagacacgaccggtgctcgatttagagagagtgtgttgggttggggaagaggaagactgacggtccccaggagttcaggtgctgggcacagcggccctgggctacctggtcaaggactacttcctctctcgactctgagcgggctggcaaggcgcatagnnnnnnnnnnn

SEQ ID NO: 21434 - DNA, 173 bp, Homo sapiens; identical to SEQ ID NO: 20229
  misc_feature: GYAE6OF02H60OB.49.53.E09.1.454.CMB.1.raw
  modified_base (173)..(173): a, c, t, g, unknown or other
  misc_feature (173)..(173): n is a, c, g, or t

SEQ ID NO: 21435 - DNA, 173 bp, Homo sapiens; identical to SEQ ID NO: 20229
  misc_feature: GYAE6OF02GW5I2.49.53.E09.1.454.CMB.1.raw
  modified_base (173)..(173): a, c, t, g, unknown or other
  misc_feature (173)..(173): n is a, c, g, or t

SEQ ID NO: 21436 - DNA, 180 bp, Homo sapiens
  misc_feature: GYAE6OF02IY5MW.49.53.E09.1.454.CMB.1.raw
  modified_base (174)..(180): a, c, t, g, unknown or other
  misc_feature (174)..(180): n is a, c, g, or t
tcagagtcgagagacacgaccggtgctcgatttagagagagtgtgttgggtttgggggaagaggaagactgacggtcccccaggagttcaggtgctgggcacagcggccctgggctgccctggtcaaggactacttcctctctcgactctgagcgggctggcaaggcgcatagnnnnnnn

SEQ ID NO: 21437 - DNA, 175 bp, Homo sapiens; identical to SEQ ID NO: 20418
  misc_feature: GYAE6OF02I50VI.49.53.E09.1.454.CMB.1.raw
  modified_base (173)..(175): a, c, t, g, unknown or other
  misc_feature (173)..(175): n is a, c, g, or t

SEQ ID NO: 21438 - DNA, 171 bp, Homo sapiens; identical to SEQ ID NO: 20210
  misc_feature: GYAE6OF02FUN1P.49.53.E09.1.454.CMB.1.raw
  modified_base (171)..(171): a, c, t, g, unknown or other
  misc_feature (171)..(171): n is a, c, g, or t

SEQ ID NO: 21439 - DNA, 174 bp, Homo sapiens; identical to SEQ ID NO: 20265
  misc_feature: GYAE6OF02H4800.49.53.E09.1.454.CMB.1.raw
  modified_base (173)..(174): a, c, t, g, unknown or other
  misc_feature (173)..(174): n is a, c, g, or t

SEQ ID NO: 21440 - DNA, 172 bp, Homo sapiens; identical to SEQ ID NO: 20291
  misc_feature: GYAE6OF02F0RNO.49.53.E09.1.454.CMB.1.raw

SEQ ID NO: 21441 - DNA, 181 bp, Homo sapiens; identical to SEQ ID NO: 20539
  misc_feature: GYAE6OF02GFBQ4.49.53.E09.1.454.CMB.1.raw
  modified_base (173)..(181): a, c, t, g, unknown or other
  misc_feature (173)..(181): n is a, c, g, or t

SEQ ID NO: 21442 - DNA, 176 bp, Homo sapiens; identical to SEQ ID NO: 20270
  misc_feature: GYAE6OF02HNOU9.49.53.E09.1.454.CMB.1.raw
  modified_base (173)..(176): a, c, t, g, unknown or other
  misc_feature (173)..(176): n is a, c, g, or t

SEQ ID NO: 21443 - DNA, 173 bp, Homo sapiens
  misc_feature: GYAE6OF02GN2HN.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaggaagactgacggtcccccaggagttcaggtgctggacacagcggccctgggctgcctggtcaaggactacttcctctctcgactctgagcgggctggcaaggcgcatagn

SEQ ID NO: 21444 - DNA, 677 bp, Homo sapiens
  misc_feature: GYAE6OF02I6P4C.49.53.E09.1.454.CMB.1.raw
  modified_base (218)..(218): a, c, t, g, unknown or other
  misc_feature (218)..(218): n is a, c, g, or t
  modified_base (622)..(623): a, c, t, g, unknown or other
  misc_feature (622)..(623): n is a, c, g, or t
tcagagtcgagagacacgaccggtgctcgatttagagagagtgtgttgggtttggggtgggtcaggaggcagaactctgggtgtctcaccatggctggatcctctacttctccctcctcactctctgcacagactctgacggcctcctatgagctgacacacgccacctcggtcgtctgtcgtcctcgacgacgacgacggccacgtactacacctcncgtcgtcggagagtacgctacgtacgtacgaaacgaacaatacgtacgtaacttacgtacggtaaccgagcacgaaggacgaacggacgacggaccgtccgtacgtcgtacgtactacgttaacttaacgtaacgtttacgtaacgtacggtacggtacgtacggaccgtacgtacggacgtacgtacgttacgtacgtacgtacgtacgacgtacacgacgacgaacgaacgtacgtacgtacgtacgaactacgtacgtacggtacggtacggtacggacggacgggaacggaacggacggtacgtaacgtaacgtaacgtacgtacgtaacgtacgtacgtacgtacgaacgtaacgtaacgtaacggtacgtaacgttacgttacgttacgttacgttannggttacggtacggtacggaacggacgtacgtacgtacgtacggtacgtacgacg

SEQ ID NO: 21445 - DNA, 174 bp, Homo sapiens; identical to SEQ ID NO: 20265
  misc_feature: GYAE6OF02H50A2.49.53.E09.1.454.CMB.1.raw
  modified_base (173)..(174): a, c, t, g, unknown or other
  misc_feature (173)..(174): n is a, c, g, or t

SEQ ID NO: 21446 - DNA, 186 bp, Homo sapiens
  misc_feature: GYAE6OF02F9QM5.49.53.E09.1.454.CMB.1.raw
  modified_base (174)..(186): a, c, t, g, unknown or other
  misc_feature (174)..(186): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagtcgggctggcaaggcgcatagnnnnnnnnnnnnn

SEQ ID NO: 21447 - DNA, 174 bp, Homo sapiens; identical to SEQ ID NO: 20265
  misc_feature: GYAE6OF02IQ1TR.49.53.E09.1.454.CMB.1.raw
  modified_base (173)..(174): a, c, t, g, unknown or other
  misc_feature (173)..(174): n is a, c, g, or t

SEQ ID NO: 21448 - DNA, 173 bp, Homo sapiens; identical to SEQ ID NO: 20229
  misc_feature: GYAE6OF02HZT74.49.53.E09.1.454.CMB.1.raw
  modified_base (173)..(173): a, c, t, g, unknown or other
  misc_feature (173)..(173): n is a, c, g, or t

SEQ ID NO: 21449 - DNA, 203 bp, Homo sapiens
  misc_feature: GYAE6OF02FZF36.49.53.E09.1.454.CMB.1.raw
  modified_base (172)..(203): a, c, t, g, unknown or other
  misc_feature (172)..(203): n is a, c, g, or t
tcagagtcgagagacacgaccggtgctcgatttagagagagtgtgttgggtttggggaagaagggaagactgacggtccccaggagttcaggtgctgggcacagcggcctggctgcctggtccaaggactacttcctctctcgactctgagcgggctggcaaggcgcatagnnnnnnnnnnnnnnnnnnnnnnnnnnnnnnnn

SEQ ID NO: 21450 - DNA, 173 bp, Homo sapiens; identical to SEQ ID NO: 20229
  misc_feature: GYAE6OF02G6DO9.49.53.E09.1.454.CMB.1.raw
  modified_base (173)..(173): a, c, t, g, unknown or other
  misc_feature (173)..(173): n is a, c, g, or t

SEQ ID NO: 21451 - DNA, 173 bp, Homo sapiens; identical to SEQ ID NO: 20229
  misc_feature: GYAE6OF02GFG52.49.53.E09.1.454.CMB.1.raw
  modified_base (173)..(173): a, c, t, g, unknown or other
  misc_feature (173)..(173): n is a, c, g, or t

SEQ ID NO: 21452 - DNA, 174 bp, Homo sapiens; identical to SEQ ID NO: 20960
  misc_feature: GYAE6OF02I298P.49.53.E09.1.454.CMB.1.raw
  modified_base (174)..(174): a, c, t, g, unknown or other
  misc_feature (174)..(174): n is a, c, g, or t

SEQ ID NO: 21453 - DNA, 189 bp, Homo sapiens
  misc_feature: GYAE6OF02HQNAE.49.53.E09.1.454.CMB.1.raw
  modified_base (174)..(189): a, c, t, g, unknown or other
  misc_feature (174)..(189): n is a, c, g, or t
tcagagtcgagagacacgaccggtgctcgatttagagagagtgtgttgggtttgggggaagaggaagactgacggtcccccaggagttcaggtgctgggcacagcggccctgggcctgcctggtcaaggactacttcctcgtagcactctgagcgggctggcaaggcgcatagnnnnnnnnnnnnnnnn

SEQ ID NO: 21454 - DNA, 175 bp, Homo sapiens; identical to SEQ ID NO: 20418
  misc_feature: GYAE6OF02FI8C0.49.53.E09.1.454.CMB.1.raw
  modified_base (173)..(175): a, c, t, g, unknown or other
  misc_feature (173)..(175): n is a, c, g, or t

SEQ ID NO: 21455 - DNA, 176 bp, Homo sapiens; identical to SEQ ID NO: 20270
  misc_feature: GYAE6OF02FQZQS.49.53.E09.1.454.CMB.1.raw
  modified_base (173)..(176): a, c, t, g, unknown or other
  misc_feature (173)..(176): n is a, c, g, or t

SEQ ID NO: 21456 - DNA, 171 bp, Homo sapiens; identical to SEQ ID NO: 20210
  misc_feature: GYAE6OF02IPD2V.49.53.E09.1.454.CMB.1.raw
  modified_base (171)..(171): a, c, t, g, unknown or other
  misc_feature (171)..(171): n is a, c, g, or t

SEQ ID NO: 21457 - DNA, 493 bp, Homo sapiens
  misc_feature: GYAE6OF02IMMXL.49.53.E09.1.454.CMB.1.raw
  modified_base (357)..(357): a, c, t, g, unknown or other
  misc_feature (357)..(357): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcagggacccctgagcgattctctggctccagctcagcgacaacngtcacgttgaccatcagtggagtcgggcagaggacgaggctgactattactgtcagtcatcagacagtagtgctacttctgtcgtattcggcggaagggaccaagcgtcgaccgtctaggtcaggccaggctccgg

SEQ ID NO: 21458 - DNA, 186 bp, Homo sapiens
  misc_feature: GYAE6OF02H3633.49.53.E09.1.454.CMB.1.raw
  modified_base (172)..(186): a, c, t, g, unknown or other
  misc_feature (172)..(186): n is a, c, g, or t
tcagagtcgagagacacgaccggtgctcgatttagagagagtgtgttgggtttgggggaagaggaagactgacggtccccaggagttcaggtgctgggcacagcggccctgggctgcctggtcaaggactacttcctcgtagcactctgagcgggctggcaaggcgcatagnnnnnnnnnnnnnnn

SEQ ID NO: 21459 - DNA, 173 bp, Homo sapiens; identical to SEQ ID NO: 20229
  misc_feature: GYAE6OF02IUENQ.49.53.E09.1.454.CMB.1.raw
  modified_base (173)..(173): a, c, t, g, unknown or other
  misc_feature (173)..(173): n is a, c, g, or t

SEQ ID NO: 21460 - DNA, 173 bp, Homo sapiens; identical to SEQ ID NO: 20229
  misc_feature: GYAE6OF02I2A8W.49.53.E09.1.454.CMB.1.raw
  modified_base (173)..(173): a, c, t, g, unknown or other
  misc_feature (173)..(173): n is a, c, g, or t

SEQ ID NO: 21461 - DNA, 171 bp, Homo sapiens; identical to SEQ ID NO: 20210
  misc_feature: GYAE6OF02JHDZ8.49.53.E09.1.454.CMB.1.raw
  modified_base (171)..(171): a, c, t, g, unknown or other
  misc_feature (171)..(171): n is a, c, g, or t

SEQ ID NO: 21462 - DNA, 172 bp, Homo sapiens; identical to SEQ ID NO: 20291
  misc_feature: GYAE6OF02JC9ZX.49.53.E09.1.454.CMB.1.raw

SEQ ID NO: 21463 - DNA, 172 bp, Homo sapiens
  misc_feature: GYAE6OF02HJF33.49.53.E09.1.454.CMB.1.raw
tcagagtcgagagacacgaccggtgctcgatttagagagagtgtgttgggtttgggggaagaggaagactgacggtcccccaggagttcaggtgctgggcacagcggccctgggctgcctggtcaaggactacttcctcgtagcactctgagcgggctggcaaggcgcatag

SEQ ID NO: 21464 - DNA, 177 bp, Homo sapiens; identical to SEQ ID NO: 20482
  misc_feature: GYAE6OF02IK31L.49.53.E09.1.454.CMB.1.raw
  modified_base (173)..(177): a, c, t, g, unknown or other
  misc_feature (173)..(177): n is a, c, g, or t

SEQ ID NO: 21465 - DNA, 174 bp, Homo sapiens; identical to SEQ ID NO: 20265
  misc_feature: GYAE6OF02FKUTJ.49.53.E09.1.454.CMB.1.raw
  modified_base (173)..(174): a, c, t, g, unknown or other
  misc_feature (173)..(174): n is a, c, g, or t

SEQ ID NO: 21466 - DNA, 172 bp, Homo sapiens; identical to SEQ ID NO: 21463
  misc_feature: GYAE6OF02I9QTP.49.53.E09.1.454.CMB.1.raw

SEQ ID NO: 21467 - DNA, 177 bp, Homo sapiens
  misc_feature: GYAE6OF02JVD9P.49.53.E09.1.454.CMB.1.raw
  modified_base (172)..(177): a, c, t, g, unknown or other
  misc_feature (172)..(177): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcggctggcaaggcgcatagnnnnnn

SEQ ID NO: 21468 - DNA, 172 bp, Homo sapiens; identical to SEQ ID NO: 20291
  misc_feature: GYAE6OF02IESOG.49.53.E09.1.454.CMB.1.raw

SEQ ID NO: 21469 - DNA, 492 bp, Homo sapiens
  misc_feature: GYAE6OF02HINIV.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaaatatgcttactggtaccagcagaagccaggccaggcccctgtcttgatcattataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtctaggtcaggcccaaggctccg

SEQ ID NO: 21470 - DNA, 173 bp, Homo sapiens; identical to SEQ ID NO: 20229
  misc_feature: GYAE6OF02FXDVQ.49.53.E09.1.454.CMB.1.raw
  modified_base (173)..(173): a, c, t, g, unknown or other
  misc_feature (173)..(173): n is a, c, g, or t

SEQ ID NO: 21471 - DNA, 524 bp, Homo sapiens
  misc_feature: GYAE6OF02HPMT7.49.53.E09.1.454.CMB.1.raw
  modified_base (360)..(360): a, c, t, g, unknown or other
  misc_feature (360)..(360): n is a, c, g, or t
  modified_base (388)..(388): a, c, t, g, unknown or other
  misc_feature (388)..(388): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtactagcagaagccaggccaggcccctgtcttgatcatttataaagtactttgagagggcctcgacgggacccctgagcgattctctggctccagctcgagcgacaacngtcacgttgaccatcagtggagtccggnagaggacgaggctgactattactgtcagtcatacagacagtagtgctacttcgtgtcgtagttcgggacggtacgggaccaggccgttacggacccgttccgtacggtccgacggacccgaacggtcctaccccgg

SEQ ID NO: 21472 - DNA, 176 bp, Homo sapiens; identical to SEQ ID NO: 20270
  misc_feature: GYAE6OF02GWUW0.49.53.E09.1.454.CMB.1.raw
  modified_base (173)..(176): a, c, t, g, unknown or other
  misc_feature (173)..(176): n is a, c, g, or t

SEQ ID NO: 21473 - DNA, 510 bp, Homo sapiens
  misc_feature: GYAE6OF02I5QEI.49.53.E09.1.454.CMB.1.raw
  modified_base (334)..(334): a, c, t, g, unknown or other
  misc_feature (334)..(334): n is a, c, g, or t
  modified_base (417)..(417): a, c, t, g, unknown or other
  misc_feature (417)..(417): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcagggacccctgagcgattcnctgctcagctcagggacaacagtcaccttgaccatcagtggagtccggccagaggacgaggctgactattactgtcagtccgnagacagcagtggctagttatgtcgtattcgggcgggtagggtctaacggctaggaccgttcctaaggtcgacgcccgaaggcctgtccccccg

SEQ ID NO: 21474 - DNA, 175 bp, Homo sapiens; identical to SEQ ID NO: 20458
  misc_feature: GYAE6OF02GLQ1A.49.53.E09.1.454.CMB.1.raw
  modified_base (173)..(175): a, c, t, g, unknown or other
  misc_feature (173)..(175): n is a, c, g, or t

SEQ ID NO: 21475 - DNA, 175 bp, Homo sapiens; identical to SEQ ID NO: 20418
  misc_feature: GYAE6OF02FVYI9.49.53.E09.1.454.CMB.1.raw
  modified_base (173)..(175): a, c, t, g, unknown or other
  misc_feature (173)..(175): n is a, c, g, or t

SEQ ID NO: 21476 - DNA, 173 bp, Homo sapiens; identical to SEQ ID NO: 20229
  misc_feature: GYAE6OF02FLVXQ.49.53.E09.1.454.CMB.1.raw
  modified_base (173)..(173): a, c, t, g, unknown or other
  misc_feature (173)..(173): n is a, c, g, or t

SEQ ID NO: 21477 - DNA, 178 bp, Homo sapiens; identical to SEQ ID NO: 20465
  misc_feature: GYAE6OF02GAXOT.49.53.E09.1.454.CMB.1.raw
  modified_base (173)..(178): a, c, t, g, unknown or other
  misc_feature (173)..(178): n is a, c, g, or t

SEQ ID NO: 21478 - DNA, 174 bp, Homo sapiens; identical to SEQ ID NO: 20265
  misc_feature: GYAE6OF02GZBGX.49.53.E09.1.454.CMB.1.raw
  modified_base (173)..(174): a, c, t, g, unknown or other
  misc_feature (173)..(174): n is a, c, g, or t

SEQ ID NO: 21479 - DNA, 173 bp, Homo sapiens; identical to SEQ ID NO: 20229
  misc_feature: GYAE6OF02HQ243.49.53.E09.1.454.CMB.1.raw
  modified_base (173)..(173): a, c, t, g, unknown or other
  misc_feature (173)..(173): n is a, c, g, or t

SEQ ID NO: 21480 - DNA, 510 bp, Homo sapiens
  misc_feature: GYAE6OF02HL7EF.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgacgggacccctgagcgattctctggctccagctcagcgaacaacagtcacgttcgaccatcagtggagtccgggcagaggacgaggctagactattactgtcagtcatcagacagtagtgactacttctagtcgtagttcggacgggagggaccagctacgaccgttccgtaggtccacggcccaggcctacccgg

SEQ ID NO: 21481 - DNA, 598 bp, Homo sapiens
  misc_feature: GYAE6OF02H2L5M.49.53.E09.1.454.CMB.1.raw
tcagagtcgagagacacgaccggtgctcgatttagagagagtgtgttgggtttgggggtggtccgaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgcattgaccaaagcaatatgcttactggtaccagcagaacgcaggccacggccctgtcttgatctattaataagtactttgagagggcctacgacgggacccctgacgcgattctcgtcggctccagctcgacgcgaacaacgtagtctacgttcgaacatcgaaggtggacggtccgggacgaggacggaggacggtacgtagtaaccttagtttaacgtcgtacgaacgttcgaacttaccgagtaaccgtagttaacggttggacttaacttcgttcggttacgttaccggttcgggtacgggacgggtaaccaaggtcgttacggaccgtccgtacggtccgaacggccccgaacggtcctaccccggg

SEQ ID NO: 21482 - DNA, 174 bp, Homo sapiens; identical to SEQ ID NO: 20265
  misc_feature: GYAE6OF02GSXRH.49.53.E09.1.454.CMB.1.raw
  modified_base (173)..(174): a, c, t, g, unknown or other
  misc_feature (173)..(174): n is a, c, g, or t

SEQ ID NO: 21483 - DNA, 205 bp, Homo sapiens
  misc_feature: GYAE6OF02IP33Y.49.53.E09.1.454.CMB.1.raw
  modified_base (176)..(205): a, c, t, g, unknown or other
  misc_feature (176)..(205): n is a, c, g, or t
tcagagtcgagagacacgaccggtgctcgatttagagagagtgtgttgggtttgggggaagaggaagactgaccggtcccccaggagttcaggtgctgggcactagcggccctgggctgcctggtcgaaggactacttcctcgtagcactctgagcgggctggcaaggcgcatagnnnnnnnnnnnnnnnnnnnnnnnnnnnnnn

SEQ ID NO: 21484 - DNA, 178 bp, Homo sapiens; identical to SEQ ID NO: 20465
  misc_feature: GYAE6OF02GE039.49.53.E09.1.454.CMB.1.raw
  modified_base (173)..(178): a, c, t, g, unknown or other
  misc_feature (173)..(178): n is a, c, g, or t

SEQ ID NO: 21485 - DNA, 173 bp, Homo sapiens; identical to SEQ ID NO: 20229
  misc_feature: GYAE6OF02IX8RL.49.53.E09.1.454.CMB.1.raw
  modified_base (173)..(173): a, c, t, g, unknown or other
  misc_feature (173)..(173): n is a, c, g, or t

SEQ ID NO: 21486 - DNA, 173 bp, Homo sapiens; identical to SEQ ID NO: 20337
  misc_feature: GYAE6OF02FGJJR.49.53.E09.1.454.CMB.1.raw
  modified_base (173)..(173): a, c, t, g, unknown or other
  misc_feature (173)..(173): n is a, c, g, or t

SEQ ID NO: 21487 - DNA, 173 bp, Homo sapiens; identical to SEQ ID NO: 20229
  misc_feature: GYAE6OF02G3D86.49.53.E09.1.454.CMB.1.raw
  modified_base (173)..(173): a, c, t, g, unknown or other
  misc_feature (173)..(173): n is a, c, g, or t

SEQ ID NO: 21488 - DNA, 172 bp, Homo sapiens; identical to SEQ ID NO: 20291
  misc_feature: GYAE6OF02GF0JI.49.53.E09.1.454.CMB.1.raw

SEQ ID NO: 21489 - DNA, 173 bp, Homo sapiens; identical to SEQ ID NO: 20229
  misc_feature: GYAE6OF02IP0V0.49.53.E09.1.454.CMB.1.raw
  modified_base (173)..(173): a, c, t, g, unknown or other
  misc_feature (173)..(173): n is a, c, g, or t

SEQ ID NO: 21490 - DNA, 173 bp, Homo sapiens; identical to SEQ ID NO: 20229
  misc_feature: GYAE6OF02FQQWB.49.53.E09.1.454.CMB.1.raw
  modified_base (173)..(173): a, c, t, g, unknown or other
  misc_feature (173)..(173): n is a, c, g, or t

SEQ ID NO: 21491 - DNA, 173 bp, Homo sapiens; identical to SEQ ID NO: 20229
  misc_feature: GYAE6OF02GLB8R.49.53.E09.1.454.CMB.1.raw
  modified_base (173)..(173): a, c, t, g, unknown or other
  misc_feature (173)..(173): n is a, c, g, or t

SEQ ID NO: 21492 - DNA, 173 bp, Homo sapiens; identical to SEQ ID NO: 20337
  misc_feature: GYAE6OF02HA0BN.49.53.E09.1.454.CMB.1.raw
  modified_base (173)..(173): a, c, t, g, unknown or other
  misc_feature (173)..(173): n is a, c, g, or t

SEQ ID NO: 21493 - DNA, 178 bp, Homo sapiens; identical to SEQ ID NO: 20465
  misc_feature: GYAE6OF02GE8BC.49.53.E09.1.454.CMB.1.raw
  modified_base (173)..(178): a, c, t, g, unknown or other
  misc_feature (173)..(178): n is a, c, g, or t

SEQ ID NO: 21494 - DNA, 171 bp, Homo sapiens; identical to SEQ ID NO: 20210
  misc_feature: GYAE6OF02HH4NN.49.53.E09.1.454.CMB.1.raw
  modified_base (171)..(171): a, c, t, g, unknown or other
  misc_feature (171)..(171): n is a, c, g, or t

SEQ ID NO: 21495 - DNA, 179 bp, Homo sapiens
  misc_feature: GYAE6OF02G4SQR.49.53.E09.1.454.CMB.1.raw
  modified_base (179)..(179): a, c, t, g, unknown or other
  misc_feature (179)..(179): n is a, c, g, or t
tcagagtcgagagacacgaccggtgctcgatttagagagagtgtggttagggtttagggggaagaggaagactgaccggtcccccgaggagttacaggtgctgggcacagcggccctgggctgcctggtcaaggactacttcctctctcgactctgagcgggctggcaaggcgcatagn

SEQ ID NO: 21496 - DNA, 174 bp, Homo sapiens; identical to SEQ ID NO: 20912
  misc_feature: GYAE6OF02GG5PV.49.53.E09.1.454.CMB.1.raw
  modified_base (174)..(174): a, c, t, g, unknown or other
  misc_feature (174)..(174): n is a, c, g, or t

SEQ ID NO: 21497 - DNA, 173 bp, Homo sapiens; identical to SEQ ID NO: 20229
  misc_feature: GYAE6OF02IXSCH.49.53.E09.1.454.CMB.1.raw
  modified_base (173)..(173): a, c, t, g, unknown or other
  misc_feature (173)..(173): n is a, c, g, or t

SEQ ID NO: 21498 - DNA, 173 bp, Homo sapiens; identical to SEQ ID NO: 20229
  misc_feature: GYAE6OF02H65ZU.49.53.E09.1.454.CMB.1.raw
  modified_base (173)..(173): a, c, t, g, unknown or other
  misc_feature (173)..(173): n is a, c, g, or t

SEQ ID NO: 21499 - DNA, 173 bp, Homo sapiens; identical to SEQ ID NO: 20229
  misc_feature: GYAE6OF02GL6P1.49.53.E09.1.454.CMB.1.raw
  modified_base (173)..(173): a, c, t, g, unknown or other
  misc_feature (173)..(173): n is a, c, g, or t

SEQ ID NO: 21500 - DNA, 174 bp, Homo sapiens; identical to SEQ ID NO: 20265
  misc_feature: GYAE6OF02HO8AT.49.53.E09.1.454.CMB.1.raw
  modified_base (173)..(174): a, c, t, g, unknown or other
  misc_feature (173)..(174): n is a, c, g, or t

SEQ ID NO: 21501 - DNA, 496 bp, Homo sapiens
  misc_feature: GYAE6OF02GT83C.49.53.E09.1.454.CMB.1.raw
  modified_base (385)..(385): a, c, t, g, unknown or other
  misc_feature (385)..(385): n is a, c, g, or t
  modified_base (435)..(435): a, c, t, g, unknown or other
  misc_feature (435)..(435): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcagggacccctgagcgattctctggctcagctcagcgacaacagtcacgttgaccatcagtggagtccgggnagaggacgagctgactattactgtcagtcatcagacagtagtgcacttcngtcgtattcggcggtagggaccaagtctagacccgtcgtaggtccagcccaaggctcccgg

SEQ ID NO: 21502 - DNA, 173 bp, Homo sapiens; identical to SEQ ID NO: 20229
  misc_feature: GYAE6OF02F3D7C.49.53.E09.1.454.CMB.1.raw
  modified_base (173)..(173): a, c, t, g, unknown or other
  misc_feature (173)..(173): n is a, c, g, or t

SEQ ID NO: 21503 - DNA, 173 bp, Homo sapiens; identical to SEQ ID NO: 20229
  misc_feature: GYAE6OF02GJIUH.49.53.E09.1.454.CMB.1.raw
  modified_base (173)..(173): a, c, t, g, unknown or other
  misc_feature (173)..(173): n is a, c, g, or t

SEQ ID NO: 21504 - DNA, 509 bp, Homo sapiens
  misc_feature: GYAE6OF02H0WZ7.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgcttgatcatttataaagactttgagagggcctcgacgggacccctgagcgattctctggctccagctcagcgacaacagtcacgttgaccatcagtggacgtcgggcaggacggacgaggctaggacttattacgtgtcagtcatcaagacagtagtgctattctgtcgtagtcggacggaggaccaagtcgtacgaccgtcgtacggtccacgacccaggcctacccgg

SEQ ID NO: 21505 - DNA, 174 bp, Homo sapiens; identical to SEQ ID NO: 20265
  misc_feature: GYAE6OF02I5D1Y.49.53.E09.1.454.CMB.1.raw
  modified_base (173)..(174): a, c, t, g, unknown or other
  misc_feature (173)..(174): n is a, c, g, or t

SEQ ID NO: 21506 - DNA, 173 bp, Homo sapiens; identical to SEQ ID NO: 20229
  misc_feature: GYAE6OF02FP1YZ.49.53.E09.1.454.CMB.1.raw
  modified_base (173)..(173): a, c, t, g, unknown or other
  misc_feature (173)..(173): n is a, c, g, or t

SEQ ID NO: 21507 - DNA, 174 bp, Homo sapiens; identical to SEQ ID NO: 20265
  misc_feature: GYAE6OF02HSYTD.49.53.E09.1.454.CMB.1.raw
  modified_base (173)..(174): a, c, t, g, unknown or other
  misc_feature (173)..(174): n is a, c, g, or t

SEQ ID NO: 21508 - DNA, 174 bp, Homo sapiens; identical to SEQ ID NO: 20265
  misc_feature: GYAE6OF02HVG18.49.53.E09.1.454.CMB.1.raw
  modified_base (173)..(174): a, c, t, g, unknown or other
  misc_feature (173)..(174): n is a, c, g, or t

SEQ ID NO: 21509 - DNA, 501 bp, Homo sapiens
  misc_feature: GYAE6OF02IA19I.49.53.E09.1.454.CMB.1.raw
  modified_base (347)..(347): a, c, t, g, unknown or other
  misc_feature (347)..(347): n is a, c, g, or t
tcagagtcgagagacacgaccggtgctcgatttagagagagtgtgttgggtttgggggtggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagacttttgagagggcctcagggacccctgagcgattctctggctccagctcngcgacaacagtcacgttgaccatcagtggagtccgggcagaggacgaggctgactattactgtcagtcatacagacagtagtgcattctgtcgtagttcgggcggagggaccaagccgtacgaccgtcctaggtccacgcccaggcctacccgg

SEQ ID NO: 21510 - DNA, 173 bp, Homo sapiens; identical to SEQ ID NO: 20229
  misc_feature: GYAE6OF02FNGBZ.49.53.E09.1.454.CMB.1.raw
  modified_base (173)..(173): a, c, t, g, unknown or other
  misc_feature (173)..(173): n is a, c, g, or t

SEQ ID NO: 21511 - DNA, 174 bp, Homo sapiens; identical to SEQ ID NO: 20265
  misc_feature: GYAE6OF02HXRLZ.49.53.E09.1.454.CMB.1.raw
  modified_base (173)..(174): a, c, t, g, unknown or other
  misc_feature (173)..(174): n is a, c, g, or t

SEQ ID NO: 21512 - DNA, 173 bp, Homo sapiens; identical to SEQ ID NO: 20229
  misc_feature: GYAE6OF02H7OHQ.49.53.E09.1.454.CMB.1.raw
  modified_base (173)..(173): a, c, t, g, unknown or other
  misc_feature (173)..(173): n is a, c, g, or t

SEQ ID NO: 21513 - DNA, 172 bp, Homo sapiens; identical to SEQ ID NO: 20291
  misc_feature: GYAE6OF02GCHY2.49.53.E09.1.454.CMB.1.raw

SEQ ID NO: 21514 - DNA, 495 bp, Homo sapiens
  misc_feature: GYAE6OF02JAC8K.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtgcacttctgtcgtattcggcggagggaccaagcctgaccgtcctaggtccagcccaaggctcccgg

SEQ ID NO: 21515 - DNA, 174 bp, Homo sapiens; identical to SEQ ID NO: 20265
  misc_feature: GYAE6OF02F1L1B.49.53.E09.1.454.CMB.1.raw
  modified_base (173)..(174): a, c, t, g, unknown or other
  misc_feature (173)..(174): n is a, c, g, or t

SEQ ID NO: 21516 - DNA, 173 bp, Homo sapiens
  misc_feature: GYAE6OF02HQPB8.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaggaagactgacggtcccccaggagttcatgtgctgggcacagcggccctgggctgcctggtcaaggactacttcctcgtagcactctgagcgggctggcaaggcgcatagn

SEQ ID NO: 21517 - DNA, 217 bp, Homo sapiens
  misc_feature: GYAE6OF02H8P9W.49.53.E09.1.454.CMB.1.raw
  modified_base (177)..(217): a, c, t, g, unknown or other
  misc_feature (177)..(217): n is a, c, g, or t
tcagagtcgagagacacgaccggtgctcgatttagagagagtgtgttggggtttgggggaagaggaagactgacggtcccccaggagttcaggtgctgggtcacagcggccctgggctgcctggtcaaggctacttccgtctctcgactctgacgcgggcctggcaaggcgcatagnnnnnnnnnnnnnnnnnnnnnnnnnnnnnnnnnnnnnnnnn

SEQ ID NO: 21518 - DNA, 523 bp, Homo sapiens
  misc_feature: GYAE6OF02ISCKF.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctacggtgtctgtgtcctcaggacagacggccagtatcacctgctctggagatgcattgccaaaagcaatatgcttactggtaccagcagaagccaggccaggcccctgtcttgatcatttataaagtactttgagaggcctcgacgggacccctgagcgattctctggctccagctcagcgaacaacagtctacgttgaaccatcaggtggacgtccgggacaggacggacgaggctagactattactgtacagtcatcagacagtagtgctacttctgttcgtagttcggcgggaacggaccaaggctacggaccgttcgtacggtccacggcccgaaggcctacccgg

SEQ ID NO: 21519 - DNA, 180 bp, Homo sapiens; identical to SEQ ID NO: 21408
  misc_feature: GYAE6OF02G3H0I.49.53.E09.1.454.CMB.1.raw
  modified_base (173)..(180): a, c, t, g, unknown or other
  misc_feature (173)..(180): n is a, c, g, or t

SEQ ID NO: 21520 - DNA, 174 bp, Homo sapiens; identical to SEQ ID NO: 20265
  misc_feature: GYAE6OF02IBYW9.49.53.E09.1.454.CMB.1.raw
  modified_base (173)..(174): a, c, t, g, unknown or other
  misc_feature (173)..(174): n is a, c, g, or t

SEQ ID NO: 21521 - DNA, 205 bp, Homo sapiens
  misc_feature: GYAE6OF02HP3QQ.49.53.E09.1.454.CMB.1.raw
  modified_base (143)..(143): a, c, t, g, unknown or other
  misc_feature (143)..(143): n is a, c, g, or t
  modified_base (176)..(205): a, c, t, g, unknown or other
  misc_feature (176)..(205): n is a, c, g, or t
tcagagtcgagagacacgaccggtgctcgatttagagagagtgtgttgggtttgggggaagaggaagactgacggtccccccaggagttcaggtgctcgggcacagcggccctgggctgcctggtcaaggactacttcctctntcgactctgagcgggcttggcaaggcgcatagnnnnnnnnnnnnnnnnnnnnnnnnnnnnnn

SEQ ID NO: 21522 - DNA, 174 bp, Homo sapiens; identical to SEQ ID NO: 20265
  misc_feature: GYAE6OF02HFN9T.49.53.E09.1.454.CMB.1.raw
  modified_base (173)..(174): a, c, t, g, unknown or other
  misc_feature (173)..(174): n is a, c, g, or t

SEQ ID NO: 21523 - DNA, 511 bp, Homo sapiens
  misc_feature: GYAE6OF02IBDYG.49.53.E09.1.454.CMB.1.raw
  modified_base (392)..(392): a, c, t, g, unknown or other
  misc_feature (392)..(392): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaaatatgcttactggtaccagcagaagcaggccagcccctgtcttgatcatttaataaagtactttgagagggctcgagggacccctgaacgcgattctctggctccagctcagcgacaacagtcacgttagaccatcgaagtggacgtccgggnaggaggacgtaggctaggactattactgtcagtcatcagacagtagtgcacttcgtgttacgtagttcggacggagggaaccagctcgaccgttcgaggtcacggacccgagctcccgg

SEQ ID NO: 21524 - DNA, 173 bp, Homo sapiens; identical to SEQ ID NO: 20229
  misc_feature: GYAE6OF02GNYU8.49.53.E09.1.454.CMB.1.raw
  modified_base (173)..(173): a, c, t, g, unknown or other
  misc_feature (173)..(173): n is a, c, g, or t

SEQ ID NO: 21525 - DNA, 172 bp, Homo sapiens; identical to SEQ ID NO: 20291
  misc_feature: GYAE6OF02FWXKK.49.53.E09.1.454.CMB.1.raw

SEQ ID NO: 21526 - DNA, 174 bp, Homo sapiens; identical to SEQ ID NO: 20630
  misc_feature: GYAE6OF02FII09.49.53.E09.1.454.CMB.1.raw
  modified_base (173)..(174): a, c, t, g, unknown or other
  misc_feature (173)..(174): n is a, c, g, or t

SEQ ID NO: 21527 - DNA, 174 bp, Homo sapiens; identical to SEQ ID NO: 20630
  misc_feature: GYAE6OF02I2MG5.49.53.E09.1.454.CMB.1.raw
  modified_base (173)..(174): a, c, t, g, unknown or other
  misc_feature (173)..(174): n is a, c, g, or t

SEQ ID NO: 21528 - DNA, 173 bp, Homo sapiens; identical to SEQ ID NO: 20229
  misc_feature: GYAE6OF02FPD7K.49.53.E09.1.454.CMB.1.raw
  modified_base (173)..(173): a, c, t, g, unknown or other
  misc_feature (173)..(173): n is a, c, g, or t

SEQ ID NO: 21529 - DNA, 176 bp, Homo sapiens
  misc_feature: GYAE6OF02HDOOZ.49.53.E09.1.454.CMB.1.raw
  modified_base (174)..(176): a, c, t, g, unknown or other
  misc_feature (174)..(176): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggaactacttccagtactctatctgagcgggctggcaaggcgcatagnnn

SEQ ID NO: 21530 - DNA, 185 bp, Homo sapiens
  misc_feature: GYAE6OF02HYREW.49.53.E09.1.454.CMB.1.raw
  modified_base (137)..(137): a, c, t, g, unknown or other
  misc_feature (137)..(137): n is a, c, g, or t
  modified_base (172)..(185): a, c, t, g, unknown or other
  misc_feature (172)..(185): n is a, c, g, or t
tcagagtcgagagacacgaccggtgctcgatttagagagagtgtgttgggtttgggggaagaggaagactgacggtcccccaggagttcaggtgctgggcacagcggcctgggctgcctggtcaaggactacttccnctctcgactctgagcgggctggcaaggcgcatagnnnnnnnnnnnnnn

SEQ ID NO: 21531 - DNA, 175 bp, Homo sapiens; identical to SEQ ID NO: 20458
  misc_feature: GYAE6OF02HE6YB.49.53.E09.1.454.CMB.1.raw
  modified_base (173)..(175): a, c, t, g, unknown or other
  misc_feature (173)..(175): n is a, c, g, or t

SEQ ID NO: 21532 - DNA, 174 bp, Homo sapiens; identical to SEQ ID NO: 20265
  misc_feature: GYAE6OF02GCJ0B.49.53.E09.1.454.CMB.1.raw
  modified_base (173)..(174): a, c, t, g, unknown or other
  misc_feature (173)..(174): n is a, c, g, or t

SEQ ID NO: 21533 - DNA, 227 bp, Homo sapiens
  misc_feature: GYAE6OF02I4G5D.49.53.E09.1.454.CMB.1.raw
  modified_base (179)..(227): a, c, t, g, unknown or other
  misc_feature (179)..(227): n is a, c, g, or t
tcagagtcgagagacacgaccggtgctcgatttagagagagtgtgttgggtttgggggaagaggaagactgacggtcccccaggagttcaggtgctgggctacagtcggccctgggctgcctggtcaaggactacttcctctctcgactctggagcgggctggcgtaaggcgcatagtnnnnnnnnnnnnnnnnnnnnnnnnnnnnnnnnnnnnnnnnnnnnnnnnn

SEQ ID NO: 21534 - DNA, 511 bp, Homo sapiens
  misc_feature: GYAE6OF02JABCP.49.53.E09.1.454.CMB.1.raw
  modified_base (391)..(391): a, c, t, g, unknown or other
  misc_feature (391)..(391): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
tcagagtcgagagacacgaccggtgctcgatttagagagagtgtgttgggtttgggggttggggtccgaggaggcgagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggcaggcccctgtcttgatcatttataaagactttgagagggcctcacgggacccctgagcgattctctggctccagctcagcgacaacagtcacgttgaccatccagtggacgtccgggnaggtaggacgaggctgactattactgtcagtcatcagacagtagngtacacttntgtcgtattcgggcgaaggggtaccaagcgtgtaccgtccgtaggtccaggcccaaggcctacccg

SEQ ID NO: 21535 - DNA, 521 bp, Homo sapiens
  misc_feature: GYAE6OF02GRD9Z.49.53.E09.1.454.CMB.1.raw
  modified_base (390)..(390): a, c, t, g, unknown or other
  misc_feature (390)..(390): n is a, c, g, or t
  modified_base (441)..(441): a, c, t, g, unknown or other
  misc_feature (441)..(441): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaccagcagaagccaggccaggcccctgtcttgatcatttataaagactttgagagggcctcacgggacccctgagcgattctctggctccagctcagccgacaacagtcacgttcgaccatcagtggagtccgggnagaggacgaggctgactattactgtcagtcatcagacagtagtgctacttntgttacgttagttcgggacgggaagggtaccaaggtcgtcgtaccgttccgtaggtaccaccgcccgaacggcctcccgg

SEQ ID NO: 21536 - DNA, 174 bp, Homo sapiens; identical to SEQ ID NO: 20265
  misc_feature: GYAE6OF02F7CAS.49.53.E09.1.454.CMB.1.raw
  modified_base (173)..(174): a, c, t, g, unknown or other
  misc_feature (173)..(174): n is a, c, g, or t

SEQ ID NO: 21537 - DNA, 174 bp, Homo sapiens; identical to SEQ ID NO: 20265
  misc_feature: GYAE6OF02GRSVH.49.53.E09.1.454.CMB.1.raw
  modified_base (173)..(174): a, c, t, g, unknown or other
  misc_feature (173)..(174): n is a, c, g, or t

SEQ ID NO: 21538 - DNA, 174 bp, Homo sapiens
  misc_feature: GYAE6OF02JLHC0.49.53.E09.1.454.CMB.1.raw
  modified_base (172)..(174): a, c, t, g, unknown or other
  misc_feature (172)..(174): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcggctggcaaggcgcatagnnn

SEQ ID NO: 21539 - DNA, 502 bp, Homo sapiens
  misc_feature: GYAE6OF02G5GWF.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcaggaggacgaggctgactattactgtcagtcatcagacagtagtgctacttcgtgtcgtattcggacggagggaccaagctagaccgtccgtaggtccacggcccgaggcctcccgg

SEQ ID NO: 21540 - DNA, 174 bp, Homo sapiens; identical to SEQ ID NO: 20960
  misc_feature: GYAE6OF02I11A7.49.53.E09.1.454.CMB.1.raw
  modified_base (174)..(174): a, c, t, g, unknown or other
  misc_feature (174)..(174): n is a, c, g, or t

SEQ ID NO: 21541 - DNA, 173 bp, Homo sapiens; identical to SEQ ID NO: 20229
  misc_feature: GYAE6OF02H5KVI.49.53.E09.1.454.CMB.1.raw
  modified_base (173)..(173): a, c, t, g, unknown or other
  misc_feature (173)..(173): n is a, c, g, or t

SEQ ID NO: 21542 - DNA, 181 bp, Homo sapiens; identical to SEQ ID NO: 20539
  misc_feature: GYAE6OF02IZUB8.49.53.E09.1.454.CMB.1.raw
  modified_base (173)..(181): a, c, t, g, unknown or other
  misc_feature (173)..(181): n is a, c, g, or t

SEQ ID NO: 21543 - DNA, 175 bp, Homo sapiens; identical to SEQ ID NO: 20418
  misc_feature: GYAE6OF02FKY96.49.53.E09.1.454.CMB.1.raw
  modified_base (173)..(175): a, c, t, g, unknown or other
  misc_feature (173)..(175): n is a, c, g, or t

SEQ ID NO: 21544 - DNA, 532 bp, Homo sapiens
  misc_feature: GYAE6OF02GO2QN.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccggcagaggacgaggctgactattactgtcagtcatcagacagtagtgctacttgtgtcgtagttcgggacgggtaacgggaaccgaacggtcgtacggtacccgttaccgttacgggttccgaacggaccccgaagggtccgtaccccgg

SEQ ID NO: 21545 - DNA, 174 bp, Homo sapiens
  misc_feature: GYAE6OF02HN6L8.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgggggaagaggaagactgaccggtcccccaggagttcaggttctgggcacagcggccctgggctgcctggtcaaggactacttcctctctcgactctgagcgggctggcaaggcgcatagn

SEQ ID NO: 21546 - DNA, 199 bp, Homo sapiens
  misc_feature: GYAE6OF02HFI1X.49.53.E09.1.454.CMB.1.raw
  modified_base (177)..(199): a, c, t, g, unknown or other
  misc_feature (177)..(199): n is a, c, g, or t
tcagagtcgagagacacgaccggtgctcgatttagagagagtgtgttgggtttgggggaagagggaagactgacggtcccccaggagttcaggtgctgggcacagcggccctgggctggcctggtcaaggactacttcctctctcgactctgagcgggctgggcaagggcgcatagnnnnnnnnnnnnnnnnnnnnnnn

SEQ ID NO: 21547 - DNA, 177 bp, Homo sapiens
  misc_feature: GYAE6OF02HCN16.49.53.E09.1.454.CMB.1.raw
  modified_base (174)..(177): a, c, t, g, unknown or other
  misc_feature (174)..(177): n is a, c, g, or t
tcagagtcgagagacacgaccggtgctcgatttagagagagtgtggttgggtttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 21548 - DNA, 506 bp, Homo sapiens
  misc_feature: GYAE6OF02HPP9L.49.53.E09.1.454.CMB.1.raw
  modified_base (227)..(227): a, c, t, g, unknown or other
  misc_feature (227)..(227): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctggtgtctgtgtcctcgaggtaccaggtacggccagtatcaccttgctctgganatgcattgccaaagcaatatgcttatggtaccagcaggaagcaggccaaggcccctgtcgttgatcatttataagtctttagagacggcctgacgggacccctgacgcgattctctggctccagctcagcgacacngtcacgttcacatcagtggagtcggnagngacgagctgactattacngtcagtcatcagacagtagtgactattcgtgtcgtagttccggacggacggaccaagtcgtacgaccgtccgtaggccacgaccgaggcctcccgg

SEQ ID NO: 21549 - DNA, 173 bp, Homo sapiens; identical to SEQ ID NO: 20229
  misc_feature: GYAE6OF02HI3BG.49.53.E09.1.454.CMB.1.raw
  modified_base (173)..(173): a, c, t, g, unknown or other
  misc_feature (173)..(173): n is a, c, g, or t

SEQ ID NO: 21550 - DNA, 498 bp, Homo sapiens
  misc_feature: GYAE6OF02IV2HQ.49.53.E09.1.454.CMB.1.raw
  modified_base (384)..(384): a, c, t, g, unknown or other
  misc_feature (384)..(384): n is a, c, g, or t
  modified_base (435)..(435): a, c, t, g, unknown or other
  misc_feature (435)..(435): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctcagctcagcgacaacagtcacgttgaccatcagtggagtccgggnagaggacgaggctgactattactgtcagtcatcagacagtagtgcacttcngtcgttattcgggacggagggaccaaggctacgaccgtcgtaggtcacggcccaaggctccgg

SEQ ID NO: 21551 - DNA, 174 bp, Homo sapiens; identical to SEQ ID NO: 20265
  misc_feature: GYAE6OF02GL2OZ.49.53.E09.1.454.CMB.1.raw
  modified_base (173)..(174): a, c, t, g, unknown or other
  misc_feature (173)..(174): n is a, c, g, or t

SEQ ID NO: 21552 - DNA, 755 bp, Homo sapiens
  misc_feature: GYAE6OF02HPI8D.49.53.E09.1.454.CMB.1.raw
  modified_base (223)..(223): a, c, t, g, unknown or other
  misc_feature (223)..(223): n is a, c, g, or t
tcagagtcgagagacacgaccggtgctcgatttagagagagtgtgttgggtttggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaggactcacctgctcgtgganatgctagttcgacccaaaccgatatgactttagttcggtaccagcgaagaacggcccgggcacggcccctgtcttgatctatttaataaagtctttagaggacggcctacgacgggtaccctagacgcgtatttccgtcgtcggccttaccgacgtccttccgaacggaccgaaccgaaaccgtacggttaccctaaacggtttacgaaccctaagttaccgtaaggttacggggtaaccggttccccggggacaacggggaacgggaaccgggaagggtaccgttacggtaaacctttaacgtttaaccgtttcggtaacgttaacgttacgtaactaccgtaaacggaaccgtaaggttaggtaccggacttaaccgtttcgttggttacgttaacggttcggggaccgggtaaccgggtaacctaacgggtccgttaccggaaccccggttacccgttaacgggtaccgacccgggaaccccggtaacgggttcccggtaccccggttccccccggttcgggtaacccc

SEQ ID NO: 21553 - DNA, 190 bp, Homo sapiens
  misc_feature: GYAE6OF02HQMFJ.49.53.E09.1.454.CMB.1.raw
  modified_base (174)..(190): a, c, t, g, unknown or other
  misc_feature (174)..(190): n is a, c, g, or t
tcagagtcgagagacacgaccggtgctcgatttagagagagtgtgttgggtttgggggaagagggaagactgacggtcccccaggagttcaggtgctgggcacagcggccctgggctgcctggtcaaggactacttcctctctcgactctgagcgggctggcaaggcgcatagnnnnnnnnnnnnnnnnn

SEQ ID NO: 21554 - DNA, 195 bp, Homo sapiens
  misc_feature: GYAE6OF02ICPVU.49.53.E09.1.454.CMB.1.raw
  modified_base (176)..(195): a, c, t, g, unknown or other
  misc_feature (176)..(195): n is a, c, g, or t
tcagagtcgagagacacgaccggtgctcgatttagagagagtgtggttggggtttgggggaagaggaagactgacggtcccccgaggagttcaggtgctgggcacagcggccctgggctgcctggtcaaggactacttcctctctcgactctgagcgggctggcaaggcgcatagnnnnnnnnnnnnnnnnnnnn

SEQ ID NO: 21555 - DNA, 174 bp, Homo sapiens; identical to SEQ ID NO: 20265
  misc_feature: GYAE6OF02GM40U.49.53.E09.1.454.CMB.1.raw
  modified_base (173)..(174): a, c, t, g, unknown or other
  misc_feature (173)..(174): n is a, c, g, or t

SEQ ID NO: 21556 - DNA, 180 bp, Homo sapiens; identical to SEQ ID NO: 20243
  misc_feature: GYAE6OF02IF5W2.49.53.E09.1.454.CMB.1.raw
  modified_base (173)..(180): a, c, t, g, unknown or other
  misc_feature (173)..(180): n is a, c, g, or t

SEQ ID NO: 21557 - DNA, 174 bp, Homo sapiens; identical to SEQ ID NO: 20265
  misc_feature: GYAE6OF02IFSYT.49.53.E09.1.454.CMB.1.raw
  modified_base (173)..(174): a, c, t, g, unknown or other
  misc_feature (173)..(174): n is a, c, g, or t

SEQ ID NO: 21558 - DNA, 178 bp, Homo sapiens
  misc_feature: GYAE6OF02HGZ0D.49.53.E09.1.454.CMB.1.raw
  modified_base (173)..(178): a, c, t, g, unknown or other
  misc_feature (173)..(178): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaagcactacttcctctctcgactctgagcgggctggcaaggcgcatagnnnnnn

SEQ ID NO: 21559 - DNA, 175 bp, Homo sapiens; identical to SEQ ID NO: 20418
  misc_feature: GYAE6OF02HT6ND.49.53.E09.1.454.CMB.1.raw
  modified_base (173)..(175): a, c, t, g, unknown or other
  misc_feature (173)..(175): n is a, c, g, or t

SEQ ID NO: 21560 - DNA, 175 bp, Homo sapiens
  misc_feature: GYAE6OF02FU9IF.49.53.E09.1.454.CMB.1.raw
  modified_base (174)..(175): a, c, t, g, unknown or other
  misc_feature (174)..(175): n is a, c, g, or t
tcagagtcgagagacacgaccggtgctcgatttagagagagtgtgttgggtttgtggggaagaggaagactgacggtcccccaggagttcaggtgctgggcacagcggccctgggctgcctggtcaaggactacttcctctctcgactctgagcgggctggcaaggcgcatagnn

SEQ ID NO: 21561 - DNA, 175 bp, Homo sapiens; identical to SEQ ID NO: 20418
  misc_feature: GYAE6OF02F9YUU.49.53.E09.1.454.CMB.1.raw
  modified_base (173)..(175): a, c, t, g, unknown or other
  misc_feature (173)..(175): n is a, c, g, or t

SEQ ID NO: 21562 - DNA, 173 bp, Homo sapiens; identical to SEQ ID NO: 20229
  misc_feature: GYAE6OF02JC92N.49.53.E09.1.454.CMB.1.raw
  modified_base (173)..(173): a, c, t, g, unknown or other
  misc_feature (173)..(173): n is a, c, g, or t

SEQ ID NO: 21563 - DNA, 174 bp, Homo sapiens; identical to SEQ ID NO: 20630
  misc_feature: GYAE6OF02I2ABN.49.53.E09.1.454.CMB.1.raw
  modified_base (173)..(174): a, c, t, g, unknown or other
  misc_feature (173)..(174): n is a, c, g, or t

SEQ ID NO: 21564 - DNA, 183 bp, Homo sapiens
  misc_feature: GYAE6OF02HC9LP.49.53.E09.1.454.CMB.1.raw
  modified_base (174)..(183): a, c, t, g, unknown or other
  misc_feature (174)..(183): n is a, c, g, or t
tcagagtcgagagacacgaccggtgctcgatttagagagagtgtgttgggtttgggggaagaaggaagactgacggtcccccaggagttcaggtgctgggcacagcggccctgggctgcctggtcaaggactacttcctctctcgactctgagcgggctggcaaggcgcatagnnnnnnnnnn

SEQ ID NO: 21565 - DNA, 505 bp, Homo sapiens
  misc_feature: GYAE6OF02HZBKB.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagccaggccaggcccctgtcttgatcatttataaagtactttgagagggcctcgacgggacccctgagcgattctctggctcagctcagcgacaacagtcacgttgaccatcagtggacgtcgggcaggaggacgaggctgacttattactgtcagtcatcagactagtagtgctacttctgtcgtagttcggacggaggaccaggcgtcgaccgtctaggtccgacgcccgaggctacccgg

SEQ ID NO: 21566 - DNA, 173 bp, Homo sapiens; identical to SEQ ID NO: 20229
  misc_feature: GYAE6OF02G7W37.49.53.E09.1.454.CMB.1.raw
  modified_base (173)..(173): a, c, t, g, unknown or other
  misc_feature (173)..(173): n is a, c, g, or t

SEQ ID NO: 21567 - DNA, 173 bp, Homo sapiens; identical to SEQ ID NO: 20229
  misc_feature: GYAE6OF02FQBTZ.49.53.E09.1.454.CMB.1.raw
  modified_base (173)..(173): a, c, t, g, unknown or other
  misc_feature (173)..(173): n is a, c, g, or t

SEQ ID NO: 21568 - DNA, 173 bp, Homo sapiens; identical to SEQ ID NO: 20229
  misc_feature: GYAE6OF02F508M.49.53.E09.1.454.CMB.1.raw
  modified_base (173)..(173): a, c, t, g, unknown or other
  misc_feature (173)..(173): n is a, c, g, or t

SEQ ID NO: 21569 - DNA, 260 bp, Homo sapiens
  misc_feature: GYAE6OF02FQPXY.49.53.E09.1.454.CMB.1.raw
  modified_base (181)..(181): a, c, t, g, unknown or other
  misc_feature (181)..(181): n is a, c, g, or t
  modified_base (183)..(184): a, c, t, g, unknown or other
  misc_feature (183)..(184): n is a, c, g, or t
  modified_base (186)..(188): a, c, t, g, unknown or other
  misc_feature (186)..(188): n is a, c, g, or t
  modified_base (191)..(193): a, c, t, g, unknown or other
  misc_feature (191)..(193): n is a, c, g, or t
  modified_base (195)..(260): a, c, t, g, unknown or other
  misc_feature (195)..(260): n is a, c, g, or t
tcagagtcgagagacacgaccggtgctcgatttagagagagtgtgttggggtttagggggggaagaggaagactgacggtcccccaggagttcgaggtgctgggccacagcggccctgggctgcctggtcaaggactacttcctctctcgactctggagcgggctggcaaggcgcataggncnntnnnagnnncnnnnnnnnnnnnnnnnnnnnnnnnnnnnnnnnnnnnnnnnnnnnnnnnnnnnnnnnnnnnnnnnnn

SEQ ID NO: 21570 - DNA, 173 bp, Homo sapiens; identical to SEQ ID NO: 20229
  misc_feature: GYAE6OF02G1U8W.49.53.E09.1.454.CMB.1.raw
  modified_base (173)..(173): a, c, t, g, unknown or other
  misc_feature (173)..(173): n is a, c, g, or t

SEQ ID NO: 21571 - DNA, 175 bp, Homo sapiens; identical to SEQ ID NO: 20418
  misc_feature: GYAE6OF02F0F73.49.53.E09.1.454.CMB.1.raw
  modified_base (173)..(175): a, c, t, g, unknown or other
  misc_feature (173)..(175): n is a, c, g, or t

SEQ ID NO: 21572 - DNA, 173 bp, Homo sapiens; identical to SEQ ID NO: 20229
  misc_feature: GYAE6OF02IVLPA.49.53.E09.1.454.CMB.1.raw
  modified_base (173)..(173): a, c, t, g, unknown or other
  misc_feature (173)..(173): n is a, c, g, or t

SEQ ID NO: 21573 - DNA, 175 bp, Homo sapiens; identical to SEQ ID NO: 20418
  misc_feature: GYAE6OF02GLZ05.49.53.E09.1.454.CMB.1.raw
  modified_base (173)..(175): a, c, t, g, unknown or other
  misc_feature (173)..(175): n is a, c, g, or t

SEQ ID NO: 21574 - DNA, 173 bp, Homo sapiens; identical to SEQ ID NO: 20229
  misc_feature: GYAE6OF02H469F.49.53.E09.1.454.CMB.1.raw
  modified_base (173)..(173): a, c, t, g, unknown or other
  misc_feature (173)..(173): n is a, c, g, or t

SEQ ID NO: 21575 - DNA, 175 bp, Homo sapiens; identical to SEQ ID NO: 20458
  misc_feature: GYAE6OF02JMNWF.49.53.E09.1.454.CMB.1.raw
  modified_base (173)..(175): a, c, t, g, unknown or other
  misc_feature (173)..(175): n is a, c, g, or t

SEQ ID NO: 21576 - DNA, 173 bp, Homo sapiens; identical to SEQ ID NO: 20229
  misc_feature: GYAE6OF02HEGCF.49.53.E09.1.454.CMB.1.raw
  modified_base (173)..(173): a, c, t, g, unknown or other
  misc_feature (173)..(173): n is a, c, g, or t

SEQ ID NO: 21577 - DNA, 172 bp, Homo sapiens; identical to SEQ ID NO: 20291
  misc_feature: GYAE6OF02HYSV5.49.53.E09.1.454.CMB.1.raw

SEQ ID NO: 21578 - DNA, 565 bp, Homo sapiens
  misc_feature: GYAE6OF02H96JV.49.53.E09.1.454.CMB.1.raw
  modified_base (421)..(421): a, c, t, g, unknown or other
  misc_feature (421)..(421): n is a, c, g, or t
tcagagtcgagagacacgaccggtgctcgatttagagagagtgtgttgggtttgggggtggtccaggaggcagaactctgggtgtctcaccatggcctggatccctctacttctccccctcctcactctctgcacagactctgaggcctcctatgagctgacacagcccaccctcggtgtctgtgtcctcaggacaggacggccagtatcacctgctctggagatgcattgaccaaagcaatatgacttactggtaccagcagaagccaggccacggcccctgtcttgatctaatttaataagtactttgagagggcctacgacgggaccctgacgcgattcctcgtggctccgagctacgagaccgaacaacacgtactacggtttagacctataccgaggtcgggacggttccgggganaacgggacgggacggagggctacggtaacttaattacgtgtcagttcaagtcagacgagtagtgacctactgttgtcgtagttcgggacggaggaccaaggcctaggacccgtcgtacggtccacggccctacggcctacccgg

SEQ ID NO: 21579 - DNA, 174 bp, Homo sapiens; identical to SEQ ID NO: 20265
  misc_feature: GYAE6OF02IJYBB.49.53.E09.1.454.CMB.1.raw
  modified_base (173)..(174): a, c, t, g, unknown or other
  misc_feature (173)..(174): n is a, c, g, or t

SEQ ID NO: 21580 - DNA, 178 bp, Homo sapiens; identical to SEQ ID NO: 20465
  misc_feature: GYAE6OF02FJYJN.49.53.E09.1.454.CMB.1.raw
  modified_base (173)..(178): a, c, t, g, unknown or other
  misc_feature (173)..(178): n is a, c, g, or t

SEQ ID NO: 21581 - DNA, 174 bp, Homo sapiens; identical to SEQ ID NO: 20265
  misc_feature: GYAE6OF02IJBRG.49.53.E09.1.454.CMB.1.raw
  modified_base (173)..(174): a, c, t, g, unknown or other
  misc_feature (173)..(174): n is a, c, g, or t

SEQ ID NO: 21582 - DNA, 633 bp, Homo sapiens
  misc_feature: GYAE6OF02I2H6F.49.53.E09.1.454.CMB.1.raw
  modified_base (222)..(222): a, c, t, g, unknown or other
  misc_feature (222)..(222): n is a, c, g, or t
tcagagtcgagagacacgaccggtgctcgatttagagagagtgtgttgggtttggggtgggtccaggaggcagaactctgggtgtctcaccatggcctggatccctctacttctccccctcctcactctctgcacagactctgaggcctcctatgagctgacacagccaccctcggtgtctgtgtccctcaggacagacggccagtatcacctgctctgganatgcattgccaaaagcaatatgcttactggtaccagcagaagccaggccaggcccctgtcttgatcgtatttataagtactttgagacgggcctgacgggacccccttggagccgtaattcctcgtacggccttaccagtcctcgacggccgaacaaacgacgtacctaccgttggaaccctagtaccgtaaggttgggtaccggttcccggggactaacggaacgggaaccggacgggtcttacgtacttaacgttacgttacgtcctagtacctatccgaagacgtacggttagcggtacctacgttacgtgttaccgttagttccgggacggaacgggtaaccaaggtccgttacgacccgttacggtaccggtaccgaccggtacccgaacggtccgttacccccgg

SEQ ID NO: 21583 - DNA, 179 bp, Homo sapiens; identical to SEQ ID NO: 20397
  misc_feature: GYAE6OF02I5Y07.49.53.E09.1.454.CMB.1.raw
  modified_base (173)..(179): a, c, t, g, unknown or other
  misc_feature (173)..(179): n is a, c, g, or t

SEQ ID NO: 21584 - DNA, 173 bp, Homo sapiens; identical to SEQ ID NO: 20229
  misc_feature: GYAE6OF02GU0J7.49.53.E09.1.454.CMB.1.raw
  modified_base (173)..(173): a, c, t, g, unknown or other
  misc_feature (173)..(173): n is a, c, g, or t

SEQ ID NO: 21585 - DNA, 503 bp, Homo sapiens
  misc_feature: GYAE6OF02IJ02G.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcgacgggacccctgagcgattctctggctccagctcagcgacaacagtcacgttgaccatcagtggagtccgggcaggaggacgaggctgactattactgtcagtcatcagacagtagtgcacttctgtcgtattcgggcggaagggaccaaggctacgaccgtccgtaggtcacgcccaggctacccgg

SEQ ID NO: 21586 - DNA, 173 bp, Homo sapiens; identical to SEQ ID NO: 20337
  misc_feature: GYAE6OF02GIM3R.49.53.E09.1.454.CMB.1.raw
  modified_base (173)..(173): a, c, t, g, unknown or other
  misc_feature (173)..(173): n is a, c, g, or t

SEQ ID NO: 21587 - DNA, 172 bp, Homo sapiens; identical to SEQ ID NO: 20291
  misc_feature: GYAE6OF02F0O1G.49.53.E09.1.454.CMB.1.raw

SEQ ID NO: 21588 - DNA, 173 bp, Homo sapiens; identical to SEQ ID NO: 20229
  misc_feature: GYAE6OF02F5A27.49.53.E09.1.454.CMB.1.raw
  modified_base (173)..(173): a, c, t, g, unknown or other
  misc_feature (173)..(173): n is a, c, g, or t

SEQ ID NO: 21589 - DNA, 200 bp, Homo sapiens
  misc_feature: GYAE6OF02FFGG3.49.53.E09.1.454.CMB.1.raw
  modified_base (176)..(200): a, c, t, g, unknown or other
  misc_feature (176)..(200): n is a, c, g, or t
tcagagtcgagagacacgaccggtgctcgatttagagagagtgtgttgggtttggggggaagaggaagactgacggtcccccaggagttcgaggtgctgggcacagcggccctgggctgcctggtcaaggactacttcctctctcgactctgagcgggctggcaaggcgcagtagnnnnnnnnnnnnnnnnnnnnnnnnn

SEQ ID NO: 21590 - DNA, 175 bp, Homo sapiens; identical to SEQ ID NO: 20458
  misc_feature: GYAE6OF02I3H3Q.49.53.E09.1.454.CMB.1.raw
  modified_base (173)..(175): a, c, t, g, unknown or other
  misc_feature (173)..(175): n is a, c, g, or t

SEQ ID NO: 21591 - DNA, 173 bp, Homo sapiens; identical to SEQ ID NO: 20229
  misc_feature: GYAE6OF02GE83Z.49.53.E09.1.454.CMB.1.raw
  modified_base (173)..(173): a, c, t, g, unknown or other
  misc_feature (173)..(173): n is a, c, g, or t

SEQ ID NO: 21592 - DNA, 177 bp, Homo sapiens; identical to SEQ ID NO: 20482
  misc_feature: GYAE6OF02I6OD4.49.53.E09.1.454.CMB.1.raw
  modified_base (173)..(177): a, c, t, g, unknown or other
  misc_feature (173)..(177): n is a, c, g, or t

SEQ ID NO: 21593 - DNA, 173 bp, Homo sapiens; identical to SEQ ID NO: 20229
  misc_feature: GYAE6OF02GAS5U.49.53.E09.1.454.CMB.1.raw
  modified_base (173)..(173): a, c, t, g, unknown or other
  misc_feature (173)..(173): n is a, c, g, or t

SEQ ID NO: 21594 - DNA, 174 bp, Homo sapiens; identical to SEQ ID NO: 20265
  misc_feature: GYAE6OF02HBYUK.49.53.E09.1.454.CMB.1.raw
  modified_base (173)..(174): a, c, t, g, unknown or other
  misc_feature (173)..(174): n is a, c, g, or t

SEQ ID NO: 21595 - DNA, 173 bp, Homo sapiens; identical to SEQ ID NO: 20229
  misc_feature: GYAE6OF02HO2W8.49.53.E09.1.454.CMB.1.raw
  modified_base (173)..(173): a, c, t, g, unknown or other
  misc_feature (173)..(173): n is a, c, g, or t

SEQ ID NO: 21596 - DNA, 174 bp, Homo sapiens; identical to SEQ ID NO: 20265
  misc_feature: GYAE6OF02GWXTC.49.53.E09.1.454.CMB.1.raw
  modified_base (173)..(174): a, c, t, g, unknown or other
  misc_feature (173)..(174): n is a, c, g, or t

SEQ ID NO: 21597 - DNA, 489 bp, Homo sapiens
  misc_feature: GYAE6OF02FSSM3.49.53.E09.1.454.CMB.1.raw
  modified_base (222)..(222): a, c, t, g, unknown or other
  misc_feature (222)..(222): n is a, c, g, or t
  modified_base (439)..(439): a, c, t, g, unknown or other
  misc_feature (439)..(439): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctgganatgcattgccaaaagcaatatgcttactggtaccagcagaagccaggccaggcccctgtcttgatcatttataaagactttgagagggcctcgagggacccctgagcgattctctggctccagctcagcgacaacagtcacgttgaccatcagtggagtccgggcagaggacgaggctgacttattactgtcagtcatcagacagtagtggcacttntgtcgtagtcggcggaggaccaagctgacgtctagtcagccaggctcccg

SEQ ID NO: 21598 - DNA, 173 bp, Homo sapiens; identical to SEQ ID NO: 20229
  misc_feature: GYAE6OF02HA1AX.49.53.E09.1.454.CMB.1.raw
  modified_base (173)..(173): a, c, t, g, unknown or other
  misc_feature (173)..(173): n is a, c, g, or t

SEQ ID NO: 21599 - DNA, 177 bp, Homo sapiens
  misc_feature: GYAE6OF02FR6CR.49.53.E09.1.454.CMB.1.raw
  modified_base (171)..(177): a, c, t, g, unknown or other
  misc_feature (171)..(177): n is a, c, g, or t
tcagagtcgagagacacgaccggtgctcgatttagagagagtgtgtgggtttgggggaagaggaagactgacggtcccccaggagttcaggtgctgggcacagcggcctgggctgcctggtcaaggactacttcctctctcgactctgagcgggctggcaaggcgcatagnnnnnnn

SEQ ID NO: 21600 - DNA, 192 bp, Homo sapiens
  misc_feature: GYAE6OF02IYN1A.49.53.E09.1.454.CMB.1.raw
  modified_base (175)..(192): a, c, t, g, unknown or other
  misc_feature (175)..(192): n is a, c, g, or t
tcagagtcgagagacacgaccggtgctcgatttagagagagtgtgttgggttgggggaagaggaagactgacggtcccccaggagttcgaggtgctgggccacagcggccctgggctgccctggtcaaggactacttcctcgtagcactctgagcgggctggcaaggcgcatagnnnnnnnnnnnnnnnnnn

SEQ ID NO: 21601 - DNA, 173 bp, Homo sapiens; identical to SEQ ID NO: 20229
  misc_feature: GYAE6OF02F4BAL.49.53.E09.1.454.CMB.1.raw
  modified_base (173)..(173): a, c, t, g, unknown or other
  misc_feature (173)..(173): n is a, c, g, or t

SEQ ID NO: 21602 - DNA, 176 bp, Homo sapiens; identical to SEQ ID NO: 20270
  misc_feature: GYAE6OF02HI77A.49.53.E09.1.454.CMB.1.raw
  modified_base (173)..(176): a, c, t, g, unknown or other
  misc_feature (173)..(176): n is a, c, g, or t

SEQ ID NO: 21603 - DNA, 174 bp, Homo sapiens; identical to SEQ ID NO: 20960
  misc_feature: GYAE6OF02IQIYW.49.53.E09.1.454.CMB.1.raw
  modified_base (174)..(174): a, c, t, g, unknown or other
  misc_feature (174)..(174): n is a, c, g, or t

SEQ ID NO: 21604 - DNA, 173 bp, Homo sapiens; identical to SEQ ID NO: 20337
  misc_feature: GYAE6OF02F2CWD.49.53.E09.1.454.CMB.1.raw
  modified_base (173)..(173): a, c, t, g, unknown or other
  misc_feature (173)..(173): n is a, c, g, or t

SEQ ID NO: 21605 - DNA, 209 bp, Homo sapiens
  misc_feature: GYAE6OF02HDKAS.49.53.E09.1.454.CMB.1.raw
  modified_base (174)..(209): a, c, t, g, unknown or other
  misc_feature (174)..(209): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacgttcctctctcgactctgagcgggctggcaaggcgcatagnnnnnnnnnnnnnnnnnnnnnnnnnnnnnnnnnnnn

SEQ ID NO: 21606 - DNA, 174 bp, Homo sapiens; identical to SEQ ID NO: 20960
  misc_feature: GYAE6OF02GWO7N.49.53.E09.1.454.CMB.1.raw
  modified_base (174)..(174): a, c, t, g, unknown or other
  misc_feature (174)..(174): n is a, c, g, or t

SEQ ID NO: 21607 - DNA, 174 bp, Homo sapiens; identical to SEQ ID NO: 20960
  misc_feature: GYAE6OF02IGO2V.49.53.E09.1.454.CMB.1.raw
  modified_base (174)..(174): a, c, t, g, unknown or other
  misc_feature (174)..(174): n is a, c, g, or t

SEQ ID NO: 21608 - DNA, 174 bp, Homo sapiens; identical to SEQ ID NO: 20265
  misc_feature: GYAE6OF02F22MO.49.53.E09.1.454.CMB.1.raw
  modified_base (173)..(174): a, c, t, g, unknown or other
  misc_feature (173)..(174): n is a, c, g, or t

SEQ ID NO: 21609 - DNA, 174 bp, Homo sapiens; identical to SEQ ID NO: 20265
  misc_feature: GYAE6OF02JELGS.49.53.E09.1.454.CMB.1.raw
  modified_base (173)..(174): a, c, t, g, unknown or other
  misc_feature (173)..(174): n is a, c, g, or t

SEQ ID NO: 21610 - DNA, 676 bp, Homo sapiens
  misc_feature: GYAE6OF02ICING.49.53.E09.1.454.CMB.1.raw
  modified_base (226)..(226): a, c, t, g, unknown or other
  misc_feature (226)..(226): n is a, c, g, or t
tcagagtcgagagacacgaccggtgctcgatttagagagagtgtggtttggggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctcgtgganatgcagttcgaccgaaaagctaaatatacgcttaacgtacggtaccagacacgaacgccgacggccgacggcccttgttaccttaggacttacgtaatttaagtaaacgtacgtttaggaggtacggtcctacgacgggtaccctgacgcgtacttcgtctcggcctacgacgtctacgacgacgaacaacgtacgtacgtacggttacgaaccagtacgagggtacgggaacgggttcccgggagaacgggacggaaccggaggtccgttagtaacttacgttacgtgtaccgtagtactactacgaggacgtaggttacggtggtaaccgtacgttcgttacggttacggttacggttaccgggacgggtaacgggtacccgaaggtcccgttacggacccgttaccggtacgggtacccaccggtacccggtacggtccctccccgg

SEQ ID NO: 21611 - DNA, 175 bp, Homo sapiens; identical to SEQ ID NO: 20418
  misc_feature: GYAE6OF02G4IQF.49.53.E09.1.454.CMB.1.raw
  modified_base (173)..(175): a, c, t, g, unknown or other
  misc_feature (173)..(175): n is a, c, g, or t

SEQ ID NO: 21612 - DNA, 173 bp, Homo sapiens; identical to SEQ ID NO: 20229
  misc_feature: GYAE6OF02FYS51.49.53.E09.1.454.CMB.1.raw
  modified_base (173)..(173): a, c, t, g, unknown or other
  misc_feature (173)..(173): n is a, c, g, or t

SEQ ID NO: 21613 - DNA, 175 bp, Homo sapiens
  misc_feature: GYAE6OF02HXL0K.49.53.E09.1.454.CMB.1.raw
  modified_base (172)..(175): a, c, t, g, unknown or other
  misc_feature (172)..(175): n is a, c, g, or t
tcagagtcgagagacacgaccggtgctcgatttagagagagtgtgttgggtttgggggaagaggaagactgacggtcccccaggagttcaggtgctgggcacagcggcctgggctgcctggtcaaggactacttcctctctcgactctgagcgggctggcaaggcgcatagnnnn

SEQ ID NO: 21614 - DNA, 174 bp, Homo sapiens; identical to SEQ ID NO: 20265
  misc_feature: GYAE6OF02I5Z31.49.53.E09.1.454.CMB.1.raw
  modified_base (173)..(174): a, c, t, g, unknown or other
  misc_feature (173)..(174): n is a, c, g, or t

SEQ ID NO: 21615 - DNA, 174 bp, Homo sapiens; identical to SEQ ID NO: 20630
  misc_feature: GYAE6OF02I55BY.49.53.E09.1.454.CMB.1.raw
  modified_base (173)..(174): a, c, t, g, unknown or other
  misc_feature (173)..(174): n is a, c, g, or t

SEQ ID NO: 21616 - DNA, 172 bp, Homo sapiens; identical to SEQ ID NO: 20291
  misc_feature: GYAE6OF02IJ0Y2.49.53.E09.1.454.CMB.1.raw

SEQ ID NO: 21617 - DNA, 173 bp, Homo sapiens; identical to SEQ ID NO: 20229
  misc_feature: GYAE6OF02GMEXT.49.53.E09.1.454.CMB.1.raw
  modified_base (173)..(173): a, c, t, g, unknown or other
  misc_feature (173)..(173): n is a, c, g, or t

SEQ ID NO: 21618 - DNA, 519 bp, Homo sapiens
  misc_feature: GYAE6OF02I4AUD.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcaggaggacgaggctgactattactgtcagtcatcagacagtagtgctacttctgttcgtagttcgggacggtaagggacctaaggccgtaggacccgttccgtacgggtccacggacccaagggcctaccccgg

SEQ ID NO: 21619 - DNA, 174 bp, Homo sapiens; identical to SEQ ID NO: 20265
  misc_feature: GYAE6OF02G4UQ9.49.53.E09.1.454.CMB.1.raw
  modified_base (173)..(174): a, c, t, g, unknown or other
  misc_feature (173)..(174): n is a, c, g, or t

SEQ ID NO: 21620 - DNA, 176 bp, Homo sapiens
  misc_feature: GYAE6OF02IEY1Z.49.53.E09.1.454.CMB.1.raw
  modified_base (174)..(176): a, c, t, g, unknown or other
  misc_feature (174)..(176): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnn

SEQ ID NO: 21621 - DNA, 510 bp, Homo sapiens
  misc_feature: GYAE6OF02HSDDW.49.53.E09.1.454.CMB.1.raw
  modified_base (375)..(375): a, c, t, g, unknown or other
  misc_feature (375)..(375): n is a, c, g, or t
  modified_base (439)..(439): a, c, t, g, unknown or other
  misc_feature (439)..(439): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgacgggacccctggacgcggtaattctcgtgggcctccagctcagcgacaacagtcacgttnaccatcagtggagtccggcaggaggacgaggctgactattactgtacagtcatcagacagtagngcacttctgtcgtagttcgggcggaggaccgaagcgtcgaccgtcgtaggtccaggcccgaggcctcccgg

SEQ ID NO: 21622 - DNA, 173 bp, Homo sapiens; identical to SEQ ID NO: 20229
  misc_feature: GYAE6OF02GAS0Y.49.53.E09.1.454.CMB.1.raw
  modified_base (173)..(173): a, c, t, g, unknown or other
  misc_feature (173)..(173): n is a, c, g, or t

SEQ ID NO: 21623 - DNA, 179 bp, Homo sapiens
  misc_feature: GYAE6OF02FHIH9.49.53.E09.1.454.CMB.1.raw
  modified_base (174)..(179): a, c, t, g, unknown or other
  misc_feature (174)..(179): n is a, c, g, or t
tcagagtcgagagacacgaccggtgctcgatttagagagagtgtggttgggtttgggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 21624 - DNA, 173 bp, Homo sapiens; identical to SEQ ID NO: 20229
  misc_feature: GYAE6OF02H94DU.49.53.E09.1.454.CMB.1.raw
  modified_base (173)..(173): a, c, t, g, unknown or other
  misc_feature (173)..(173): n is a, c, g, or t

SEQ ID NO: 21625 - DNA, 189 bp, Homo sapiens
  misc_feature: GYAE6OF02F9NAM.49.53.E09.1.454.CMB.1.raw
  modified_base (175)..(189): a, c, t, g, unknown or other
  misc_feature (175)..(189): n is a, c, g, or t
tcagagtcgagagacacgaccggtgctcgatttagagagagtgtgttgggtttagggggaagaggaagactgacggtcccccaggagttcaggtgctgggccacagcggccctgggctgcctggtcaaggactacttcctctctcgactctgagcgggctggcaaggcgcatagnnnnnnnnnnnnnnn

SEQ ID NO: 21626 - DNA, 529 bp, Homo sapiens
  misc_feature: GYAE6OF02GGO6D.49.53.E09.1.454.CMB.1.raw
  modified_base (394)..(394): a, c, t, g, unknown or other
  misc_feature (394)..(394): n is a, c, g, or t
  modified_base (422)..(422): a, c, t, g, unknown or other
  misc_feature (422)..(422): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatctatttataaagtactttgagagggcctcgacgggacccctgagcgtattctcgtggctcagctcagcgacaacagtcacgttgaaccatcagtcggaggtccggganaggaggacggaggcgtgacttattacgngtacagtcatacagacagtagtgactactttctgtcgtagttcgggcggacggtaccaggtcctcgacccggttcctacgggtccacggacccgaggtcctacccgg

SEQ ID NO: 21627 - DNA, 173 bp, Homo sapiens; identical to SEQ ID NO: 20337
  misc_feature: GYAE6OF02FSNN9.49.53.E09.1.454.CMB.1.raw
  modified_base (173)..(173): a, c, t, g, unknown or other
  misc_feature (173)..(173): n is a, c, g, or t

SEQ ID NO: 21628 - DNA, 176 bp, Homo sapiens
  misc_feature: GYAE6OF02IY3ZC.49.53.E09.1.454.CMB.1.raw
  modified_base (174)..(176): a, c, t, g, unknown or other
  misc_feature (174)..(176): n is a, c, g, or t
tcagagtcgagagacacgaccggtgctcgatttagagagagtgtgttgggtttgggggaagaggaagactgacggtcccccgaggagttcaggtgctgggcacagcggccctgggctgcctggtcaaggactacttcctctctcgactctgagcgggctggcaaggcgcatagnnn

SEQ ID NO: 21629 - DNA, 174 bp, Homo sapiens; identical to SEQ ID NO: 20265
  misc_feature: GYAE6OF02HNKH2.49.53.E09.1.454.CMB.1.raw
  modified_base (173)..(174): a, c, t, g, unknown or other
  misc_feature (173)..(174): n is a, c, g, or t

SEQ ID NO: 21630 - DNA, 506 bp, Homo sapiens
  misc_feature: GYAE6OF02FPT2R.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgacgggacccctgagcgattctctggctccgagctcagcgacaacagtcacgtgaccatcagtggagtccgggcaggaggacgaggctgacttattactgtcagtcatcagactagtagtggcacttctgtcgttagtcggcgggagggaccaaggctacgaccgtcgtaggtccaggcccaggcctacccgg

SEQ ID NO: 21631 - DNA, 173 bp, Homo sapiens; identical to SEQ ID NO: 20834
  misc_feature: GYAE6OF02F27QB.49.53.E09.1.454.CMB.1.raw
  modified_base (173)..(173): a, c, t, g, unknown or other
  misc_feature (173)..(173): n is a, c, g, or t

SEQ ID NO: 21632 - DNA, 518 bp, Homo sapiens
  misc_feature: GYAE6OF02G5T2F.49.53.E09.1.454.CMB.1.raw
  modified_base (334)..(334): a, c, t, g, unknown or other
  misc_feature (334)..(334): n is a, c, g, or t
  modified_base (385)..(385): a, c, t, g, unknown or other
  misc_feature (385)..(385): n is a, c, g, or t
  modified_base (424)..(424): a, c, t, g, unknown or other
  misc_feature (424)..(424): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcacgggacccctgagcgattcnctggctcagctcagcgacaacagtcacgttgaccatcagtggagtccgggnaggaggacgaggctgacttattactgtcagtcatcaganagtagtcggctactttcgtgttccgttagttcgggacgggtaagggacccaaggcgtacgaccgtcgtaggtccaggcccgaaggcgtccccgg

SEQ ID NO: 21633 - DNA, 535 bp, Homo sapiens
  misc_feature: GYAE6OF02HOM0X.49.53.E09.1.454.CMB.1.raw
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttaataaagtacttttgagtagggcctcgacgggacccctgacgcgattctcgtggctccagctcagcgacaacagtcacgttgaccatcaggtggaggtccgggnaggaggacgnggctgtactattactgtcagttcatcgaagacaggtagtcggctactcttgtgttacgttcgggacgggaacgggacctaaggcgttacggacccgttcgttacggccacggacccgaggtccctcccgg

SEQ ID NO: 21634 - DNA, 547 bp, Homo sapiens
  misc_feature: GYAE6OF02GY3W6.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggccctgtcttgatcatttaataaagtactttagagagggcctcgacgggacccctgagcgtattctcgtggctcagctcacgcgaacaacagtctacgttcgaccatcgaggtggacggtccgggcaaggacggacggaggctagtacttattacgtgtcagtcatacacgacaggtagtgctacgttcgtgttccgttagttcggacgggtaacgggaaccgagtcgtacgtaccgtaccgtacggtccgacgacccgaacggcctaccccgg

SEQ ID NO: 21635 - DNA, 508 bp, Homo sapiens
  misc_feature: GYAE6OF02GJ5XH.49.53.E09.1.454.CMB.1.raw
  modified_base (458)..(458): a, c, t, g, unknown or other
  misc_feature (458)..(458): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagacttttgagagggcctcagggacccctgagcgattctctggctccagctcagcgacaacagtcacgttgaccatcaggtggaggtccgggcaggaggacgaggctgactattactgtcagtcatcagacagtagtggctacttctgtcgttagttccgggnggagggaccaaggcgtagaccgtcgtacggtcacgcccgaggcctcccgg

SEQ ID NO: 21636 - DNA, 584 bp, Homo sapiens
  misc_feature: GYAE6OF02IBZ6I.49.53.E09.1.454.CMB.1.raw
tcagagtcgagagacacgaccggtgctcgatttagagagagtgtgttgggtttgggggtgggtccaggaggcagaactctgggtgtctcaccatggcctggatcctctacttctcccctcctcactctctgcacagactctgaggcctcctatgagctgacacagccaccctcggtgtctgtgtcctcaggacagacggccagtatcacctgctctggagatgcattgccaaaagctaaatatgcttactggtaccagcagaagcaggcaggcccctgtcttgatctattaataaagtactttgagagggctcgacggaccctagacgcgattctctggctcagctcgagcgacaacagtcacgttcgaacctatccgaaggtcggacgtccgggacaacgggtaggacggaagggtcctaggtaactaacgtttacgtgtacacggttacaacttcgaacgacgtaggtaaggtcgactacgtttacgtcgttagttacgtcgggtacgggaacgggaaccgaaggtccttaggaccccggttctaacgggttccaacggcccgtaacgggcccttacccggg

SEQ ID NO: 21637 - DNA, 198 bp, Homo sapiens
  misc_feature: GYAE6OF02HBWWZ.49.53.E09.1.454.CMB.1.raw
  modified_base (173)..(198): a, c, t, g, unknown or other
  misc_feature (173)..(198): n is a, c, g, or t
tcagagtcgagagacacgaccggtgctcgatttagagagagtgtgttgggtttgggggaagaggaagactgacggtcccccaggagttcaggtgctgggcacagcggccctgggcctgcctggtcaaggctacttcctctctcgactctgagcgggctggcaaggcgcatagnnnnnnnnnnnnnnnnnnnnnnnnnn

SEQ ID NO: 21638 - DNA, 175 bp, Homo sapiens; identical to SEQ ID NO: 20418
  misc_feature: GYAE6OF02FORP1.49.53.E09.1.454.CMB.1.raw
  modified_base (173)..(175): a, c, t, g, unknown or other
  misc_feature (173)..(175): n is a, c, g, or t

SEQ ID NO: 21639 - DNA, 595 bp, Homo sapiens
  misc_feature: GYAE6OF02JDKX9.49.53.E09.1.454.CMB.1.raw
  modified_base (295)..(295): a, c, t, g, unknown or other
  misc_feature (295)..(295): n is a, c, g, or t
  modified_base (406)..(406): a, c, t, g, unknown or other
  misc_feature (406)..(406): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgcattgaccaaaagcaaatatgcttactggtaccagcagaagccaggccaggcccctgtctgatcattanaagactttgagaggcctacgacgggacccctgagcgtattctcgtggccttccgagctcgagcgaacaacgagtccacgttcgaaccatcgaaggtcgggacgtccggganaggaagggacgaggctaggactagttactgtacagttcactacgagaacgtagtacgtagcctaacgtttcgtacgttcgttacgttacggggaccgggtaacgggaacctaagggtaccttccggtaacccggttacccgttaacgggtaccaaccgggtaccccgaacggtcccgttaacccccggg

SEQ ID NO: 21640 - DNA, 173 bp, Homo sapiens; identical to SEQ ID NO: 20229
  misc_feature: GYAE6OF02H9QWS.49.53.E09.1.454.CMB.1.raw
  modified_base (173)..(173): a, c, t, g, unknown or other
  misc_feature (173)..(173): n is a, c, g, or t

SEQ ID NO: 21641 - DNA, 175 bp, Homo sapiens; identical to SEQ ID NO: 20418
  misc_feature: GYAE6OF02I8893.49.53.E09.1.454.CMB.1.raw
  modified_base (173)..(175): a, c, t, g, unknown or other
  misc_feature (173)..(175): n is a, c, g, or t

SEQ ID NO: 21642 - DNA, 508 bp, Homo sapiens
  misc_feature: GYAE6OF02IRDK9.49.53.E09.1.454.CMB.1.raw
  modified_base (224)..(224): a, c, t, g, unknown or other
  misc_feature (224)..(224): n is a, c, g, or t
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (397)..(397): a, c, t, g, unknown or other
  misc_feature (397)..(397): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (466)..(466): a, c, t, g, unknown or other
  misc_feature (466)..(466): n is a, c, g, or t
  modified_base (494)..(494): a, c, t, g, unknown or other
  misc_feature (494)..(494): n is a, c, g, or t
tcagagtcgagagacacgaccggtgctcgatttagagagagtgtgttgggtttgggggtgggtccgaggaggcagaactctgggtgtctcaccatggcctggatccctctacttctcccctcctcactctctgcacagactctgaggcctcctatgagctgacacacgccaccctcggtgtctgtcgtcctcaggacagacggccagtatcacctgctctgganatgctattgaccaaaagcaaatatgcttactggtaccagcagaancagcacggcccctgtctgatcattataaanctttagagtaggcctnacgggacccctgagcgattcncgtggctcagtctcgacgcgaacaacagtaccaacgttcgaaccatcacgtgagtccgggnacggaggacgaggctagacttatactgtcagtcatcganacagtagngctacttctgtcgtagttcggnggaacggaccagcgtgaccgtactgacncggaccagctcccg

SEQ ID NO: 21643 - DNA, 499 bp, Homo sapiens
  misc_feature: GYAE6OF02IM4M4.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagtactttgagagggcctcgacgggacccctgagcgattctctggctccagctcagcgacaacagtcacgttgaccatcagtggacgtccgggcaggaggacgaggctgactattactgtcagtcatcgagacagtagtgctacttcgtgtcgttagtcggcggaggaccagctgaccgtctaggtcacgcccgaggctcccgg

SEQ ID NO: 21644 - DNA, 177 bp, Homo sapiens; identical to SEQ ID NO: 20536
  misc_feature: GYAE6OF02I27WS.49.53.E09.1.454.CMB.1.raw
  modified_base (173)..(177): a, c, t, g, unknown or other
  misc_feature (173)..(177): n is a, c, g, or t

SEQ ID NO: 21645 - DNA, 175 bp, Homo sapiens; identical to SEQ ID NO: 20458
  misc_feature: GYAE6OF02G0HFO.49.53.E09.1.454.CMB.1.raw
  modified_base (173)..(175): a, c, t, g, unknown or other
  misc_feature (173)..(175): n is a, c, g, or t

SEQ ID NO: 21646 - DNA, 189 bp, Homo sapiens
  misc_feature: GYAE6OF02FJYFS.49.53.E09.1.454.CMB.1.raw
  modified_base (174)..(189): a, c, t, g, unknown or other
  misc_feature (174)..(189): n is a, c, g, or t
tcagagtcgagagacacgaccggtgctcgatttagagagagtgtgttgggtttggggggaagaggaagactgacggtcccccaggagttcaggtgctgggccacagcggccctgggctgcctggtcaaggctacttcctctctcgactctgagcgggctggcaaggcgcatagnnnnnnnnnnnnnnnn

SEQ ID NO: 21647 - DNA, 172 bp, Homo sapiens; identical to SEQ ID NO: 20291
  misc_feature: GYAE6OF02F7XVI.49.53.E09.1.454.CMB.1.raw

SEQ ID NO: 21648 - DNA, 175 bp, Homo sapiens; identical to SEQ ID NO: 20458
  misc_feature: GYAE6OF02JAP9P.49.53.E09.1.454.CMB.1.raw
  modified_base (173)..(175): a, c, t, g, unknown or other
  misc_feature (173)..(175): n is a, c, g, or t

SEQ ID NO: 21649 - DNA, 173 bp, Homo sapiens; identical to SEQ ID NO: 20229
  misc_feature: GYAE6OF02GMSWE.49.53.E09.1.454.CMB.1.raw
  modified_base (173)..(173): a, c, t, g, unknown or other
  misc_feature (173)..(173): n is a, c, g, or t

SEQ ID NO: 21650 - DNA, 175 bp, Homo sapiens; identical to SEQ ID NO: 20418
  misc_feature: GYAE6OF02FTSJ1.49.53.E09.1.454.CMB.1.raw
  modified_base (173)..(175): a, c, t, g, unknown or other
  misc_feature (173)..(175): n is a, c, g, or t

SEQ ID NO: 21651 - DNA, 177 bp, Homo sapiens; identical to SEQ ID NO: 20482
  misc_feature: GYAE6OF02F8IN3.49.53.E09.1.454.CMB.1.raw
  modified_base (173)..(177): a, c, t, g, unknown or other
  misc_feature (173)..(177): n is a, c, g, or t

SEQ ID NO: 21652 - DNA, 513 bp, Homo sapiens
  misc_feature: GYAE6OF02GS0U6.49.53.E09.1.454.CMB.1.raw
  modified_base (387)..(387): a, c, t, g, unknown or other
  misc_feature (387)..(387): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgtttactggtaccagcagaagcaggccaggcccctgtcttgatcatttataaagactttgagagggcctcgagggacccctgagcgattctctggctcagctcagcgaacaacagtcacgttcgaccatcagtggagtccgggnagaggacgaggctgactattacgtgtcagtcatcagacagtaggtgactacttctgtcgttagttcgggcggagggaccaaggctcggaccgttcgtacggtcacggcccaacggctacgcccccg

SEQ ID NO: 21653 - DNA, 174 bp, Homo sapiens; identical to SEQ ID NO: 20265
  misc_feature: GYAE6OF02F4UDK.49.53.E09.1.454.CMB.1.raw
  modified_base (173)..(174): a, c, t, g, unknown or other
  misc_feature (173)..(174): n is a, c, g, or t

SEQ ID NO: 21654 - DNA, 195 bp, Homo sapiens
  misc_feature: GYAE6OF02IN5CV.49.53.E09.1.454.CMB.1.raw
  modified_base (172)..(195): a, c, t, g, unknown or other
  misc_feature (172)..(195): n is a, c, g, or t
tcagagtcgagagacacgaccggtgctcgatttagagagagtgtgttgggtttgggggaagaggaagactgacggtcccccaggagttcaggtgctgggcacagcggccctggctgcctggtcaaggactacttcctctctcgactctgagcgggctggcaaggcgcatagnnnnnnnnnnnnnnnnnnnnnnnn

SEQ ID NO: 21655 - DNA, 199 bp, Homo sapiens
  misc_feature: GYAE6OF02G5I5L.49.53.E09.1.454.CMB.1.raw
  modified_base (176)..(199): a, c, t, g, unknown or other
  misc_feature (176)..(199): n is a, c, g, or t
tcagagtcgagagacacgaccggtgctcgatttagagagagtgtgttggggtttgggggaagaggaagactgacggtcccccaggagttcaggtgctgggcacagcggccctgggcctgcctggtcaacggactacttcctcgtagcactctgagcgggctggcaaggcgcatagnnnnnnnnnnnnnnnnnnnnnnnn

SEQ ID NO: 21656 - DNA, 192 bp, Homo sapiens
  misc_feature: GYAE6OF02FYEN1.49.53.E09.1.454.CMB.1.raw
  modified_base (175)..(192): a, c, t, g, unknown or other
  misc_feature (175)..(192): n is a, c, g, or t
tcagagtcgagagacacgaccggtgctcgatttagagagagtgtgttgggttgggggaagaggagactgacggtcccccaggagttcgaggtgctgggccacagcggccctgggctgccctggtcaaggactacttcctcgtagcactctgagcgggactggcaaggcgcatagnnnnnnnnnnnnnnnnnn

SEQ ID NO: 21657 - DNA, 176 bp, Homo sapiens; identical to SEQ ID NO: 20270
  misc_feature: GYAE6OF02FO0YL.49.53.E09.1.454.CMB.1.raw
  modified_base (173)..(176): a, c, t, g, unknown or other
  misc_feature (173)..(176): n is a, c, g, or t

SEQ ID NO: 21658 - DNA, 658 bp, Homo sapiens
  misc_feature: GYAE6OF02JFJHL.49.53.E09.1.454.CMB.1.raw
  modified_base (267)..(267): a, c, t, g, unknown or other
  misc_feature (267)..(267): n is a, c, g, or t
  modified_base (301)..(301): a, c, t, g, unknown or other
  misc_feature (301)..(301): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattcgaccaaaagcaaatatgcttactggtaccagcagaanccgaggccacggcccctgtcttgatctatttaanaaagtactttgagagggcctcgagggacccctgacgcgtattcctctggcctccgagcctacacgccgaacaaacgtacgtccaacggtttacgaacccaataccgaggtacgggacggttcccggggacagggaacgggaacggagggaccttaggtaaccttacgtttaaccgtcgtaccaacggttccgaattccggaagtacaaggttaacggtacggtccttaaccgtttcttcgggttaccgtttacggttccggggaccgggtaacggggtaaccctaaagggtcccgtacggtaccccgttaccgtacgggttaccgaaccggaccccgtaagggtcccctaccccggg

SEQ ID NO: 21659 - DNA, 173 bp, Homo sapiens
  misc_feature: GYAE6OF02FH1S3.49.53.E09.1.454.CMB.1.raw
  modified_base (172)..(173): a, c, t, g, unknown or other
  misc_feature (172)..(173): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcggctggcaaggcgcatagnn

SEQ ID NO: 21660 - DNA, 174 bp, Homo sapiens; identical to SEQ ID NO: 20265
  misc_feature: GYAE6OF02FGVBN.49.53.E09.1.454.CMB.1.raw
  modified_base (173)..(174): a, c, t, g, unknown or other
  misc_feature (173)..(174): n is a, c, g, or t

SEQ ID NO: 21661 - DNA, 174 bp, Homo sapiens; identical to SEQ ID NO: 20265
  misc_feature: GYAE6OF02I8ID3.49.53.E09.1.454.CMB.1.raw
  modified_base (173)..(174): a, c, t, g, unknown or other
  misc_feature (173)..(174): n is a, c, g, or t

SEQ ID NO: 21662 - DNA, 171 bp, Homo sapiens
  misc_feature: GYAE6OF02FF7CW.49.53.E09.1.454.CMB.1.raw
  modified_base (166)..(166): a, c, t, g, unknown or other
  misc_feature (166)..(166): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcggctggcaaggcncatag

SEQ ID NO: 21663 - DNA, 528 bp, Homo sapiens
  misc_feature: GYAE6OF02HCXBT.49.53.E09.1.454.CMB.1.raw
  modified_base (398)..(398): a, c, t, g, unknown or other
  misc_feature (398)..(398): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaccagcagaagccaggccacggccctgtctgatcatttataaagtactttgagaggcctacgacgggacccctggagcgtattctcgtcggctccagctcagcgaacaaacagtacacgttgaccatcaggtggagtccggganaggaggacgaggctagtactattactgtcagtcatcagacagtagtgctacttcgtgtcgtacgttcgggaggtaacggaccaaggtctacgaccgtccgtaggtaccacgacccgacggtcctacccgg

SEQ ID NO: 21664 - DNA, 684 bp, Homo sapiens
  misc_feature: GYAE6OF02I39PX.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtcgtcctcgaggacagacggccagtactcactgctctggagatgcattgaccaaagcaatatgtacttacgtgtaccagcaagaagcgagccacggccctgtctgatctatttaataagtactttagaggacggaccgttaccgaacgggtaccccgtagacgacgtaactttccgtcgttacggccgttaccgacgtccttacgtaccgaccggaaaccaaaccgtaacgtaccgtaaccgtttacggaaaccctacgtacgtacgggttagggaaccggttcccggggaaccaaggggaacggaacggtacggtacgtaacgtacttaactttacggtatcgaacggtctaacgtaccgaagaaccgttagggtaacgtcggtaccttacgtttacgttacgttaccggttacgttcgggaaccggggtacggtaaccggacggtcgtaccgtaccggtaccgttacggtaccgaccgtacccggaggtcccgtacccgg

SEQ ID NO: 21665 - DNA, 524 bp, Homo sapiens
  misc_feature: GYAE6OF02G6Y60.49.53.E09.1.454.CMB.1.raw
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (421)..(421): a, c, t, g, unknown or other
  misc_feature (421)..(421): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaccagcagaanccaggccaggcccctgtcttgatcatttanaaagtactttgagaggcctagacgggacccctgagcgattcncgtggctccagctcagcacaacngtacacgttgaccatcaggtggacggtccgggacaggaggacgaggctggacttagttacngtacagtcatacgagactagtagtcggctacgttctgtcgtagttcgggaggtacgggaccagctacggacccgtctaggtccacgacccgtaggcctcccgg

SEQ ID NO: 21666 - DNA, 171 bp, Homo sapiens
  misc_feature: GYAE6OF02HM5Z5.49.53.E09.1.454.CMB.1.raw
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcactctgagcgggctggcaaggcgcatag

SEQ ID NO: 21667 - DNA, 175 bp, Homo sapiens; identical to SEQ ID NO: 20418
  misc_feature: GYAE6OF02IAWJU.49.53.E09.1.454.CMB.1.raw
  modified_base (173)..(175): a, c, t, g, unknown or other
  misc_feature (173)..(175): n is a, c, g, or t

SEQ ID NO: 21668 - DNA, 175 bp, Homo sapiens
  misc_feature: GYAE6OF02HJWBJ.49.53.E09.1.454.CMB.1.raw
  modified_base (174)..(175): a, c, t, g, unknown or other
  misc_feature (174)..(175): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctctctcgactctgagcgggctggcaaggcgcatagnn

SEQ ID NO: 21669 - DNA, 187 bp, Homo sapiens
  misc_feature: GYAE6OF02F8IG2.49.53.E09.1.454.CMB.1.raw
  modified_base (175)..(187): a, c, t, g, unknown or other
  misc_feature (175)..(187): n is a, c, g, or t
tcagagtcgagagacacgaccggtgctcgatttagagagagtgtgttgggtttggggggaagaggaagactgacggtcccccaggagttcaggtgctgggcacagcggccctgggctgccctggtcaaggactacttcctctctcgactctgagcgggctggcaaggcgcatagnnnnnnnnnnnnn

SEQ ID NO: 21670 - DNA, 173 bp, Homo sapiens; identical to SEQ ID NO: 20229
  misc_feature: GYAE6OF02GIR9A.49.53.E09.1.454.CMB.1.raw
  modified_base (173)..(173): a, c, t, g, unknown or other
  misc_feature (173)..(173): n is a, c, g, or t

SEQ ID NO: 21671 - DNA, 547 bp, Homo sapiens
  misc_feature: GYAE6OF02JCJRI.49.53.E09.1.454.CMB.1.raw
  modified_base (394)..(394): a, c, t, g, unknown or other
  misc_feature (394)..(394): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaccagcagaagccaggccaggcccctgtcttgatctatttataaagtactttgagagggcctcacgggacccctggagcgattctctggctccagctcagcgacaacagtcacgttcgaccatcagtgggacgtccgggnaggaggacgaggctgactattacgtgtcagtcatcagacagtagtgtactacttacgtcgttacgttagttccgggacgggaacgggtaaccgaaggtccgttagaccccggttcctacgggtacctacggacccgacgggtcctaccccggg

SEQ ID NO: 21672 - DNA, 719 bp, Homo sapiens
  misc_feature: GYAE6OF02I7955.49.53.E09.1.454.CMB.1.raw
  modified_base (296)..(296): a, c, t, g, unknown or other
  misc_feature (296)..(296): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcgaggacagacggccagtatcacctgctctggagatgctattgccaaaagcaatatgcttactggtaccagcagaagccaggccaggcccctgtcttgatcatttanaaagtctttgagacgggtcctcgacgggacccctggacgacgtacttctcgtaggtcctaccagctacgagccgtaaccaacgtacggttccaaccgtttcgaaccctacgtacgaacggttgggaacggttcccggggacacgggacgggaaccggtaacgggtccgttacggaaccgtttaacgtttaacttacgggttaccaacgggttaccgaaaccttaccgtaaaggaacccgtaagggttaacgggttacgggtcctttaaacccgttttccgttacggtttaccggttaaggttttcccggggacggggtaaccggggtaaacccgtaagggtacccgttacgggtaaccccggtttaccggtaaccgggttacccgaaggtaacccccggtaacgggtcccggttacccccggg

SEQ ID NO: 21673 - DNA, 174 bp, Homo sapiens; identical to SEQ ID NO: 20630
  misc_feature: GYAE6OF02HGRP2.49.53.E09.1.454.CMB.1.raw
  modified_base (173)..(174): a, c, t, g, unknown or other
  misc_feature (173)..(174): n is a, c, g, or t

SEQ ID NO: 21674 - DNA, 544 bp, Homo sapiens
  misc_feature: GYAE6OF02FWXAO.49.53.E09.1.454.CMB.1.raw
  modified_base (345)..(345): a, c, t, g, unknown or other
  misc_feature (345)..(345): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcgacgggacccctgagcgattctctgctccngctcagcgacaacagtcacgttgaccatcaggtggagtccgggcaggaggacggaggctagacttattacgtgtacagtcatacgtacgactagtagtggtacctacgttcgtgttcgttacgttcgggacgggtacgggaccaacggtccgttaggacccgttaccgtacggtccacggacccgaggccgtaccccgg

SEQ ID NO: 21675 - DNA, 178 bp, Homo sapiens
  misc_feature: GYAE6OF02FE3RW.49.53.E09.1.454.CMB.1.raw
  modified_base (172)..(178): a, c, t, g, unknown or other
  misc_feature (172)..(178): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggctacttcctctctcgactctgagcgggctggcaaggcgcatagnnnnnnn

SEQ ID NO: 21676 - DNA, 174 bp, Homo sapiens; identical to SEQ ID NO: 20265
  misc_feature: GYAE6OF02F7LEB.49.53.E09.1.454.CMB.1.raw
  modified_base (173)..(174): a, c, t, g, unknown or other
  misc_feature (173)..(174): n is a, c, g, or t

SEQ ID NO: 21677 - DNA, 174 bp, Homo sapiens; identical to SEQ ID NO: 20265
  misc_feature: GYAE6OF02GE417.49.53.E09.1.454.CMB.1.raw
  modified_base (173)..(174): a, c, t, g, unknown or other
  misc_feature (173)..(174): n is a, c, g, or t

SEQ ID NO: 21678 - DNA, 175 bp, Homo sapiens
  misc_feature: GYAE6OF02JH0C2.49.53.E09.1.454.CMB.1.raw
  modified_base (174)..(175): a, c, t, g, unknown or other
  misc_feature (174)..(175): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnn

SEQ ID NO: 21679 - DNA, 529 bp, Homo sapiens
  misc_feature: GYAE6OF02ITC4N.49.53.E09.1.454.CMB.1.raw
  modified_base (222)..(222): a, c, t, g, unknown or other
  misc_feature (222)..(222): n is a, c, g, or t
  modified_base (396)..(396): a, c, t, g, unknown or other
  misc_feature (396)..(396): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctgganatgcattgccaaagcaatatgcttactggtaccagcagaagccaggccaggcccctgtcttgatcatttataaagactttgagagggccctgacgggacccctgagcgtattctactggccttccagctcagcgacaacagtcaacgttcgacctagtcagtggacgtccgggnagaggacgaggctagacttattactgtacagtcatacagacagtagtcgctacttctgttcgtagttcggacgggacgggtaaccaagcgtagaccgttccgtaggtccgaacgcccgaaggtcctaccccgg

SEQ ID NO: 21680 - DNA, 174 bp, Homo sapiens; identical to SEQ ID NO: 20265
  misc_feature: GYAE6OF02HWY4G.49.53.E09.1.454.CMB.1.raw
  modified_base (173)..(174): a, c, t, g, unknown or other
  misc_feature (173)..(174): n is a, c, g, or t

SEQ ID NO: 21681 - DNA, 175 bp, Homo sapiens; identical to SEQ ID NO: 20418
  misc_feature: GYAE6OF02G4XIA.49.53.E09.1.454.CMB.1.raw
  modified_base (173)..(175): a, c, t, g, unknown or other
  misc_feature (173)..(175): n is a, c, g, or t

SEQ ID NO: 21682 - DNA, 176 bp, Homo sapiens
  misc_feature: GYAE6OF02FR4FR.49.53.E09.1.454.CMB.1.raw
  modified_base (175)..(176): a, c, t, g, unknown or other
  misc_feature (175)..(176): n is a, c, g, or t
tcagagtcgagagacacgaccggtgctcgatttagagagagtgtgttggatttggggggaagaggaagactgacggtccccccaggagttcaggtgctgggcacagcggccctgggctgcctggtcaaggactacttcctcgtagcactctgagcgggctggcaaggcgcatagnn

SEQ ID NO: 21683 - DNA, 173 bp, Homo sapiens; identical to SEQ ID NO: 20337
  misc_feature: GYAE6OF02GQ74A.49.53.E09.1.454.CMB.1.raw
  modified_base (173)..(173): a, c, t, g, unknown or other
  misc_feature (173)..(173): n is a, c, g, or t

SEQ ID NO: 21684 - DNA, 173 bp, Homo sapiens; identical to SEQ ID NO: 20229
  misc_feature: GYAE6OF02G45IP.49.53.E09.1.454.CMB.1.raw
  modified_base (173)..(173): a, c, t, g, unknown or other
  misc_feature (173)..(173): n is a, c, g, or t

SEQ ID NO: 21685 - DNA, 177 bp, Homo sapiens
  misc_feature: GYAE6OF02GYV7G.49.53.E09.1.454.CMB.1.raw
  modified_base (174)..(177): a, c, t, g, unknown or other
  misc_feature (174)..(177): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnn

SEQ ID NO: 21686 - DNA, 667 bp, Homo sapiens
  misc_feature: GYAE6OF02F815I.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagagccagccacggccctgtcttgatctatttataaagtactttgagacggcctcgacgggacccctgacgcgtattctcgtggctcagctcgacgcgaacaacgtacgtaccgtacgttcgaacctaattccgaagggttacgggtacgggttacccggggacgaaacgggaacggggaaccgggaacgggtccgttaacggtaaaccgtttaacgtttaaccggttcgttaccgtaacggttcccggacgtaacggaaccgacggacgtagggtcggaccgtaggttttagtacggttacggttacggttccggggacgggtaacggggaccttaccgggccgttacggtacccggttaccgttacgggtaccgaaccggaccccggtaagggcccttacccccggg

SEQ ID NO: 21687 - DNA, 175 bp, Homo sapiens; identical to SEQ ID NO: 20458
  misc_feature: GYAE6OF02H7NJM.49.53.E09.1.454.CMB.1.raw
  modified_base (173)..(175): a, c, t, g, unknown or other
  misc_feature (173)..(175): n is a, c, g, or t

SEQ ID NO: 21688 - DNA, 203 bp, Homo sapiens
  misc_feature: GYAE6OF02IRA4B.49.53.E09.1.454.CMB.1.raw
  modified_base (178)..(203): a, c, t, g, unknown or other
  misc_feature (178)..(203): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctctctcgtactctgagcgggcttggcaaggcgctaatagnnnnnnnnnnnnnnnnnnnnnnnnnn

SEQ ID NO: 21689 - DNA, 174 bp, Homo sapiens; identical to SEQ ID NO: 20630
  misc_feature: GYAE6OF02I01EL.49.53.E09.1.454.CMB.1.raw
  modified_base (173)..(174): a, c, t, g, unknown or other
  misc_feature (173)..(174): n is a, c, g, or t

SEQ ID NO: 21690 - DNA, 198 bp, Homo sapiens
  misc_feature: GYAE6OF02JAUVD.49.53.E09.1.454.CMB.1.raw
  modified_base (175)..(198): a, c, t, g, unknown or other
  misc_feature (175)..(198): n is a, c, g, or t
tcagagtcgagagacacgaccggtgctcgatttagagagagtgtgttgggtttgggggaaggaggaagactgacggtccccccaggacgttcaggtgctgggcacagcggcctggctgcctggtcaaggactacttcctctctcgactctgagcgggctggcaaggcgcatagcnnnnnnnnnnnnnnnnnnnnnnnn

SEQ ID NO: 21691 - DNA, 174 bp, Homo sapiens; identical to SEQ ID NO: 20265
  misc_feature: GYAE6OF02FI8CC.49.53.E09.1.454.CMB.1.raw
  modified_base (173)..(174): a, c, t, g, unknown or other
  misc_feature (173)..(174): n is a, c, g, or t

SEQ ID NO: 21692 - DNA, 619 bp, Homo sapiens
  misc_feature: GYAE6OF02JNFF8.49.53.E09.1.454.CMB.1.raw
  modified_base (190)..(190): a, c, t, g, unknown or other
  misc_feature (190)..(190): n is a, c, g, or t
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
tcagagtcgagagacacgaccggtgctcgatttagagagagtgtgttgggtttgggggtgggtccgaggaggcagaactctgggtgtctcaccatggcctggatccctctacttctcccctcctcactctctgcacagactctgaggcctcctatgagctgacacagccaccctcggtgtctgtgtcctnaggacagacggccagtatcacctgctctggagatgcattcgaccaaagcaatntgcttactggtaccagcagaanccaggccaggcccctgtactgatcgatttanaaagtacttgagagggtctcgacgggtacccctgagtcgacgttcaccgttggcctcaacggcttcgaacgtccgaacaaactcggtacaacggtttcaaccacgtcaaggtggacggtccggacgtaaggacgggtacggaacggtcgtagtaaccgttacgtttaacgtgttaccaggttacacgttacgagtaaacgtaggttaaggtccggtaactacgtttaccgtgttccgttagttccgggacgggtacggaacctaaggtccgtcggacccgtaccgtacgggtccaccgggtaacccgaggtccctaccccggg

SEQ ID NO: 21693 - DNA, 173 bp, Homo sapiens; identical to SEQ ID NO: 20229
  misc_feature: GYAE6OF02HXH4V.49.53.E09.1.454.CMB.1.raw
  modified_base (173)..(173): a, c, t, g, unknown or other
  misc_feature (173)..(173): n is a, c, g, or t

SEQ ID NO: 21694 - DNA, 173 bp, Homo sapiens; identical to SEQ ID NO: 20229
  misc_feature: GYAE6OF02IZ9MF.49.53.E09.1.454.CMB.1.raw
  modified_base (173)..(173): a, c, t, g, unknown or other
  misc_feature (173)..(173): n is a, c, g, or t

SEQ ID NO: 21695 - DNA, 203 bp, Homo sapiens
  misc_feature: GYAE6OF02G2GO5.49.53.E09.1.454.CMB.1.raw
  modified_base (176)..(203): a, c, t, g, unknown or other
  misc_feature (176)..(203): n is a, c, g, or t
tcagagtcgagagacacgaccggtgctcgatttagagagagtgtggttggggtttgggggaagaggaagactgacggtccccccaggagttcaggtgctgggccacagcggccctgggctgcctggtcaaggctacttcctctctcgactctgagcgggctggcaaggcgcatagnnnnnnnnnnnnnnnnnnnnnnnnnnnn

SEQ ID NO: 21696 - DNA, 610 bp, Homo sapiens
  misc_feature: GYAE6OF02JZ4WL.49.53.E09.1.454.CMB.1.raw
  modified_base (178)..(178): a, c, t, g, unknown or other
  misc_feature (178)..(178): n is a, c, g, or t
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
tcagagtcgagagacacgaccggtgctcgatttagagagagtgtgttgggtttgggggtgggtccaggaggcagaactctgggtgtctcaccatggcctggatccctctacttctccccctctcactctctgcacagactctgaggcctcctatgagctgacacagcccaccctggtntctgtgtccctcagggaccaggtaccggccagtatccaccctgctactggaagntgccattcgcccaaaggccaaatntgcttactggtaccagccaggaacgcccaggcccacggcccctgtctttgattcagtttaacaacgtacttagacgacgggtccctcgacgggtacccccttgacggcgtacttccgtccgttcgggccttacccgacggtcctccgacggcccggaaccaacccgtaggtcccaccgtttacggacccactccgacgtcggtacgttcccgggccacggacggtaccgaggccttcgaccttactcctacgtcacgtcgactcgacgacagtagtcggccacgttctcgtcgttacgttcggcggacgggaaccacgcgtcgaccgtccacggtcacgtcccgacgctcccgg

SEQ ID NO: 21697 - DNA, 192 bp, Homo sapiens
  misc_feature: GYAE6OF02FHF1X.49.53.E09.1.454.CMB.1.raw
  modified_base (166)..(166): a, c, t, g, unknown or other
  misc_feature (166)..(166): n is a, c, g, or t
  modified_base (172)..(192): a, c, t, g, unknown or other
  misc_feature (172)..(192): n is a, c, g, or t
tcagagtcgagagacacgaccggtgctcgatttagagagagtgtgttgggtttgggggaagaggaagactgaccggtccccccaggagttcaggtgctgggcacagcgccctgggctgcctggtcaaggtctactcctctctcgactctgagcggctggcaaggcncatagnnnnnnnnnnnnnnnnnnnnn

SEQ ID NO: 21698 - DNA, 174 bp, Homo sapiens; identical to SEQ ID NO: 20265
  misc_feature: GYAE6OF02HTP6F.49.53.E09.1.454.CMB.1.raw
  modified_base (173)..(174): a, c, t, g, unknown or other
  misc_feature (173)..(174): n is a, c, g, or t

SEQ ID NO: 21699 - DNA, 543 bp, Homo sapiens
  misc_feature: GYAE6OF02ION04.49.53.E09.1.454.CMB.1.raw
  modified_base (361)..(361): a, c, t, g, unknown or other
  misc_feature (361)..(361): n is a, c, g, or t
tcagagtcgagagacacgaccggtgctcgatttagagagagtgtgttggggttttgggggtgggtccaggaggcagaactctgggtgtctcaccgatggcctggatccctctacttctcccctcctcactctctgcacagactctgaggcctcctatgagctgacacagccacctcggtgtctgtgtcctcaggacagacggccagtatcacctgctctggagatgcattgaccaaagcaatatgcttactgtaccagcagacgcagcacggccctgtcttgatctatttataaagtactttgagacggacctcgacgggtacccctggagcgattctcgtggctcagctcagcgacaacngtacacgtgacctatcgagtaggacgtccgggactaggaggacgtaggtctacgaacttagttactcgtacgacgttcacgtcgacgtacgtagtagtacgtctacttcgtagttcgtacttcgggcggaacgggaccagtcgtacgtaccgtcgtacggtccacggacccaggctccccgg

SEQ ID NO: 21700 - DNA, 177 bp, Homo sapiens; identical to SEQ ID NO: 20482
  misc_feature: GYAE6OF02HR2FJ.49.53.E09.1.454.CMB.1.raw
  modified_base (173)..(177): a, c, t, g, unknown or other
  misc_feature (173)..(177): n is a, c, g, or t

SEQ ID NO: 21701 - DNA, 173 bp, Homo sapiens; identical to SEQ ID NO: 20337
  misc_feature: GYAE6OF02IXSE5.49.53.E09.1.454.CMB.1.raw
  modified_base (173)..(173): a, c, t, g, unknown or other
  misc_feature (173)..(173): n is a, c, g, or t

SEQ ID NO: 21702 - DNA, 613 bp, Homo sapiens
  misc_feature: GYAE6OF02JQNUE.49.53.E09.1.454.CMB.1.raw
  modified_base (220)..(220): a, c, t, g, unknown or other
  misc_feature (220)..(220): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcactgctctgganatcgctattcgaccaaaagtcaaattatgcttaactggtaccagacagaacgcacggccgaggcccctgtacttgactctaatttaactaaagtacgtttagaggtaacgggccttacgacgggtacccctaggacgtacggtactttccgtcgtcggtcctaccgaacgtctacgaacgaccgaacgaaaccgtagtaccgtacgttcgaacctagtctacgggtacggacggttcgggacaagggacgggacgacggtcgtacgtacttacgttacgtgtacacgtctagtacacgtactagtcgtacgctacgttctacgtcgtagttcggacggacgaaccgtagaccgtcggtacctacgttcgaccgaggtacccaggtcccgtccg

SEQ ID NO: 21703 - DNA, 199 bp, Homo sapiens
  misc_feature: GYAE6OF02FLBR3.49.53.E09.1.454.CMB.1.raw
  modified_base (175)..(199): a, c, t, g, unknown or other
  misc_feature (175)..(199): n is a, c, g, or t
tcagagtcgagagacacgaccggtgctcgatttagagagagtgtgttggggtttgtggggaagaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnnnnnn

SEQ ID NO: 21704 - DNA, 489 bp, Homo sapiens
  misc_feature: GYAE6OF02G5H0O.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtgagtccggcagaggacgaggctgactattactgtcagtcatcagacagtagtgcacttctgtcgtagttcggcggagggaccaagctagaccgtctaggtcacgccaggctccgg

SEQ ID NO: 21705 - DNA, 707 bp, Homo sapiens
  misc_feature: GYAE6OF02I17P9.49.53.E09.1.454.CMB.1.raw
  modified_base (455)..(455): a, c, t, g, unknown or other
  misc_feature (455)..(455): n is a, c, g, or t
tcagagtcgagagacacgaccggtgctcgatttagagagagtgtgttgggtttgggggtgggtccaggaggcagaactctgggtgtctcaccatggcctggatccctctacttctcccccctcctcactctctgcacagactctgaggcctcctatgagctgacacagccaccctcggtgtctgtgtcctcaggacagacggccagtactcacctgctctggagatgcattgaccaaagcaatatgcttactggtaaccagcaagacgccgaggccacggcccctgtcttgatactatttaataaagtactttgaaggtagggtccctacgacgggtaccccctaggacgccgtattccgtcgtcggcctccgacgctacgaacggccgaaccaaacgacgtccgtaacggttacgacccgaagttaccgagggtcggtacgggtcccggggaanacgggaaggggaaccgacgggtccgttaaggtaacctttacgtttaaccgtcgttacgtacggtacctaagttaccgtaagtaaccgtaaggttagggttacgtaccgttacccgttttcgtaggtttaccggtttacgttccgggggaccgggtaacggggaacccgttaacggtcgttaccgggtaccccggtaccgttaacggggttacccgtaaccggaccccggttaacggtcccgtaccccccggg

SEQ ID NO: 21706 - DNA, 175 bp, Homo sapiens; identical to SEQ ID NO: 20418
  misc_feature: GYAE6OF02H9T5S.49.53.E09.1.454.CMB.1.raw
  modified_base (173)..(175): a, c, t, g, unknown or other
  misc_feature (173)..(175): n is a, c, g, or t

SEQ ID NO: 21707 - DNA, 176 bp, Homo sapiens; identical to SEQ ID NO: 20270
  misc_feature: GYAE6OF02FRH4I.49.53.E09.1.454.CMB.1.raw
  modified_base (173)..(176): a, c, t, g, unknown or other
  misc_feature (173)..(176): n is a, c, g, or t

SEQ ID NO: 21708 - DNA, 175 bp, Homo sapiens; identical to SEQ ID NO: 21613
  misc_feature: GYAE6OF02J1M4V.49.53.E09.1.454.CMB.1.raw
  modified_base (172)..(175): a, c, t, g, unknown or other
  misc_feature (172)..(175): n is a, c, g, or t

SEQ ID NO: 21709 - DNA, 734 bp, Homo sapiens
  misc_feature: GYAE6OF02J28YI.49.53.E09.1.454.CMB.1.raw
tcagagtcgagagacacgaccggtgctcgatttagagagagtgtgttgggtttgggggtgggtccaggaggcagaactctgggtgtctcaccatggcctggatcctctacttcctcccctcctcactctctgcacagactctgaggcctcctatgagctgacacacgccaccctcggtgtctgtgtcctcacggacacggacggccagtactccacctgctcgtggagatgcattcgaccaaagcaatatcgtaccttactcggtacagacaacgaacgccgacggccacggccccttgtcctgacttactaatttaagtaaagtactttaggacggaccgggtcctacgaccgggtaccccgtgacgtaccgtacttcgtcgtcggccttcacggtcctacgacgaccgaacaactacgtacgtacgttacactacgacggtacggtacggtaccgggtaccggacggaacgggtaaccgggacggtacggggtaccttaacggttaaccgttaacgttaccgttacgtacgtaccgttacgtacgttaccgaacgtaccggttaaggtcggttaacgaccgtttaccgtttaggtaccgtttacggttacggttcccgggggtaccgggaaccgggtaaccgaccgtaaccggttacccggtaaccccggtttacggttacccgggaaccgtacccggtaacccgggtaccggtccccggttaccccccggg

SEQ ID NO: 21710 - DNA, 647 bp, Homo sapiens
  misc_feature: GYAE6OF02H4MLN.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgaccaaagcaatatgtcttactggtaccagcagaagcaggcaggccctgtctgatctaattataaagactttgaagaggcctcgacgggacccctggacgcgattctcgtcggctcagctacgagacgaacaacacgtacgtaacgttcgaacctacgtacagggtaggtacggtccgggacgaagggaaacgggacgggaacgggtacgtacggtaacttaacgtttaacgttcgtacgtaacgtcgtaagtactaacggaaccgtaaggtaaggttcggacgttacgttacttcgggttacgttacggtttccggggaccgggtaacgggtaacccgtaaaggtcccggttaacggtacccggtttaccgtaacgggttacctaaccgggtacccggtaacggccgttacccccggg

SEQ ID NO: 21711 - DNA, 649 bp, Homo sapiens
  misc_feature: GYAE6OF02F4L5M.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaccagcagaagccaggccacggcccctgtcttgatctatttaataaagtactttgaggaggcctcgacgggacccctgagcgtattctcgtgctccagctcacgcgaacaacacgtacacgttacgaccatactaggtacgggacggtcccgggcgaacgggacgggaccggacgggcgttacgaacttaacgttaccgttgtaccgtacgttacaacgtacgaagtaacgtaaggttgttacgggtactacgtttcgtggttaccgtttaggtttaccggggacggggtaaccgggtaacccgtaaacggtccggttaccggttaaccccggttaccggttaacgggttacccgaaccgggtaaccccgtaacggggtcccccgttaccccggg

SEQ ID NO: 21712 - DNA, 574 bp, Homo sapiens
  misc_feature: GYAE6OF02IWINK.49.53.E09.1.454.CMB.1.raw
  modified_base (177)..(177): a, c, t, g, unknown or other
  misc_feature (177)..(177): n is a, c, g, or t
  modified_base (249)..(249): a, c, t, g, unknown or other
  misc_feature (249)..(249): n is a, c, g, or t
  modified_base (360)..(360): a, c, t, g, unknown or other
  misc_feature (360)..(360): n is a, c, g, or t
  modified_base (421)..(421): a, c, t, g, unknown or other
  misc_feature (421)..(421): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctctatgagctgacacagccaccctggtntctgtcgtcctcgaggacaggaccggccagtactcacctgctcgtggagatgctattcgaccaaaagcaatntgtcttactggtaccagacagaagccgaggccacggcccctgtcttgatctatttaataaagtactttggagacgggccctacgacgggtacccctggacgcgtatttccncgtggcctccagctcagcgacaacagtctacgttcgaccatcgaggtcggacggtccgganaggaggacgaggctagtactacttacgtcgtcagtacatcaagacaggtagtcggctacttcgtgtacgttagttccgggacgggtaacggaacctaacggtctacggtacccgtacgtacggtccaccggtacccgaaggtccctaccccgg

SEQ ID NO: 21713 - DNA, 177 bp, Homo sapiens; identical to SEQ ID NO: 20482
  misc_feature: GYAE6OF02GSJFV.49.53.E09.1.454.CMB.1.raw
  modified_base (173)..(177): a, c, t, g, unknown or other
  misc_feature (173)..(177): n is a, c, g, or t

SEQ ID NO: 21714 - DNA, 620 bp, Homo sapiens
  misc_feature: GYAE6OF02I8GGZ.49.53.E09.1.454.CMB.1.raw
  modified_base (408)..(408): a, c, t, g, unknown or other
  misc_feature (408)..(408): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggccctcctatgagctgacacagccaccctcggtgtctgtgtcctcaggacagacggccagtatcacctgctcgtggagatgcattcgccaaaagcaatatgcttactggtaccagcaagaagccaggccaggccctgtctgatcattataagactttgagacgggcctcgacggacccctgacgcgattctacgtcggcctcgagctcagccgacaaacacgtcacgtttgaccagttaccgaggttggaggttcccggganagggacggacggaggtccgtaggacttacgtttctacggtacagttaccgattacgaacgaagtacggtaaggttcgggacctaactttcgtacggtttaccggttacgttccggggtaccgggtaacggggtaaccccaaagggtccgttacggaccccgttacggtacggttccggaacgtacccccggtaagggtcccttacccccggg

SEQ ID NO: 21715 - DNA, 176 bp, Homo sapiens; identical to SEQ ID NO: 21620
  misc_feature: GYAE6OF02FQJON.49.53.E09.1.454.CMB.1.raw
  modified_base (174)..(176): a, c, t, g, unknown or other
  misc_feature (174)..(176): n is a, c, g, or t

SEQ ID NO: 21716 - DNA, 188 bp, Homo sapiens
  misc_feature: GYAE6OF02GYJAG.49.53.E09.1.454.CMB.1.raw
  modified_base (175)..(188): a, c, t, g, unknown or other
  misc_feature (175)..(188): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctcgtagctactctgagcgggctggcaaggcgcatagnnnnnnnnnnnnnn

SEQ ID NO: 21717 - DNA, 775 bp, Homo sapiens
  misc_feature: GYAE6OF02H03OE.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctcccctcctcactctctgcacagactctgaggcctcctatgagctgacacacgccctacccttcggtgtctgtgtcctcgaggacagaccggccagtactcacctgctcgtggagatgcattcgaaccaaagcaattagtcgtacttacgtacggtaaccacgacgaaggaacgccgaacggtcccaacgggtccccttgtctttagacttactaattttaataaacggtactttaggaggacggtcctacggaccgggaccctagaacgcgttacttaccgtcgtcggacctcctacgtcctacgacgtaccaacaacgtacgtaccgtaccgtttacgacctacgtacgtaacgggtagggaccgggtaccgggacgaacgggtaacgggaaccggagggtaccgttaacggtaaccgtttaacgtttaccgttacgttacgtaaccgttacttaacgtaaccgaacgtaacggtaaggttacggtacggtacccgttaacgtttaccggttcgttacggtttaccgggttaccggggtaccggggtaaacggtaacccggtaaacggtccggttaacccggttaacccggttacccggttacggtaacccggtaacccgggtaaccccggtaaccgggttcccgttaacccccgggg

SEQ ID NO: 21718 - DNA, 173 bp, Homo sapiens; identical to SEQ ID NO: 20229
  misc_feature: GYAE6OF02HXGWZ.49.53.E09.1.454.CMB.1.raw
  modified_base (173)..(173): a, c, t, g, unknown or other
  misc_feature (173)..(173): n is a, c, g, or t

SEQ ID NO: 21719 - DNA, 176 bp, Homo sapiens; identical to SEQ ID NO: 20270
  misc_feature: GYAE6OF02FM8I4.49.53.E09.1.454.CMB.1.raw
  modified_base (173)..(176): a, c, t, g, unknown or other
  misc_feature (173)..(176): n is a, c, g, or t

SEQ ID NO: 21720 - DNA, 191 bp, Homo sapiens
  misc_feature: GYAE6OF02GQV9T.49.53.E09.1.454.CMB.1.raw
  modified_base (174)..(191): a, c, t, g, unknown or other
  misc_feature (174)..(191): n is a, c, g, or t
tcagagtcgagagacacgaccggtgctcgatttagagagagtgtgttgggtttgggggaaggaggaagactgacggtcccccaggagttcaggtgctgggcacagcggccctgggctgcctggtcaaggactacttcctctctcgactctgagcgggctggcaaggcgcatagnnnnnnnnnnnnnnnnnn

SEQ ID NO: 21721 - DNA, 529 bp, Homo sapiens
  misc_feature: GYAE6OF02G0Y0J.49.53.E09.1.454.CMB.1.raw
  modified_base (293)..(293): a, c, t, g, unknown or other
  misc_feature (293)..(293): n is a, c, g, or t
tcagagtcgagagacacgaccggtgctcgatttagagagagtgtgttggatttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagccaggccaggccctgtcttgatcatttanaaagtactttgagagggcctcgacgggacccctgacgcgattctctggctcagctcagcgacaacagtcacgttgaccatcagtggagtccgggcaggaaggacggaggcgtagacttattacgtgtctagtcactcgagactaggtacgtggctacgttctgtcgttagttcgggcgggtacgggaccgaacgtcgtacggtaccgttccgtaggtaccacggacccaggtcccg

SEQ ID NO: 21722 - DNA, 175 bp, Homo sapiens; identical to SEQ ID NO: 20418
  misc_feature: GYAE6OF02I4VZK.49.53.E09.1.454.CMB.1.raw
  modified_base (173)..(175): a, c, t, g, unknown or other
  misc_feature (173)..(175): n is a, c, g, or t

SEQ ID NO: 21723 - DNA, 175 bp, Homo sapiens
  misc_feature: GYAE6OF02GW39T.49.53.E09.1.454.CMB.1.raw
  modified_base (173)..(175): a, c, t, g, unknown or other
  misc_feature (173)..(175): n is a, c, g, or t
tcagagtcgagagacacgaccggtgctcgatttagagagagtgtgttgggtttgtggggaagaggaagactgacggtcccccaggagttcaggtgctgggcacagcggccctgggctgcctggtcaagactacttcctcgtagcactctgagcgggctggcaaggcgcatagnnn

SEQ ID NO: 21724 - DNA, 172 bp, Homo sapiens
  misc_feature: GYAE6OF02HQJI2.49.53.E09.1.454.CMB.1.raw
  modified_base (172)..(172): a, c, t, g, unknown or other
  misc_feature (172)..(172): n is a, c, g, or t
tcagagtcgagagacacgaccggtgctcgatttagagagagtgtgttgggtttgggggaagaggaagactgacggtcccccaggagttcaggtgctgggcacagcggcctgggctgcctggtcaaggactacttcctcgtagcactctgagcgggctggcaaggcgcatagn

SEQ ID NO: 21725 - DNA, 683 bp, Homo sapiens
  misc_feature: GYAE6OF02G8PCW.49.53.E09.1.454.CMB.1.raw
  modified_base (188)..(188): a, c, t, g, unknown or other
  misc_feature (188)..(188): n is a, c, g, or t
  modified_base (220)..(220): a, c, t, g, unknown or other
  misc_feature (220)..(220): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctggtgtctgtgtcctnaggacagacggccagtatcacctgctctgganatgcattcgaccaaaagctaaatatgtcctttacgtggtaaccagcaaggaacgccaggccacggcccctgtcttgacttctaatttaataaagtactttagaggtacgggtcctacgacgggacccctggacgtccgtactttcgtcgtcggcctccgacgtcgtcgaacggtccgtaaacaaacgtacgtacctaaccggtttacgaacctaagtaccgtaagggtcgggacgggtcccggggacaacggggacggaacgggaggtaccgttaggtaaccttaacgttacgttgttacgtaacgttcaacgttaccggaagtaaccgtaagggtacgtacgggtacttaccgtttcgttacgttacggttacggttcgggtacgggaacggtaccggaacgtcgttaacggtaccgtaccggttacggtccgaaccggacccggtacggcccgttccccgg

SEQ ID NO: 21726 - DNA, 177 bp, Homo sapiens
  misc_feature: GYAE6OF02JAPWM.49.53.E09.1.454.CMB.1.raw
  modified_base (175)..(177): a, c, t, g, unknown or other
  misc_feature (175)..(177): n is a, c, g, or t
tcagagtcgagagacacgaccggtgctcgatttagagagagtgtgttgggtttgggggaagaggaagactgaccggtccccccaggagttcaggtgctgggcacagcggccctgggctgcctggtcaaggactacttcctcgtagcactctgagcgggctggcaaggcgcatagnnn

SEQ ID NO: 21727 - DNA, 173 bp, Homo sapiens; identical to SEQ ID NO: 20229
  misc_feature: GYAE6OF02FMR8Y.49.53.E09.1.454.CMB.1.raw
  modified_base (173)..(173): a, c, t, g, unknown or other
  misc_feature (173)..(173): n is a, c, g, or t

SEQ ID NO: 21728 - DNA, 523 bp, Homo sapiens
  misc_feature: GYAE6OF02F0ZKD.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttaataaagactttgagagggccttcgacgggacccctgacgcgattctctggctccagctcgagcgacaacagtcacgttgaccatcgagtggaggtccgggcaggaggacggaggctgacttagttactgtcagtcatcagacagtgtgctacttctgttcgtagttcgggcgggaacgggaccgaagcctacggacccgtccgtaggtccaccggaccacggctaccccgg

SEQ ID NO: 21729 - DNA, 179 bp, Homo sapiens; identical to SEQ ID NO: 20397
  misc_feature: GYAE6OF02FVGGN.49.53.E09.1.454.CMB.1.raw
  modified_base (173)..(179): a, c, t, g, unknown or other
  misc_feature (173)..(179): n is a, c, g, or t

SEQ ID NO: 21730 - DNA, 175 bp, Homo sapiens
  misc_feature: GYAE6OF02GWEF1.49.53.E09.1.454.CMB.1.raw
  modified_base (173)..(175): a, c, t, g, unknown or other
  misc_feature (173)..(175): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcggctggcaaggcgcatagnnn

SEQ ID NO: 21731 - DNA, 241 bp, Homo sapiens
  misc_feature: GYAE6OF02HRASW.49.53.E09.1.454.CMB.1.raw
  modified_base (179)..(185): a, c, t, g, unknown or other
  misc_feature (179)..(185): n is a, c, g, or t
  modified_base (187)..(241): a, c, t, g, unknown or other
  misc_feature (187)..(241): n is a, c, g, or t
tcagagtcgagagacacgaccggtgctcgatttagagagagtgtggttgggtttggggggggaagaggaaggactgacggtccccccaggagttcgaggtgcctgggcacagcggccctgggctgcctggtcaaggctacttcctcgtagcactctgagcggctggcaaggcgcatagnnnnnnngnnnnnnnnnnnnnnnnnnnnnnnnnnnnnnnnnnnnnnnnnnnnnnnnnnnnnnn

SEQ ID NO: 21732 - DNA, 175 bp, Homo sapiens; identical to SEQ ID NO: 20418
  misc_feature: GYAE6OF02GEJ6P.49.53.E09.1.454.CMB.1.raw
  modified_base (173)..(175): a, c, t, g, unknown or other
  misc_feature (173)..(175): n is a, c, g, or t

SEQ ID NO: 21733 - DNA, 175 bp, Homo sapiens; identical to SEQ ID NO: 20418
  misc_feature: GYAE6OF02G64K8.49.53.E09.1.454.CMB.1.raw
  modified_base (173)..(175): a, c, t, g, unknown or other
  misc_feature (173)..(175): n is a, c, g, or t

SEQ ID NO: 21734 - DNA, 174 bp, Homo sapiens; identical to SEQ ID NO: 20960
  misc_feature: GYAE6OF02JEKM5.49.53.E09.1.454.CMB.1.raw
  modified_base (174)..(174): a, c, t, g, unknown or other
  misc_feature (174)..(174): n is a, c, g, or t

SEQ ID NO: 21735 - DNA, 553 bp, Homo sapiens
  misc_feature: GYAE6OF02JBBCD.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagccaggccaggcccctgtcttgatctatttataaagtactttgagagggcctcgacgggacccctggacgcgacttcctcgtcggcctccgagctcacgcgacaaacagtcacgttcgaacctatacaggtggacggtccgggcaggaggacggaggctagactattacgtgtcagtcatcagacagtagtcggctacgttcgtgttcgtagttcgggacgggacgggtaaccaaggtcctacggtacccgtccgtacggtccaaccggcccgtaacggccttaccccgg

SEQ ID NO: 21736 - DNA, 532 bp, Homo sapiens
  misc_feature: GYAE6OF02HPQF8.49.53.E09.1.454.CMB.1.raw
  modified_base (222)..(222): a, c, t, g, unknown or other
  misc_feature (222)..(222): n is a, c, g, or t
  modified_base (365)..(365): a, c, t, g, unknown or other
  misc_feature (365)..(365): n is a, c, g, or t
  modified_base (398)..(398): a, c, t, g, unknown or other
  misc_feature (398)..(398): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctgganatgcattgaccaaagcaatatgcttactggtaccagcagaagccaggccaggcccctgtctgatctattaataaagtctttagagacggctcgacgggacccctgacgcgattctcgtcggtctccagctacagacgacaacncgtacacgttgaccatcgagtggacgtccgganaggaggacggaggctagactattacgngtcagtcatcgaganagtagcgtctattcgtgttcgtagttcgggacggaacggaccaggtccgtacgtaccgtacgtacggaccaccggacctacggtcctcccgg

SEQ ID NO: 21737 - DNA, 174 bp, Homo sapiens; identical to SEQ ID NO: 20265
  misc_feature: GYAE6OF02I4B8S.49.53.E09.1.454.CMB.1.raw
  modified_base (173)..(174): a, c, t, g, unknown or other
  misc_feature (173)..(174): n is a, c, g, or t

SEQ ID NO: 21738 - DNA, 179 bp, Homo sapiens; identical to SEQ ID NO: 20397
  misc_feature: GYAE6OF02GBQ15.49.53.E09.1.454.CMB.1.raw
  modified_base (173)..(179): a, c, t, g, unknown or other
  misc_feature (173)..(179): n is a, c, g, or t

SEQ ID NO: 21739 - DNA, 605 bp, Homo sapiens
  misc_feature: GYAE6OF02GFQOC.49.53.E09.1.454.CMB.1.raw
  modified_base (222)..(222): a, c, t, g, unknown or other
  misc_feature (222)..(222): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctgganatgctattcgaccaaagcaatatgtacttacgtacggtaccagcagaacgccgaggccacggccctgttctagatactatttaataaagtactttaggacggacgggtcctacgacgggtaccccgtagacggacgtacttccgtcgtcggtcctccgacgtctacgacgacaaccaacgtacgtcgtacgttacgacctacgtcgaggtggtacggtccggagagacggacgaggctagtacttattacgtgtctacgtacacgtacagacgtagtacggtgtacctcttcgtgttacgttagttcggacgggtaacggaaccgtacggtccgtaccggtaccgtcgtacggtaccgaccggaccgtacggtccgtccccgg

SEQ ID NO: 21740 - DNA, 573 bp, Homo sapiens
  misc_feature: GYAE6OF02HAUHW.49.53.E09.1.454.CMB.1.raw
  modified_base (222)..(222): a, c, t, g, unknown or other
  misc_feature (222)..(222): n is a, c, g, or t
  modified_base (341)..(341): a, c, t, g, unknown or other
  misc_feature (341)..(341): n is a, c, g, or t
  modified_base (428)..(428): a, c, t, g, unknown or other
  misc_feature (428)..(428): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggantgcattgaccaaaagcaatatgcttactggtaccagcagaagccaggccacggcccctgtcttgatctatttaataaagtactttgagacggcctcgacgggacccctggagcgattcnctcggctccagctcgagccgaacaacagtcacgttgaccatcgaggtggacggtccggcaaggaggacgaggctagacttattacgngtacaactcaaacagaccactagttcggttaacttagtcgttcttacggaactcggacgtaaccgaacggttccaacccggttccgtacggggtaccaaccggacccctaaacggccccctaaacccccgtacgttacgtacccg

SEQ ID NO: 21741 - DNA, 173 bp, Homo sapiens; identical to SEQ ID NO: 21104
  misc_feature: GYAE6OF02IZ003.49.53.E09.1.454.CMB.1.raw

SEQ ID NO: 21742 - DNA, 568 bp, Homo sapiens
  misc_feature: GYAE6OF02GMLWE.49.53.E09.1.454.CMB.1.raw
tcagagtcgagagacacgaccggtgctcgatttagagagagtgtgttgggtttgggggtgggtccaggaggcagaactctgggtgtctcaccacggcctggatccctctacttctccccctcctcactctctgcacagactctgaggcctcctatgagctgacacagccaccctcggtgtctgtgtcctcaggacagacggccagtatcacctgctctggagatgcattgaccaaaagcaaatatgcttactggtaccagcagaagccaggccacggcccctgtcttgatctatttaataaagtactttagaggagggtcctacgacgggacccctggacgcgtattctctggcctccagctcacgcgaacaacacgtcacgtttcgacctatacaggtggacggtccgggacaagggacggacggaggctaggacttagttactgtcagtcactcgaagacagttagtggactcttcgtgttacgttagttccgggcggagggaaccagtcgtacggtacccgttcgtacggtcgaccggacccgaacggtccgtacgtccccccgg

SEQ ID NO: 21743 - DNA, 713 bp, Homo sapiens
  misc_feature: GYAE6OF02JYSCP.49.53.E09.1.454.CMB.1.raw
  modified_base (225)..(225): a, c, t, g, unknown or other
  misc_feature (225)..(225): n is a, c, g, or t
tcagagtcgagagacacgaccggtgctcgatttagagagagtgtgttgggtttggggtgggtccgaggaggcagaactctgggtgtctcaccatggcctggatccctctacttctcccctcctcactctctgcacagactctgacgcctcctatgagctgacacacgccaccctcggtgtctgtgtcctcaggacagacggccagtatccacctgcttcgtgganatgctattacgaccaaaagctaaagtactgacttacgtcggtacctagacgaacgaagaccgacggtaccacggccccttcggtctttaggacttactattttaagtaaagttaaccttttaggaacggtaacgggtcccttcgaacgggtacccccttaggaacgccgtaacgtttccgttacgtccgggtccttaccaacggtctaccgtaggacccgaaacaaccgtagttccgtaacgttaccgaacctaactcggtaaggtaccggagggtccccgggagtaacgggaacggacgggacgtccgtacgtaagtacgttactggtacacgttacgatcccgaaaggtaccgagttaacggtcgtacgttaacctcgttaacggttcgttacggttacgggtacgggtacgggtaaccgttccgaccgtttcggtaacccgtttacgacggtccgaacgtaccccggtaggtacccgtaccccgg

SEQ ID NO: 21744 - DNA, 174 bp, Homo sapiens
  misc_feature: GYAE6OF02GK2OM.49.53.E09.1.454.CMB.1.raw
tcagagtcgagagacacgaccggtgctcgatttagagagagtgtgttgggtttgggggaagaggaagactgacggtccccccaggagttcaggtgctgggcacagcggccctgggctgcctggttaaaggactacttcctctctcgactctgagcgggctggcaaggcgcatag

SEQ ID NO: 21745 - DNA, 662 bp, Homo sapiens
  misc_feature: GYAE6OF02HDYG2.49.53.E09.1.454.CMB.1.raw
tcagagtcgagagacacgaccggtgctcgatttagagagagtgtgttgggtttggggtgtgttgggtttgggttgagaacctatgaaaattctgcaggggccactgtcttctccacggtgctcccttcatgcgtgacctggcagctgtagcttctgtgggacttccactgctcaggcgtcaggctcagatagctgctggccgcgtacttgttgttgcttttggtttggagggtgtgggtggtctccactcccgcttggacggggctgctatctgccttccacggcccctgtcttgatctatttataaagtctttaggagacgggcctcgacgggtacccctggacgcgtacttctcgtggcctccgagtctcacgacgaacaacgacgtactacggttacgacctactacgaggtacggacggtcccggggacaaggacgggacgagggactaggtaaccttagttacgtcggttactaacggtcctaatccgaaggtacgtaaggttaggtacggtccgttaactttcgttacggttcgttacggttcgggacgggtaacgggaccgaaggtccggtacggtacccggttaccgtaacgggtaccgaacggtaccccggaaggtcccgttccccggtacccccgttccggtccttacccgg

SEQ ID NO: 21746 - DNA, 176 bp, Homo sapiens; identical to SEQ ID NO: 21620
  misc_feature: GYAE6OF02IA25U.49.53.E09.1.454.CMB.1.raw
  modified_base (174)..(176): a, c, t, g, unknown or other
  misc_feature (174)..(176): n is a, c, g, or t

SEQ ID NO: 21747 - DNA, 562 bp, Homo sapiens
  misc_feature: GYAE6OF02JGXRX.49.53.E09.1.454.CMB.1.raw
  modified_base (220)..(220): a, c, t, g, unknown or other
  misc_feature (220)..(220): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacgccagtatcacctgctctgganatgctattgccaaaagcaaatatgcttactggtaccagcagaacgcaggccacggcccctgtcttgatcatttataaagactttgagtacggcctacgacgggacccctggacgcgattcgtcgtggcctccgagctacagacgacaacacgtacacgttcgacctatacgagtaggacggtacccgggagaggaagggacgagggctgaacgttattactgtcagtcatcaagacaggtagtcgctacttagtgtacgttacgttacgggcggtaacgggaacctaggtccgtacggtaccgtccgttaacggtccgaacgtcccgtaaggcctaccccgg

SEQ ID NO: 21748 - DNA, 172 bp, Homo sapiens; identical to SEQ ID NO: 20291
  misc_feature: GYAE6OF02FQ1KR.49.53.E09.1.454.CMB.1.raw

SEQ ID NO: 21749 - DNA, 539 bp, Homo sapiens
  misc_feature: GYAE6OF02GRA07.49.53.E09.1.454.CMB.1.raw
  modified_base (418)..(418): a, c, t, g, unknown or other
  misc_feature (418)..(418): n is a, c, g, or t
  modified_base (473)..(473): a, c, t, g, unknown or other
  misc_feature (473)..(473): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgtcttactggtaccagacagaacgccaggccacggcccctgtcttgatctatttaataaagtactttagaggagggtccgttaacgggacccctggacgcgtattccgtcgtcggcctccagtctcagacgaacaacagtactacgttgaccatacgaggtggacggtccggganaggaggacgaggctagtactattacgtgtacagtcatcagacagtagtgctactntgtcgtagtcggacggaggacagcgtacgccgtcgtaggtccacgaccgacggtcctccgtccccg

SEQ ID NO: 21750 - DNA, 202 bp, Homo sapiens
  misc_feature: GYAE6OF02I6E6G.49.53.E09.1.454.CMB.1.raw
  modified_base (138)..(138): a, c, t, g, unknown or other
  misc_feature (138)..(138): n is a, c, g, or t
  modified_base (173)..(202): a, c, t, g, unknown or other
  misc_feature (173)..(202): n is a, c, g, or t
tcagagtcgagagacacgaccggtgctcgatttagagagagtgtgttggggtttgggggaagaggaagactgacggtcccccaggagttcaggtgctgggcacagcggcctgggctgcctggtcaaggactacttccnctctcgactctgagcgggctggcaaggcgcatagnnnnnnnnnnnnnnnnnnnnnnnnnnnnnn

SEQ ID NO: 21751 - DNA, 192 bp, Homo sapiens
  misc_feature: GYAE6OF02G7DQ3.49.53.E09.1.454.CMB.1.raw
  modified_base (176)..(192): a, c, t, g, unknown or other
  misc_feature (176)..(192): n is a, c, g, or t
tcagagtcgagagacacgaccggtgctcgatttagagagagtgtggttgggtttgggggaagaggaagactgacggtccccccaggagttcaggtgctgggcacagcggccctgggcctgcctggtcaaggactacttcctctctcgactctgagcgggctggcaaggcgcatagnnnnnnnnnnnnnnnnn

SEQ ID NO: 21752 - DNA, 175 bp, Homo sapiens
  misc_feature: GYAE6OF02IUX3H.49.53.E09.1.454.CMB.1.raw
  modified_base (173)..(175): a, c, t, g, unknown or other
  misc_feature (173)..(175): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactcgagcgggctggcaaggcgcatagnnn

SEQ ID NO: 21753 - DNA, 174 bp, Homo sapiens; identical to SEQ ID NO: 20265
  misc_feature: GYAE6OF02FSDQ1.49.53.E09.1.454.CMB.1.raw
  modified_base (173)..(174): a, c, t, g, unknown or other
  misc_feature (173)..(174): n is a, c, g, or t

SEQ ID NO: 21754 - DNA, 176 bp, Homo sapiens
  misc_feature: GYAE6OF02HBM9L.49.53.E09.1.454.CMB.1.raw
  modified_base (174)..(176): a, c, t, g, unknown or other
  misc_feature (174)..(176): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctctctcgactctgagcgggctggcaaggcgcatagnnn

SEQ ID NO: 21755 - DNA, 520 bp, Homo sapiens
  misc_feature: GYAE6OF02F2V2J.49.53.E09.1.454.CMB.1.raw
  modified_base (387)..(387): a, c, t, g, unknown or other
  misc_feature (387)..(387): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaccagcagaagccaggccaggcccctgtcttgatcatttataaagacttttgagagggcctcgacgggacccctgagcgtattctctggctcagctcagcgacaacagtcacgttgacatcagtggagtcggnagaggacgaggctgattattacgtgtctagtcaatcagatagtagtgacagttactgtgtattcgggacggtacggtaccaacggtcgtacgtaccggttaccaggttccgacgtacccgaaggtcctcccgg

SEQ ID NO: 21756 - DNA, 177 bp, Homo sapiens; identical to SEQ ID NO: 20482
  misc_feature: GYAE6OF02HBDJY.49.53.E09.1.454.CMB.1.raw
  modified_base (173)..(177): a, c, t, g, unknown or other
  misc_feature (173)..(177): n is a, c, g, or t

SEQ ID NO: 21757 - DNA, 174 bp, Homo sapiens; identical to SEQ ID NO: 20960
  misc_feature: GYAE6OF02I1UEP.49.53.E09.1.454.CMB.1.raw
  modified_base (174)..(174): a, c, t, g, unknown or other
  misc_feature (174)..(174): n is a, c, g, or t

SEQ ID NO: 21758 - DNA, 651 bp, Homo sapiens
  misc_feature: GYAE6OF02G9NOG.49.53.E09.1.454.CMB.1.raw
  modified_base (222)..(222): a, c, t, g, unknown or other
  misc_feature (222)..(222): n is a, c, g, or t
  modified_base (439)..(439): a, c, t, g, unknown or other
  misc_feature (439)..(439): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctgganatgcattgaccaaagcaatatgtcttactggtaccagcagaacgccaggccacggcccctgtcttgatctaatttaagtaaagtactttaggaggtacgggcctacgaccggggtacccctaggacgtcgtatttcctcgtcggcctccacgcctcgacgaccgaacaacgacgtacctacgttacaaccgattacgaggtcggaacggtccggganaagggacgggacgaggtctacggactttacgttacgtcgtacaggttcaacgtactacgaacgtaggttacggtacggacttaccgtttcgttacgttaccggttagttccggggacggggtaaccgggtaaccaacggttccggtaaccggtaccggttacccgtaacggggttaccaaccggtaccccggtaaggcccgttacccccggg

SEQ ID NO: 21759 - DNA, 635 bp, Homo sapiens
  misc_feature: GYAE6OF02GIPOX.49.53.E09.1.454.CMB.1.raw
  modified_base (313)..(313): a, c, t, g, unknown or other
  misc_feature (313)..(313): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
tcagagtcgagagacacgaccggtgctcgatttagagagagtgtgttgggtttggggtgtgttgggtttgggttgagaacctatgaaaattctgcaggggccactgtcttctccacggtgctcccttcatgcgtgacctggcagctgtagcttctgtgggacttccactgctcaggcgtcaggctcagatagctgctggccgcgtacttgttgttgctttggttggagggtgtggtgtctccactcccgccttggacggggctgctatctgccttcacggcccctgtcttgatctatttataaagctttgagngggcctcgacgggaccctgagcgtattctctggcctcagctcagcgacaacngtccacgttnaccatcgagtggacgtccgggcaggacggacgaggctagactattactgtcgagtcatacagacgtagtaggtcggtactaccgtttcgtacgttccggttacggttccggggaccgggtaacggggtacccgtaacggtacccggttaacgggtaaccccggtttacccgggttaacggttacccggaaccggtaccccggtaaacgggtccccgttaccccgggtccccccccggttagggttcccccttaaccccgg

SEQ ID NO: 21760 - DNA, 173 bp, Homo sapiens; identical to SEQ ID NO: 20229
  misc_feature: GYAE6OF02IFKQV.49.53.E09.1.454.CMB.1.raw
  modified_base (173)..(173): a, c, t, g, unknown or other
  misc_feature (173)..(173): n is a, c, g, or t

SEQ ID NO: 21761 - DNA, 605 bp, Homo sapiens
  misc_feature: GYAE6OF02GL1EP.49.53.E09.1.454.CMB.1.raw
  modified_base (222)..(222): a, c, t, g, unknown or other
  misc_feature (222)..(222): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctgganatgcattgaccaaaagcaaatatgcttactggtaccagcaagaacgccaggccaggtcccctgtccgttgactctaattttaataaagtactttggagagggtcctacgacgggtacccctggacgacattactcgtggcctccagctacagacaacaacacgtccagttacgacctatacgaaggttcggaggtccggganaaggacggtaacgngggacctaggaacttaagttactgtctaagtacattacgagtaactaggtacgtagactactttcgtagttacgttagttaccgggacgggtaacggaacctaaggtccgtacggtaacccggtacttacgggacgtaaccggaccccgtaaggcccgttaccccgg

SEQ ID NO: 21762 - DNA, 525 bp, Homo sapiens
  misc_feature: GYAE6OF02I34IW.49.53.E09.1.454.CMB.1.raw
  modified_base (340)..(340): a, c, t, g, unknown or other
  misc_feature (340)..(340): n is a, c, g, or t
  modified_base (395)..(395): a, c, t, g, unknown or other
  misc_feature (395)..(395): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccacggcccctgtcttgatcatttaataaagtactttgagacgggcctcgacgggacccctgagcgattcntggctcagctcagcgaacaacagtacacgttcgaccatcaggtggacgtccgggnaggaggacgaggctgacttagttacgtgtcagtcatcgagacagtagtgctacttcgtgtcgtagttcgggacggacggaccagtccgacgtaccgtacgtacggtccgacggcccgaggtcctacccgg

SEQ ID NO: 21763 - DNA, 550 bp, Homo sapiens
  misc_feature: GYAE6OF02HMTGS.49.53.E09.1.454.CMB.1.raw
  modified_base (405)..(405): a, c, t, g, unknown or other
  misc_feature (405)..(405): n is a, c, g, or t
  modified_base (443)..(443): a, c, t, g, unknown or other
  misc_feature (443)..(443): n is a, c, g, or t
  modified_base (465)..(465): a, c, t, g, unknown or other
  misc_feature (465)..(465): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagccagccagcccctgtccttgatctatttaataaagtacttttgaagacgggcctcgacggaccccctggaagcgtattcgtctggcctaccagctcagcgacaaacagtacacgttgaccatacgaagtgggagtccgggnaaggaggacgaggctagtaactattactgtcagtcatnacgacaggtagtcgctacgttntcgtcgttacgttcggcgggtaaggaccgtaagccgtacggaccgttccgtacggtcctacggaccccgaggacccgttccccgg

SEQ ID NO: 21764 - DNA, 656 bp, Homo sapiens
  misc_feature: GYAE6OF02FVWQQ.49.53.E09.1.454.CMB.1.raw
  modified_base (168)..(168): a, c, t, g, unknown or other
  misc_feature (168)..(168): n is a, c, g, or t
  modified_base (233)..(233): a, c, t, g, unknown or other
  misc_feature (233)..(233): n is a, c, g, or t
  modified_base (410)..(410): a, c, t, g, unknown or other
  misc_feature (410)..(410): n is a, c, g, or t
  modified_base (470)..(470): a, c, t, g, unknown or other
  misc_feature (470)..(470): n is a, c, g, or t
tcagagtcgagagacacgaccggtgctcgatttagagagagtgtgttgggtttgggggtgggtccaggaggcagaactctgggtgtctcaccatggcctgggatccctctacttcctccccctcctcactctctgcacagactctgaggcctcctatgagctgacacncgcccaccctcggtgtctgtcgtcctgaggacacggacggccagtactccacctgctcgtggganatgctattcgacctaaaagctaaatatacgtaccttaacgtcggtaaccagtacgaagaacgccgacggacccgacggccccttgttcttaggactcttaatttaactaaagtactttaggaggacggtcctacgacgggtacccctggacgcgtattccgtacgtcggcctacganctacgacgaccgaacaacgagtacgacgttacacctatcgtaggtgggacggtccggganaggacggacggagtcgtagtacttattacgtcgtactacgtactacgtacgacgtacgtagttaggtacgaccttacgttcgttacggttacgttacggttcgggaccgggtacggtaaccgaacggtccgtacggtacccgttacggttacgtaccgaccggtcccgtaacggtcctacccccgg

SEQ ID NO: 21765 - DNA, 627 bp, Homo sapiens
  misc_feature: GYAE6OF02HBQOA.49.53.E09.1.454.CMB.1.raw
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
tcagagtcgagagacacgaccggtgctcgatttagagagagtgtgttgggtttgggggtgggtccgaggaggcagaactctgggtgtctcaccatggcctggatcctctacttctcccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagcaggccagcccctgtcttgatctatttaataaagtactttgagtaggcctcgtacggaccctgacgcgattcnctggctcagctcgngacgaacaacgatcaacgttgacctatcgaaggtgacggtcgggacgtaagggacgggaacggaggtcgtacgacgttaattactgtacacggtactacgtacaagtaacgaggttaacgtcgtacccgttaacgtttccgtaagggtttcccgttaggttttaccggggcccggggttaaacggggaacctaaacggttcccggtaacgggttaccccggtttaccggacgggttaccggaacccgtttacccggaaacggttcccgtacccccgg

SEQ ID NO: 21766 - DNA, 197 bp, Homo sapiens
  misc_feature: GYAE6OF02GGBS2.49.53.E09.1.454.CMB.1.raw
  modified_base (176)..(197): a, c, t, g, unknown or other
  misc_feature (176)..(197): n is a, c, g, or t
tcagagtcgagagacacgaccggtgctcgatttagagagagtgtgttgggtttggggggaagaggaagactgacggtcccccaggagttcaggtgctgggcacagcggccctgggctgccctggtcaaggactacttcctctctcgactctgagcgggctggcaaaggcgcatagnnnnnnnnnnnnnnnnnnnnnn

SEQ ID NO: 21767 - DNA, 175 bp, Homo sapiens
  misc_feature: GYAE6OF02H8T0P.49.53.E09.1.454.CMB.1.raw
  modified_base (171)..(175): a, c, t, g, unknown or other
  misc_feature (171)..(175): n is a, c, g, or t
tcagagtcgagagacacgaccggtgctcgatttagagagagtgtgttgggtttgggggaagaggaagactgacggtcccccaggagttcaggtgctgggcacagcggccctggctgcctggtcaaggactacttcctctccgactctgagcgggctggcaaggcgcatagnnnnn

SEQ ID NO: 21768 - DNA, 529 bp, Homo sapiens
  misc_feature: GYAE6OF02I7PND.49.53.E09.1.454.CMB.1.raw
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
  modified_base (388)..(388): a, c, t, g, unknown or other
  misc_feature (388)..(388): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaacgccgaggccacggcccctgtctgatcattanaaagtcttgagaggcctcgacgggaccctgagcgattcncgtggcctcagctcgagcacaacngtctacgtcaccatcgagtggacgtccgganaggacggacgaggcgtagacttaagtactgtctaacgtcaacgtcagtaactaggtacgtgactacttcgtgtcgtacgttcgggacggacggtaccaagcgtacgaccgtacgtaggtccacgaccgtagtcctccccgg

SEQ ID NO: 21769 - DNA, 178 bp, Homo sapiens; identical to SEQ ID NO: 20465
  misc_feature: GYAE6OF02JQ6WP.49.53.E09.1.454.CMB.1.raw
  modified_base (173)..(178): a, c, t, g, unknown or other
  misc_feature (173)..(178): n is a, c, g, or t

SEQ ID NO: 21770 - DNA, 211 bp, Homo sapiens
  misc_feature: GYAE6OF02JG174.49.53.E09.1.454.CMB.1.raw
  modified_base (152)..(152): a, c, t, g, unknown or other
  misc_feature (152)..(152): n is a, c, g, or t
  modified_base (170)..(170): a, c, t, g, unknown or other
  misc_feature (170)..(170): n is a, c, g, or t
  modified_base (176)..(211): a, c, t, g, unknown or other
  misc_feature (176)..(211): n is a, c, g, or t
tcagagtcgagagacacgaccggtgctcgatttagagagagtgtgttgggtttgggggaagaggaaggactgacggtcccccaggagttcaggtgctgggcacagcggaccctgggctgcctggtcaaggacctacttcctctctcgactcngagcgggctggcaaggcncatagnnnnnnnnnnnnnnnnnnnnnnnnnnnnnnnnnnnn

SEQ ID NO: 21771 - DNA, 528 bp, Homo sapiens
  misc_feature: GYAE6OF02JFJI5.49.53.E09.1.454.CMB.1.raw
  modified_base (386)..(386): a, c, t, g, unknown or other
  misc_feature (386)..(386): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagacttttgagagggcctcagggacccctgagcgattctctggctccagctcagcgacaacagtcacgttgaccatcagtggagtcgggnagaggacgaggctgactattactgtcagtcatccagacagtagtgactacttcgtgtcgttagttcgggacggtaagggacctaaaggtcctacggtacccgtcccgttagggtcccaggtaccccgaaggtcctaccccgg

SEQ ID NO: 21772 - DNA, 174 bp, Homo sapiens; identical to SEQ ID NO: 20960
  misc_feature: GYAE6OF02F79P0.49.53.E09.1.454.CMB.1.raw
  modified_base (174)..(174): a, c, t, g, unknown or other
  misc_feature (174)..(174): n is a, c, g, or t

SEQ ID NO: 21773 - DNA, 515 bp, Homo sapiens
  misc_feature: GYAE6OF02FH67R.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagacttttgagagggcctcgagggacccctgacgcgattctctggctccagctcagcgacaacagtcacgttgaccatcagtgagtccgggcagaggacgaggctgacttattactgtcagtcatcagacagtagtgcacttcgtgtcgttagttcggcggaacgggaccaaggtcctaggacccgtccgtacggtccaaggccccgaaggcctacccgg

SEQ ID NO: 21774 - DNA, 174 bp, Homo sapiens
  misc_feature: GYAE6OF02GCLH6.49.53.E09.1.454.CMB.1.raw
  modified_base (173)..(174): a, c, t, g, unknown or other
  misc_feature (173)..(174): n is a, c, g, or t
tcagagtcgagagacacgaccggtgctcgatttagagagagtgtgttgggtttgggggaagaggaagactgacggtcccccaggagttcaggtgctgggcacagcggcccttggctgcctggtcaaggactacttcctctctcgactctgagcgggctggcaaggcgcatagnn

SEQ ID NO: 21775 - DNA, 526 bp, Homo sapiens
  misc_feature: GYAE6OF02HF5D9.49.53.E09.1.454.CMB.1.raw
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcaagaagccaggccacggcccctgtcttgatctatttataaagtactttgagacggcctcgacgggacccctgacgcgtattctctggcctcagctcagcgacaacngtctacgttnaccatcagtggacgtccggganaggaggacgaggctagacttattactgtcagtcatcgagactagtagtgctacttcgtgtcgttagtcgggcggaacggaccaagtcgtacgaccgttccgtaggtccacggcccgaggtcctacccgg

SEQ ID NO: 21776 - DNA, 175 bp, Homo sapiens; identical to SEQ ID NO: 20418
  misc_feature: GYAE6OF02H7MYD.49.53.E09.1.454.CMB.1.raw
  modified_base (173)..(175): a, c, t, g, unknown or other
  misc_feature (173)..(175): n is a, c, g, or t

SEQ ID NO: 21777 - DNA, 182 bp, Homo sapiens
  misc_feature: GYAE6OF02FVOZE.49.53.E09.1.454.CMB.1.raw
  modified_base (176)..(182): a, c, t, g, unknown or other
  misc_feature (176)..(182): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgactctggagcgggctggcaaggcgcatagnnnnnnn

SEQ ID NO: 21778 - DNA, 175 bp, Homo sapiens; identical to SEQ ID NO: 20418
  misc_feature: GYAE6OF02FZJ6V.49.53.E09.1.454.CMB.1.raw
  modified_base (173)..(175): a, c, t, g, unknown or other
  misc_feature (173)..(175): n is a, c, g, or t

SEQ ID NO: 21779 - DNA, 533 bp, Homo sapiens
  misc_feature: GYAE6OF02H5PDJ.49.53.E09.1.454.CMB.1.raw
  modified_base (360)..(360): a, c, t, g, unknown or other
  misc_feature (360)..(360): n is a, c, g, or t
  modified_base (407)..(407): a, c, t, g, unknown or other
  misc_feature (407)..(407): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgaccaaagcaaatatgctttactggtaaccagcaagaagcaggccacggcccctgtccttagatctaattaataaagactttgagagggccacgtacgggacccctggagcgtattcctcgtcggctaccanctcacgcgaacaacagtacacgttagaccatcagtggagtccggganaggaggagagctgtactattacgtgtacagtcatacgagacagtagtggactacgtctgtcgttagtcgggacggaggaccaaggtccgtacgaccgtcgtacggtccacgaccgacgcgtacccg

SEQ ID NO: 21780 - DNA, 220 bp, Homo sapiens
  misc_feature: GYAE6OF02IEW3Y.49.53.E09.1.454.CMB.1.raw
  modified_base (141)..(141): a, c, t, g, unknown or other
  misc_feature (141)..(141): n is a, c, g, or t
  modified_base (178)..(220): a, c, t, g, unknown or other
  misc_feature (178)..(220): n is a, c, g, or t
tcagagtcgagagacacgaccggtgctcgatttagagagagtgtgttgggtttgggggggaagaggaagactgacggtcccccaggagttcaggtgctgggccacagcggccctgggcctgcctggtcaaggctacttccnctccagactcctgagcgggactggcaaggcgcatagnnnnnnnnnnnnnnnnnnnnnnnnnnnnnnnnnnnnnnnnnnn

SEQ ID NO: 21781 - DNA, 178 bp, Homo sapiens; identical to SEQ ID NO: 20465
  misc_feature: GYAE6OF02IK4XX.49.53.E09.1.454.CMB.1.raw
  modified_base (173)..(178): a, c, t, g, unknown or other
  misc_feature (173)..(178): n is a, c, g, or t

SEQ ID NO: 21782 - DNA, 619 bp, Homo sapiens
  misc_feature: GYAE6OF02I6N5X.49.53.E09.1.454.CMB.1.raw
  modified_base (417)..(417): a, c, t, g, unknown or other
  misc_feature (417)..(417): n is a, c, g, or t
tcagagtcgagagacacgaccggtgctcgatttagagagagtgtgttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtgggctgaggtgagaagccgtgggtcgtcggtgaggtctcctgcaaggcttcgtggacgacaccttacaactaactttgctgtcagctgggtgcgacgacggccccgtggacgaacggccttggaggtggggtagggaaggatccacccctagtaccttaatactagactaaacgtatcgacacacgactacttaccacgacagtacgtacctacccgttancgacgaacaaactccaacgaaccacacgacctaacacgtacggaactcgacgacaacgtaccgtaggtactcgtacggaccgaaccgaccggtaccttaagtttcgttacgtggtacgacggagacggtaaggtcttcggtttactttacgtaagttacggttaagttacggttaacgttagttaccttagtttagttaccg

SEQ ID NO: 21783 - DNA, 701 bp, Homo sapiens
  misc_feature: GYAE6OF02JXKOW.49.53.E09.1.454.CMB.1.raw
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
  modified_base (570)..(570): a, c, t, g, unknown or other
  misc_feature (570)..(570): n is a, c, g, or t
tcagagtcgagagacacgaccggtgctcgatttagagagagtgtgttgggtttgggggtgggtcgaggaggcgaggaacgtctgggtgtcgtcaccatggcctggatccctctacttctcccctcctcacctctcctgcacagactctgaggcctcctatgagctgacacacgccaccctcggtgtctggtgtcctcgaaggacaggaccggccaagtactccaaccttggccttctggganatggcaattcggaccaaaagtcaatatgacttactcggtaaccagcgacgaagccaggccacgggcccctggtcttanacgttactatttaagtaaacgtactttaggtagtaacgggcctacgtacgggaccccgtgacgtacggactttcgtacgtcgggacctacggcgtctacgaccgtacgacgaactacggactacgttacgactacgtacctaaggtcggtacggtacccggagtaacggacgggtaaccggacgggacgttacggaacgttacgtttaacaccgggttacagggttacttacgaccgaaggttaaaccgngttaacgggtaacgggccttaaaccgtttcgtcggtttacgtacgttacgggtacggtaacgggaccgtaaggtaccgtaggtacccgtacggttaggccggtacggaacccgtaccgacggttaccccgg

SEQ ID NO: 21784 - DNA, 499 bp, Homo sapiens
  misc_feature: GYAE6OF02F2UF7.49.53.E09.1.454.CMB.1.raw
  modified_base (382)..(382): a, c, t, g, unknown or other
  misc_feature (382)..(382): n is a, c, g, or t
  modified_base (436)..(436): a, c, t, g, unknown or other
  misc_feature (436)..(436): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggctcagggacccctgagcgattctctggctccagctcagcgacacagtcacgttgaccatcagtggagtccggnagaggacgaggctgactattactgtcagtcatcagcagtagtggactacgttcngttcgtattccgggacgggtacggacctagctcgaccgtcgtacgtcacgaccgagcgtcccg

SEQ ID NO: 21785 - DNA, 197 bp, Homo sapiens
  misc_feature: GYAE6OF02GUTC7.49.53.E09.1.454.CMB.1.raw
  modified_base (174)..(197): a, c, t, g, unknown or other
  misc_feature (174)..(197): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnnnnnnnnnnnnnnnnnnnnn

SEQ ID NO: 21786 - DNA, 526 bp, Homo sapiens
  misc_feature: GYAE6OF02IEF7A.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaacgccaggccacggcccctgtcttgatctatttataaagtactttgagaggcctcgacgggacccctgacgcgattctctggcctccagctcagcgacaacacgtcacgttagaccatcagtggacgtccggacaggacggacgaggcgtgaacttattactgtcagtcatcagacgagtagtagctacttgtgttcgtagttcggacggcggaccgacggtctacgaccgtccgtacggtacacggccctaagggcctacccgg

SEQ ID NO: 21787 - DNA, 174 bp, Homo sapiens
  misc_feature: GYAE6OF02GGWJF.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctggagcgggctggcaaggcgcatagn

SEQ ID NO: 21788 - DNA, 566 bp, Homo sapiens
  misc_feature: GYAE6OF02FPQ4S.49.53.E09.1.454.CMB.1.raw
  modified_base (491)..(491): a, c, t, g, unknown or other
  misc_feature (491)..(491): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcaagaagccgaggccacggcccctgtcttgactctatttaataagtactttgagacgggcctcgacgggtaccctgagcgattctcgtggcctccgacgtctacgacgacgaacaacgacgtctacggttcaaccctatcgaaggttcggacggtccgggacaagggacggaccgagggcttagacttagttctagtcctagtcagtacaggactaggtacgtcgtactcttgngtacttacggtcgggagggtacggacaagtcgtaccgtacgtaccgtggtaccacggacccgtaggccctcccgg

SEQ ID NO: 21789 - DNA, 519 bp, Homo sapiens
  misc_feature: GYAE6OF02FGV28.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggcccctgtcttgatctatttataaagacttttagagaggcctcgacgggacccctgagcgattctcgtgcctcagctcagcgaacaacagtacacgttcgacctatcgagtggacggtccgggcaggagggacgaggcgtagacttattacgtgtcagtcatcagacagttagtgactacgttctgtcgttagtcggcggaggaccaagcgtcgaccgtcgtaggtacacgccgaggcctacccgg

SEQ ID NO: 21790 - DNA, 173 bp, Homo sapiens; identical to SEQ ID NO: 20229
  misc_feature: GYAE6OF02FKBRU.49.53.E09.1.454.CMB.1.raw
  modified_base (173)..(173): a, c, t, g, unknown or other
  misc_feature (173)..(173): n is a, c, g, or t

SEQ ID NO: 21791 - DNA, 176 bp, Homo sapiens; identical to SEQ ID NO: 20270
  misc_feature: GYAE6OF02FSTMX.49.53.E09.1.454.CMB.1.raw
  modified_base (173)..(176): a, c, t, g, unknown or other
  misc_feature (173)..(176): n is a, c, g, or t

SEQ ID NO: 21792 - DNA, 238 bp, Homo sapiens
  misc_feature: GYAE6OF02GFTFZ.49.53.E09.1.454.CMB.1.raw
  modified_base (143)..(143): a, c, t, g, unknown or other
  misc_feature (143)..(143): n is a, c, g, or t
  modified_base (176)..(238): a, c, t, g, unknown or other
  misc_feature (176)..(238): n is a, c, g, or t
tcagagtcgagagacacgaccggtgctcgatttagagagagtgtggttggggtttgggggaagaggaagactgacggtccccccaggagttcaggtgctgggcacagcggccctgggctgcctggtcaaggctacgtcctctntcgactctgaagcgggctggcaaggcgcatagnnnnnnnnnnnnnnnnnnnnnnnnnnnnnnnnnnnnnnnnnnnnnnnnnnnnnnnnnnnnnnn

SEQ ID NO: 21793 - DNA, 175 bp, Homo sapiens
  misc_feature: GYAE6OF02H8DM4.49.53.E09.1.454.CMB.1.raw
  modified_base (175)..(175): a, c, t, g, unknown or other
  misc_feature (175)..(175): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatagn

SEQ ID NO: 21794 - DNA, 176 bp, Homo sapiens; identical to SEQ ID NO: 20270
  misc_feature: GYAE6OF02FI8VI.49.53.E09.1.454.CMB.1.raw
  modified_base (173)..(176): a, c, t, g, unknown or other
  misc_feature (173)..(176): n is a, c, g, or t

SEQ ID NO: 21795 - DNA, 689 bp, Homo sapiens
  misc_feature: GYAE6OF02JABEZ.49.53.E09.1.454.CMB.1.raw
  modified_base (224)..(224): a, c, t, g, unknown or other
  misc_feature (224)..(224): n is a, c, g, or t
tcagagtcgagagacacgaccggtgctcgatttagagagagtgtgttgggtttgggggtgggtccgaggaggcagaactctgggtgtctcaccatggcctggatccctctacttctccccctcctcactctctgcacagactctgaggcctcctatgagctgacacagccaccttcggtgtctgtgtcctgaggacagacggcagtactcacctgctctggagntgctagttcgacaaagcaagttatgtacgttactcggtaaccagaccaaggaacgtccgacggacccgaacggccccctggttccttaggacttcgtaattttaacgttaaaacggttacttttaggaggtaacgggtcccgtaccggaccgggaccccgtaggacgtcgtaactttcgttacgtcgggaccttaccgacggtacctcgaacggtaccgaacctaaccgtacggttaccaccggttacgaacccgtataccgtaggtacgggaacgttccgggacaggacggacggacggctaggtaaccttaagttaccgtgtacctagtacctacgtacaaggtacagggttaggtcgtacgtacttccgtagttacggttacgttccgggacgggtacgggtaaccgagtaccggtccgtaccgtccgttaaggtaccaccggaccttacgggccttcccgg

SEQ ID NO: 21796 - DNA, 561 bp, Homo sapiens
  misc_feature: GYAE6OF02G50KS.49.53.E09.1.454.CMB.1.raw
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtcgtcctcaggacagacggccagtatcacctgctctggagatgcattcgaccaaaagcaatatgcttactggtaccagcagaagccaggccaggcccctgtcttgatctatttataaagactttgagagggcctcacgggaccctgagcgattctctggcttccagctcgagcgaactaacagtcacgttgacatcagtggagtccgggnagnggacgagctgactatactgtacncgtnanccgtaagaccgtaagtagtagtcctactttacgtcgttaccggtaatttccggggacgggtaacgggaaccgtaaacggcgtcggtaacccggttaccgtaacgggtccaaccggacccgaacggtcctaccccgg

SEQ ID NO: 21797 - DNA, 722 bp, Homo sapiens
  misc_feature: GYAE6OF02IQB58.49.53.E09.1.454.CMB.1.raw
  modified_base (222)..(222): a, c, t, g, unknown or other
  misc_feature (222)..(222): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctgganatgcattcgaccaaagcaatatgacttactcggtaccagcagaagccaggccacggcccctgtcttgatactatttaataaagtacttttagaggtacgggtccttacgacgggtacccccgttggacgtcggaactttccgtcgtcgggccttccgacgtcctacaacggccgaacaacgacggtactacgtttacgaacccaacgtacgggtacgggaacgggtcccggggacgaacgggaacgggaaccggagggtacgtacggtaacgtttaagtttaccttacggttaccgtaagtacctaagttaaccgaagtaaccgtaaggttacggtacggtaccgttaacgtttaccgtacggtttacgttacggtttccggggtaacggggtacccgggtaaccgtaaccggtccgttaaccggtaaccccggtttacgttaccgggtaccgacccggttaaccccggaacggtcccggttacccggtacccccccggg

SEQ ID NO: 21798 - DNA, 177 bp, Homo sapiens; identical to SEQ ID NO: 20482
  misc_feature: GYAE6OF02H6NQN.49.53.E09.1.454.CMB.1.raw
  modified_base (173)..(177): a, c, t, g, unknown or other
  misc_feature (173)..(177): n is a, c, g, or t

SEQ ID NO: 21799 - DNA, 677 bp, Homo sapiens
  misc_feature: GYAE6OF02IX8S6.49.53.E09.1.454.CMB.1.raw
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (406)..(406): a, c, t, g, unknown or other
  misc_feature (406)..(406): n is a, c, g, or t
tcagagtcgagagacacgaccggtgctcgatttagagagagtgtgttgggtttgggggtgggtccaggaggcagaactctgggtgtctcaccatggcctggatccctctacttctccccctctcactctctgcacagactctgaggccgtcctagtcgagctgactacgagccacctggtgtctgtgtcctanaggacagacgcagtacncacctgcttnagganatcgctattcgaccaagcaatnagtctacgtcggtaccagacgacgaaagccgaggcccaacggcccccgttgttcccttgtactacgttaactttaactaaagttaccgtttaggacgacgggtacctacgacccgggtaccccgtgaacgcggtaacttacctcgtcggtcctccgtanctacgacgacgaacaacgtagtcctaacgttcgaaccgtatacgtacgtacggcggtccggacacggaggaaccggtagacttacgtacttacgttacgtacgttcaagttcaaagttaccgaagtaaaccgtgttaaggttccgtacgttacgttccgttacgttaaccgttcgttaacgggggaccgggttaacggacgtaaaccggtccgtaacgtcccggtaccgttacggaccgtaacccgttaccgaccggtaccgttcccccgg

SEQ ID NO: 21800 - DNA, 179 bp, Homo sapiens
  misc_feature: GYAE6OF02H2Z4B.49.53.E09.1.454.CMB.1.raw
  modified_base (175)..(179): a, c, t, g, unknown or other
  misc_feature (175)..(179): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctcgtagcactctgagcgggctggcaaggcgcatagnnnnn

SEQ ID NO: 21801 - DNA, 813 bp, Homo sapiens
  misc_feature: GYAE6OF02I96BJ.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacagccaccctcggtgtctgtgtcctcaggacagaccgccagtatcacctgctctggagatgcattcgaccaaagcaagtatgtcttacgtcggtaccagcaagaacgccgaggccacggtccctgtcttagatactatttaagtaaagtctttaggaggtacgggccttacggaccgggtaccccttaggacggacgttactttcctcggtcgggtccttaccgacgtcctaccggaacgaccgaaaccgtaaaccgtacggtacccgtaccggtttaacggaacccctagtccggtaaggggttaccggggtaccgggttcccggggaaccgaaaggggacgggggaaccgggtacgggtccgttaggtaaacccgttttaactttaaaccggtcggttaaccgtacggttaaccttaacgtaccggaaacgtaccgttaagggttaacggttcccggtaactttaaacccggtttcgttaccgggtttaccggtttacgggtttacccgggggacggggtaacccggggtaaacccgtaaccgggtacccggtttaccgggtaaaccccggtttacccgggtttagggtaaaccccgttcccgggaaaccccggttaacccggggttccccggtacccccccgggg

SEQ ID NO: 21802 - DNA, 899 bp, Homo sapiens
  misc_feature: GYAE6OF02FH0QU.49.53.E09.1.454.CMB.1.raw
  modified_base (187)..(187): a, c, t, g, unknown or other
  misc_feature (187)..(187): n is a, c, g, or t
  modified_base (245)..(245): a, c, t, g, unknown or other
  misc_feature (245)..(245): n is a, c, g, or t
tcagagtcgagagacacgaccggtgctcgatttagagagagtgtgttgggtttgggggtgggtccaggaggcagaactctgggtgtctcaccatggcctggatccctctacttctcccctctcactctctgcacagactctgaggcctctatgagctgacacagccaccctggtgtctgtcgtcctnaggacacgacggccagtatcacctgctcgtggacgatgcattcgaccaaaagcaaatntgcttacgtggtaccagcaagaacgccaggccacggtcccctgtcttgatactatttaataaagtactttaggagacggtcctcgacgggaccctgacgcgtattcgtcgtcggtcctccgacgtccgtacgacgtaccgaaccaaccgtacggttaccgtaaccggtttccggaaaccttacgtaaccgtacgggttacggggtaaccgggttaccccgggggacgtaaacggggaacgggggtaaccgggtaacgggggttcccgttaaccgggttaaacttttaaaccggttttaaacccgtttacgggtttaaaccccgttaaacgggtttaacccgttaaaacctttacccgggtaaaacgtaaacccgggtttaaacgggggttttaaccgggtttaaccgggggtaaccccgtttaaaccggttttttccgggtaaccggggtttttacccgggtttttaaccggggtttaccccgggggggtaacccggggggttaaaaccgggggtaaccccggttaaaacgggttccccggtttaaccggggttaaaccccccggtttacccggtttaaaccgggggtttaccccgaaaacccgggttaacccccgggtaaaccggggttcccccgtttaaccccccccggggg

SEQ ID NO: 21803 - DNA, 178 bp, Homo sapiens; identical to SEQ ID NO: 20465
  misc_feature: GYAE6OF02GHEBE.49.53.E09.1.454.CMB.1.raw
  modified_base (173)..(178): a, c, t, g, unknown or other
  misc_feature (173)..(178): n is a, c, g, or t

SEQ ID NO: 21804 - DNA, 681 bp, Homo sapiens
  misc_feature: GYAE6OF02FUJR8.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaaagcaatatgcttactggtaccagcaagaacgccaggccacggcccctgtcttgatctatttaataaagtactttagagacgggcctcgacgggtacccctagacgcgtattctacgtcggcctccgacgtctacgacgccgaactaacgacgtaccgtaacgttacgaaccctaagtaccgaaggttcgggtaaccggtccggggtacgaagggaacgggacggacgggtcgttacgtaacctttaagtttaccgtcgtacgtacgtctaacgtacgaagacgtaaggttacggtcgggtaccttaacgtttcgtacggtttacgttacggttccgggaacggggtaaccgggtaaccgtaacgggtcccgtaaccggtaccccggttaccgttacgggtacccgtaaccggtaccccggtaaccgggtcccgttaccccccggg

SEQ ID NO: 21805 - DNA, 175 bp, Homo sapiens; identical to SEQ ID NO: 20418
  misc_feature: GYAE6OF02F5WHC.49.53.E09.1.454.CMB.1.raw
  modified_base (173)..(175): a, c, t, g, unknown or other
  misc_feature (173)..(175): n is a, c, g, or t

SEQ ID NO: 21806 - DNA, 582 bp, Homo sapiens
  misc_feature: GYAE6OF02FZNMA.49.53.E09.1.454.CMB.1.raw
  modified_base (190)..(190): a, c, t, g, unknown or other
  misc_feature (190)..(190): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggccagtatcacctgctctggagatgcattgaccaaagcaaatatgcttactcggtaccagctagaacgccgaggcccacggcccctgttccttagatactaatttaataaagtactttaggagacgggcctacgacgggtacccctggacgcgtattctcgtcggctccagctacgagccgtaacaacgacgtcaacgttcgacatacgaggtagggacggtccggacaaggacggacggaggctagacttagttactgtacagtcatacacgtagagtagtgacctacgtttcgtcgttacggttacgtacgggacgggaacgggaaccgtaacgcgtacggacccgttcggtaacggtcaccggaccgagcccgtcccgg

SEQ ID NO: 21807 - DNA, 200 bp, Homo sapiens
  misc_feature: GYAE6OF02HJ4XM.49.53.E09.1.454.CMB.1.raw
  modified_base (177)..(200): a, c, t, g, unknown or other
  misc_feature (177)..(200): n is a, c, g, or t
tcagagtcgagagacacgaccggtgctcgatttagagagagtgtgttgggtttgggggaagaggaagactgacggtcccccaggtagttcaggtgctgggcacagcggccctgggctgcctggtcaaggactacttccgtctctcggactctgagcgggcttggcaaggcgcatagnnnnnnnnnnnnnnnnnnnnnnnn

SEQ ID NO: 21808 - DNA, 556 bp, Homo sapiens
  misc_feature: GYAE6OF02FT4EU.49.53.E09.1.454.CMB.1.raw
  modified_base (399)..(399): a, c, t, g, unknown or other
  misc_feature (399)..(399): n is a, c, g, or t
  modified_base (436)..(436): a, c, t, g, unknown or other
  misc_feature (436)..(436): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtccttgatcatttataaagtactttgagagggcctcgacgggacccctgacgcgtattcctctcggctccagctcagcgaacaacgagtccacgttcgaccatcagtcggagtccgggngaggaggacggaggctagacttattactgtctacgtnagtcagactagtagtgctacttcgtcgttacgttagttccgggacgggtacggaaccgtaggccgttaggacccgttccggttacggtcccgacggaccccgtaacggcctacccccggg

SEQ ID NO: 21809 - DNA, 175 bp, Homo sapiens; identical to SEQ ID NO: 21678
  misc_feature: GYAE6OF02GAQDT.49.53.E09.1.454.CMB.1.raw
  modified_base (174)..(175): a, c, t, g, unknown or other
  misc_feature (174)..(175): n is a, c, g, or t

SEQ ID NO: 21810 - DNA, 192 bp, Homo sapiens
  misc_feature: GYAE6OF02GC10C.49.53.E09.1.454.CMB.1.raw
  modified_base (173)..(192): a, c, t, g, unknown or other
  misc_feature (173)..(192): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggctacttcctctctcgactctcgagcgggctggcaaggcgcatagnnnnnnnnnnnnnnnnnnnn

SEQ ID NO: 21811 - DNA, 200 bp, Homo sapiens
  misc_feature: GYAE6OF02IKNMC.49.53.E09.1.454.CMB.1.raw
  modified_base (177)..(200): a, c, t, g, unknown or other
  misc_feature (177)..(200): n is a, c, g, or t
tcagagtcgagagacacgaccggtgctcgatttagagagagtgtgttggggtttgggggaagaggaagactgacggtccccccaggagttcaggtgctgggcacagcggccctgggctgcctggtcaaaggactacttcctctctcgactctgagcgggctggcaaggcgacatagnnnnnnnnnnnnnnnnnnnnnnnn

SEQ ID NO: 21812 - DNA, 175 bp, Homo sapiens; identical to SEQ ID NO: 20418
  misc_feature: GYAE6OF02F7DE9.49.53.E09.1.454.CMB.1.raw
  modified_base (173)..(175): a, c, t, g, unknown or other
  misc_feature (173)..(175): n is a, c, g, or t

SEQ ID NO: 21813 - DNA, 253 bp, Homo sapiens
  misc_feature: GYAE6OF02H9KOI.49.53.E09.1.454.CMB.1.raw
  modified_base (142)..(142): a, c, t, g, unknown or other
  misc_feature (142)..(142): n is a, c, g, or t
  modified_base (145)..(145): a, c, t, g, unknown or other
  misc_feature (145)..(145): n is a, c, g, or t
  modified_base (182)..(182): a, c, t, g, unknown or other
  misc_feature (182)..(182): n is a, c, g, or t
  modified_base (187)..(187): a, c, t, g, unknown or other
  misc_feature (187)..(187): n is a, c, g, or t
  modified_base (200)..(253): a, c, t, g, unknown or other
  misc_feature (200)..(253): n is a, c, g, or t
tcagagtcgagagacacgaccggtgctcgatttagagagagtgtggttgggggtttggggggaagaggaagactgacggtcccccaggagttcaggtgctgggcacagcggcctgggctgcctggtccaaaggctacttccnctntcgaactctgagcgggctggacaaaggtcgctaatgntcatnatgctgtgcagcnnnnnnnnnnnnnnnnnnnnnnnnnnnnnnnnnnnnnnnnnnnnnnnnnnnnnn

SEQ ID NO: 21814 - DNA, 176 bp, Homo sapiens; identical to SEQ ID NO: 20270
  misc_feature: GYAE6OF02F95HY.49.53.E09.1.454.CMB.1.raw
  modified_base (173)..(176): a, c, t, g, unknown or other
  misc_feature (173)..(176): n is a, c, g, or t

SEQ ID NO: 21815 - DNA, 146 bp, Homo sapiens
  misc_feature: GYAE6OF02I4RKI.49.53.E09.1.454.CMB.1.raw
  modified_base (144)..(146): a, c, t, g, unknown or other
  misc_feature (144)..(146): n is a, c, g, or t
tcagagtcgagagacacgaccggtgctcgatttagagagagtgtggttgggtttgggggaagaggaagactgaccggtcccccgaggagttcaggtgctgggcacagcggccctgggctgcctggtcaaggactacttcctctnnn

SEQ ID NO: 21816 - DNA, 179 bp, Homo sapiens
  misc_feature: GYAE6OF02I1U62.49.53.E09.1.454.CMB.1.raw
  modified_base (173)..(179): a, c, t, g, unknown or other
  misc_feature (173)..(179): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggctacttcctctctcgactctgagcgggctggcaaggcgcatagnnnnnnn

SEQ ID NO: 21817 - DNA, 200 bp, Homo sapiens
  misc_feature: GYAE6OF02I4BVI.49.53.E09.1.454.CMB.1.raw
  modified_base (178)..(200): a, c, t, g, unknown or other
  misc_feature (178)..(200): n is a, c, g, or t
tcagagtcgagagacacgaccggtgctcgatttagagagagtgtgttggggtttgggggggaagaggaagactgacggtccccccaggagttcaggtgctgggcacagcggccctgggctgcctggtccaaggctacttcctctctcgactctgagcgggctggcaaggcgcaatagnnnnnnnnnnnnnnnnnnnnnnn

SEQ ID NO: 21818 - DNA, 176 bp, Homo sapiens; identical to SEQ ID NO: 21754
  misc_feature: GYAE6OF02GYVY6.49.53.E09.1.454.CMB.1.raw
  modified_base (174)..(176): a, c, t, g, unknown or other
  misc_feature (174)..(176): n is a, c, g, or t

SEQ ID NO: 21819 - DNA, 188 bp, Homo sapiens
  misc_feature: GYAE6OF02GNBAP.49.53.E09.1.454.CMB.1.raw
  modified_base (173)..(188): a, c, t, g, unknown or other
  misc_feature (173)..(188): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnnn

SEQ ID NO: 21820 - DNA, 179 bp, Homo sapiens; identical to SEQ ID NO: 20397
  misc_feature: GYAE6OF02F3ZPZ.49.53.E09.1.454.CMB.1.raw
  modified_base (173)..(179): a, c, t, g, unknown or other
  misc_feature (173)..(179): n is a, c, g, or t

SEQ ID NO: 21821 - DNA, 594 bp, Homo sapiens
  misc_feature: GYAE6OF02I135P.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactcggtaccagcagaagccaggccacggcccctgtgttggtgattgtaataaagacacgtgagacggccctgagggactcccgtgacgcgtattctctggctcgaggtcgagggacaacggtcacagttggcctatcgaggtggacgtccggaggacgaggaggacggaggtctagtacttagtttattgtacctaaatccaaacgtacgaactaaccgttaagtttacggtttaacttagttcgttacgttacggtactcggaaccgtaaccgtaacggtccgtaaccgttccggttgggtacccgacgaccccgtaaccggacccctaaccccgtcgttacccg

SEQ ID NO: 21822 - DNA, 174 bp, Homo sapiens; identical to SEQ ID NO: 20960
  misc_feature: GYAE6OF02F7GPA.49.53.E09.1.454.CMB.1.raw
  modified_base (174)..(174): a, c, t, g, unknown or other
  misc_feature (174)..(174): n is a, c, g, or t

SEQ ID NO: 21823 - DNA, 632 bp, Homo sapiens
  misc_feature: GYAE6OF02F5PDX.49.53.E09.1.454.CMB.1.raw
  modified_base (225)..(225): a, c, t, g, unknown or other
  misc_feature (225)..(225): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatccacctgctcgtgganatgcattcgacaaaagcaatatgcctttacgtggtaccagacaagaacgccgaggccacggcccccttgtcttgattctaatttaataaacgtactttggacggtaggcccgttacgaccgggtacccctggacgcgtacttctcgtggcctccgagtctcgacgacacaacagtcacgttcgacctatacgagtgggacggtccgggacgtacggacgggacgcggcgtagtacttagttcctgtctacgtctacgtcgaacgtagtaacggttgtcggtaccttacgttccgttaggtaccgttaggtttaccggggcgggtaaaccgggaccgtaacgtccgggttaccgtaacccggttccgtacggtacccgtacggacccgtaacgggtccctacccccgg

SEQ ID NO: 21824 - DNA, 187 bp, Homo sapiens
  misc_feature: GYAE6OF02G0NJW.49.53.E09.1.454.CMB.1.raw
  modified_base (175)..(187): a, c, t, g, unknown or other
  misc_feature (175)..(187): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatacgnnnnnnnnnnnnn

SEQ ID NO: 21825 - DNA, 594 bp, Homo sapiens
  misc_feature: GYAE6OF02GP3FZ.49.53.E09.1.454.CMB.1.raw
  modified_base (246)..(246): a, c, t, g, unknown or other
  misc_feature (246)..(246): n is a, c, g, or t
  modified_base (273)..(273): a, c, t, g, unknown or other
  misc_feature (273)..(273): n is a, c, g, or t
  modified_base (351)..(351): a, c, t, g, unknown or other
  misc_feature (351)..(351): n is a, c, g, or t
  modified_base (430)..(430): a, c, t, g, unknown or other
  misc_feature (430)..(430): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctgaggacagacggccagtatcacctgctcgtggagtatgctattcgaccaaagcaatntgacttacgtggtaccagcaaggaacnccaggccacggccctgtctgatctatttaataaagtactttgacggacggcctcgaccgggtaccctgagcgtattcngtcgctcgagctacgacgacgaacaactagtactacggtacacctagtcgaggtggacggtcggacgagggacgacggnggtctacggacttaattcgacgttcgacgtcaatacgaagtacgagttacggcggttactcgttacggtcgttacggttacgtacgggacgggaccggtaaccgtacggtccgtacggtaccgtaccgtaggtaccgtacgggacctacgggcccgttacccgg

SEQ ID NO: 21826 - DNA, 175 bp, Homo sapiens; identical to SEQ ID NO: 20418
  misc_feature: GYAE6OF02H68FS.49.53.E09.1.454.CMB.1.raw
  modified_base (173)..(175): a, c, t, g, unknown or other
  misc_feature (173)..(175): n is a, c, g, or t

SEQ ID NO: 21827 - DNA, 739 bp, Homo sapiens
  misc_feature: GYAE6OF02G7UME.49.53.E09.1.454.CMB.1.raw
  modified_base (190)..(190): a, c, t, g, unknown or other
  misc_feature (190)..(190): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggccagtatcacctgctctggagatgcattgaccaaagcaatatgtacttatcggtaccagcagaacgcaggccacggccctgtcttgatctattaataagtactttggagacgggcctacgacgggtacccctagacgcgtacttctcgtgcctcgagtctcgagtacacaacgcgtacgtacgttacgacctactacgacggtaggtacgggtcccgggagtaagggacgggaaacggcggaccgttacggtaccttaacgttacgttcggttacgtacggttacctaacgtaccgaaacggtaaccgtaacgggtaaccgtaacggggtttcgggtaaacccgtttaaggtttacgtttaccgggttaccgttttaacgggggtttaccggggtaaccggggggttaaaccggggttaacccggttaacccggggttacccgtttaacccggggaaacccccggtttttacccggggtaaccgggttaacccggtaaacccccgggttcccccggtaaaacgggggttcccccccgg

SEQ ID NO: 21828 - DNA, 688 bp, Homo sapiens
  misc_feature: GYAE6OF02FVB0Z.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgctattgaccaaaagcaatatgcttacgtgtaccagacaagaacgccacggccgacggcccctgtcttgatctaatttaataaagtactttagaggacggcctacgacgggtacccctaggacgacgtatttctcgtggcctccacgtctcgaacgaccgaacaaacgacgtacgtaacgttacgaaccctaagtcgtaagggtcgggacggtcccgggacgaagggaacgggaacggacgggtactacgggtaactttaacgttaccgttacgttacgtaacggtctaagtacctaacggtaaccgtaggttacgggtcggtacttaaccgtttcgtttacggttaccgtttacggttccggggacggggtaaccgggtaacccgtaacggtacccggttaaccggtacccggttccgtacgggtaccggtacccgaaccggtaccccggtacggtcccccgg

SEQ ID NO: 21829 - DNA, 722 bp, Homo sapiens
  misc_feature: GYAE6OF02FV1G5.49.53.E09.1.454.CMB.1.raw
  modified_base (179)..(179): a, c, t, g, unknown or other
  misc_feature (179)..(179): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtntctgtgtcctcaggacagacggccagtatcacctgctcgtggagatgctattgaccaaaagcaatatgcttactggtaaccagacaagaacgccacggccacggcccctgtcgttgactctaatttaataaagtctttagaggagggtccctcgacgggtacccctgacgcgtattctcgtcggtcctaccagtcctacgacgaccgaaccaaacgtagtaccgtaacgttacgaaccgtaagtacgaagggtcgggacgggttacccgggagtaacgggaacgggacggacgggaccgtacgaaccttaagtttaaccgtgttaccgtaagtactacgtacgaacgtaacgtaagggttaccgtacgggtacctaccgttttacgtacgttacggtttacgttaccgggggtaccggtaaacggggtaaccctaaaccgggttcccggttaaccggttaaccccggttaccgggttaaccggggttacccgtaaacccggggtacccccggtaaacggggtccccgtttaaccccccggggg

SEQ ID NO: 21830 - DNA, 610 bp, Homo sapiens
  misc_feature: GYAE6OF02GTFY7.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaacgccacggccacggcccctgtcttgatactatttaataaagtactttgagacggcctacgacggaccctgagcgtattctcgtcggcctcacgctacgacgcgaaccaacgtacgtccgtaacgttcgaacctagtacgaggtcgggtacggtcccggagaacggaaggaacggacggcgttagtaacttaagtttactagtcctagtcaatcgaagtacgtaggttacgtcgtacttacgttgttcgttacgttacgttcgggacgggtaacggaaccgaacggtaccgtccggtaacccggttaccgtacggtaccgaccgggacccgtacggccgttaccccgg

SEQ ID NO: 21831 - DNA, 794 bp, Homo sapiens
  misc_feature: GYAE6OF02GTYEK.49.53.E09.1.454.CMB.1.raw
  modified_base (392)..(392): a, c, t, g, unknown or other
  misc_feature (392)..(392): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctggaggcctcctatgagctgacacacgcccacccgtgggtgtctgtcgtcctagaggacaggaccggccaagtactccacctgcctcgtggagtatgactagttcgaaccaaaagctaaattatgtacctttacgtacggtaaccagacaaggaacgccgacggtccacggccccttgtcttagattactaatttaagaaagtcgtttaggagacggtcctacgacgggacccctgagtcgtattccgngtcgctaccgacgtctagacgacgaacgaacctaggttacccgaacggtttaccgaccttaacgtacgtagggttacgggaaccggttccggggacgtaagggaacggggaccggtacgggtaccgttacggtaaaccgtttaacgtttaccggttacggttaaccgtaacgtttaccgaaccgtttaaccggaagggttaaccccggtaaagggtttacgggacccgttaaccgtttacccggtttaacgttccggggtttacgttttaacggggttccgggggtaaccggggtaaccgggtaaacccgttaacgggtcccggttaacgggtaacccccgtttaccgggttaccggtaaccgaccccgggtaaccggtacgggttccccgtaccccccggg

SEQ ID NO: 21832 - DNA, 357 bp, Homo sapiens
  misc_feature: GYAE6OF02GLM3W.49.53.E09.1.454.CMB.1.raw
  modified_base (349)..(357): a, c, t, g, unknown or other
  misc_feature (349)..(357): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgacgggacccctgagcgggctggcaaggcgcatagnnnnnnnnn

SEQ ID NO: 21833 - DNA, 177 bp, Homo sapiens; identical to SEQ ID NO: 20482
  misc_feature: GYAE6OF02GRRV3.49.53.E09.1.454.CMB.1.raw
  modified_base (173)..(177): a, c, t, g, unknown or other
  misc_feature (173)..(177): n is a, c, g, or t

SEQ ID NO: 21834 - DNA, 731 bp, Homo sapiens
  misc_feature: GYAE6OF02GIBFK.49.53.E09.1.454.CMB.1.raw
  modified_base (237)..(237): a, c, t, g, unknown or other
  misc_feature (237)..(237): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacagcccaccgtcggtgtctgtcgtcctcgaggacgacggaccggccaagtactccaccgtgcttcgtggganatgctagttcgaaccaaagacaaatgtacgacctttacgtcggtaccaggacaagaacgacccgtacggaccgtaccggtcccctgttcgttagacttactaatttaacgtaaacgttacgttaggaggacggtcctacggaccggtaccctggacgtcgtacttccgtcgtcggtcctaccgacgtccgtagacgtaacccgaactaaacccgtacggtaccttaaccggtaccgtaaccgtaaggttaccgtaggggtaacggggacccgggttaccgggaaacggtaacgggaaacgggaccgggtacgtacggttactaaccgtttattaccggtagtcgaagttacctaagtacgaagtacgtaggttacgggcgtttccgtacgttcggttacttacgggtacgtccggggtacgggaaccggtaacacgtaccgaccggttaccggtacgtacggtccgaacccggacgtacccggctacccccggg

SEQ ID NO: 21835 - DNA, 597 bp, Homo sapiens
  misc_feature: GYAE6OF02GCOHQ.49.53.E09.1.454.CMB.1.raw
  modified_base (224)..(224): a, c, t, g, unknown or other
  misc_feature (224)..(224): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggganatgcattcgaccaaagcaatatgtcttactggtaccagcaagaacgccgaggccacggcccctgtcttgactctatttaataaagtactttgaggacggcctacgacgggacccctaggacgcgtattctcgtggcctaccagctcgagacgacaacgtacgtactacgttgaccatcgaggtaggacggtccgggacaggaacggacggaggcgtagtacttagttacgttctacgtacgtacgatacgaagtacgaggtagtcggactactttcgttcgttcgttacgttcgggacggacgggaaccgtaggtccgtccgtaacccgttccgtacgggtccaaccggtacccgtaccggtcctacccccgg

SEQ ID NO: 21836 - DNA, 173 bp, Homo sapiens; identical to SEQ ID NO: 21443
  misc_feature: GYAE6OF02GCUCD.49.53.E09.1.454.CMB.1.raw
  modified_base (173)..(173): a, c, t, g, unknown or other
  misc_feature (173)..(173): n is a, c, g, or t

SEQ ID NO: 21837 - DNA, 187 bp, Homo sapiens
  misc_feature: GYAE6OF02HV1ZP.49.53.E09.1.454.CMB.1.raw
  modified_base (175)..(187): a, c, t, g, unknown or other
  misc_feature (175)..(187): n is a, c, g, or t
tcagagtcgagagacacgaccggtgctcgatttagagagagtgtgttgggtttgggggaagaggaagactgacggtcccccaggagttcgaggtgctgggcacagcggccctgggctgcctggtcaaaggactacttcctctctcgactctgagcgggctggcaaggcgcatagnnnnnnnnnnnnn

SEQ ID NO: 21838 - DNA, 627 bp, Homo sapiens
  misc_feature: GYAE6OF02GL7AO.49.53.E09.1.454.CMB.1.raw
  modified_base (221)..(221): a, c, t, g, unknown or other
  misc_feature (221)..(221): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctggtgtctgtgtcctcgaggacagacggcagtatcacctgctctggantgctattcgaccaaagctaatatgtacttacgtcggtaccagcgaagaacgccgacggccgaccggtcccgttgttcttgactactaagtttaataagtacgtttagaggacggctacgacggaccctgacgcgtattctcgtgcctacacgtctacgacgacgaacaacgtacgtacctaacggttacgacctacgtacgtagggtacgggtacggtaccgggagaacgggacggtacggacggtacgtacgtaacgttacgttacgtacgtctacgtactacgtacgacgaacgtaggtacgtacggtctaacgttcgtagtcgttacgtcgggtaacggtaggtaaacgacgtccgtaccgtaccggtacgtacggtaccgacgaccgtacgtccgtaccccg

SEQ ID NO: 21839 - DNA, 207 bp, Homo sapiens
  misc_feature: GYAE6OF02H9XMP.49.53.E09.1.454.CMB.1.raw
  modified_base (176)..(207): a, c, t, g, unknown or other
  misc_feature (176)..(207): n is a, c, g, or t
tcagagtcgagagacacgaccggtgctcgatttagagagagtgtgttgggtttggggggaagaggaagactgacggtcccccaggagttcaggtgctgggcacagcggccctgggctgccctggtcaaaggactacttcctctctcgactctgagcgggctggcaaggcgcatagnnnnnnnnnnnnnnnnnnnnnnnnnnnnnnnn

SEQ ID NO: 21840 - DNA, 182 bp, Homo sapiens
  misc_feature: GYAE6OF02G33DL.49.53.E09.1.454.CMB.1.raw
  modified_base (174)..(182): a, c, t, g, unknown or other
  misc_feature (174)..(182): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctctctcgactctgagcgggctggcaaggcgcatagnnnnnnnnn

SEQ ID NO: 21841 - DNA, 539 bp, Homo sapiens
  misc_feature: GYAE6OF02FMPA3.49.53.E09.1.454.CMB.1.raw
  modified_base (315)..(315): a, c, t, g, unknown or other
  misc_feature (315)..(315): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttaataaagactttgagagggcctnacgggacccctgagcgattctctggctccagctcagcgacaacagtcacgttgaccatcagtggagtccgggcagaggacgaggctgacttattactgtcagtcatcagacaggtagtggcacgttcgtgtcgtagttccgggacgggtaacgggaacccgaaaggcctacggtaacccgtcccgttaagggttccaacggccccgtaaaggtccgtaccccgg

SEQ ID NO: 21842 - DNA, 211 bp, Homo sapiens
  misc_feature: GYAE6OF02HCPXU.49.53.E09.1.454.CMB.1.raw
  modified_base (178)..(211): a, c, t, g, unknown or other
  misc_feature (178)..(211): n is a, c, g, or t
tcagagtcgagagacacgaccggtgctcgatttagagagagtgtggttggggtttgggggaaagaggaacgactgacggtccccccaggagttcaggtgctgggcacagcggccctgggctgcctggtcaaggactacttcctctctcgactctgagcgggctggcaaggcgcatagnnnnnnnnnnnnnnnnnnnnnnnnnnnnnnnnnn

SEQ ID NO: 21843 - DNA, 795 bp, Homo sapiens
  misc_feature: GYAE6OF02H6NSF.49.53.E09.1.454.CMB.1.raw
  modified_base (483)..(483): a, c, t, g, unknown or other
  misc_feature (483)..(483): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctcctatgagctgacacagcccaccctcggtgtctgtgtcctcaggacagacggccagatcactgctctggagatgcattcgaccaaagacaatatgtacttacgtcggtaaccagcgaagaacgccgaggccacggcccctgtcttagattacgtaatttaataaagtactttagaggacggcctcgaacgggaccctggacgtcgtacttccgtcgtcgggcctccgacgtccgtaccgacggaccgaaaccgtaaaccgtacgttaccgttacccggttacggaaccctaagttaccggaacgggttacggggtaaccgggtacccggggtanaaacggggtaccgggaacgggtaacgggtaccgttaacggttaaacctttaacgtttaccggttacgttaccgtaacggttaccttaacggttaccgtaaacggtaaaccggttagggtttaacggttccgggttaacccttaccgtttaccggtttacgttaccgggtttaccggttacccgggggtaccgggggtaacggtaaccccggttaagggccccggtttaaaccgggtaccccggttaccccggttaaaggggtccccgaacccgggtaaccccgtaccggggttccccgttaacccccccggg

SEQ ID NO: 21844 - DNA, 836 bp, Homo sapiens
  misc_feature: GYAE6OF02HNR2W.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacagccaccctcggtgtctgtcgtcctcaggacagaccggccagtactcaccgtgctcgtggagatgctattcgaccaaaagctaaatatgtaccttaactcggtaaccagacaagaacgccgaacggccgacggccccgtgtcttagtattactaattttaaagtaaagtacgttttagaggtacggcctacgaacgggaacccctggacgacgtacttccgtcgtacggtctccgagcctcgaacgaccgaaactaaaccgtacgtacgtaccgtttaccgaacctacgttaccggtaagggtacgggtaaccgggtacccgggggtaacgaaacggggtaccggggtaaacgggtaacggtaaccggttacggttaaaccttttaaacggtttaaccttacgggttaaccgtaaaccgtttacgtaacgttaccgtaaacgggtaacccggtaaagggttttaacgggtccgggttaacccttaccgttttaggtttaaccgggttttaaccggggtttacgggtttacccggggtacgggggaaaccggggtaaccccggttaaagggtacccggttaccgggtaaccccggtttaccccggtaaggggttaccccggtaaccccgggtaaccccggtttaaccggggccctttaaccccccccgggg

SEQ ID NO: 21845 - DNA, 173 bp, Homo sapiens; identical to SEQ ID NO: 20229
  misc_feature: GYAE6OF02H61KE.49.53.E09.1.454.CMB.1.raw
  modified_base (173)..(173): a, c, t, g, unknown or other
  misc_feature (173)..(173): n is a, c, g, or t

SEQ ID NO: 21846 - DNA, 739 bp, Homo sapiens
  misc_feature: GYAE6OF02HLRH5.49.53.E09.1.454.CMB.1.raw
  modified_base (228)..(228): a, c, t, g, unknown or other
  misc_feature (228)..(228): n is a, c, g, or t
  modified_base (535)..(535): a, c, t, g, unknown or other
  misc_feature (535)..(535): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgacggcctctatgagctgacacacgccacccgtcggtgtctgtcgtcctcgaggacagacggccagtatccacctgctcgtgganatgacattcgaccaaagctaatatcgtacttacgtcggtaccagcaagaacgccgacggaccgacggtcccctgtcgttagacttactaatttaaactaaagtacgtttggaacggtacgggctacggaccgggtacccctaggacggtacgtactttccgtcgtcgtctacctacggctacgacgaccgaacaactacgtacgtacgttacgacctactacgaaggttcggacggtaccgggacgtacggaacgggacggtacgggacttcggtaaacttacgtttaaccgtagtacgtaacggtntaaccgttaccaaacgggtaacgtaggttacggtacgtaaccgttacgttacgttacggtttaccggttacgggttaccggggtaccgggtaaaccggggtaaccaacgggttacccggttaaccgggtaaccccgtttacccgggtaaacgggttccccggaaacccggtacccgggtaaccgggttcccgtaaccccccggg

SEQ ID NO: 21847 - DNA, 183 bp, Homo sapiens
  misc_feature: GYAE6OF02HV513.49.53.E09.1.454.CMB.1.raw
  modified_base (173)..(183): a, c, t, g, unknown or other
  misc_feature (173)..(183): n is a, c, g, or t
tcagagtcgagagacacgaccggtgctcgatttagagagagtgtgttgggtttgggggaagaggaagactgacggtcccccaggagttcaggtgctgggcacagcggccctgtgctgcctggtcaaggactacttcctctctcgactctgagcgggctggcaaggcgcatagnnnnnnnnnnn

SEQ ID NO: 21848 - DNA, 745 bp, Homo sapiens
  misc_feature: GYAE6OF02H7FM3.49.53.E09.1.454.CMB.1.raw
  modified_base (220)..(220): a, c, t, g, unknown or other
  misc_feature (220)..(220): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgacggccctcctatgagctgaccacacgccctacccgtcggtgtcctgtcgtcctcgaggacaggaccggcagtacnccacctgctcgtaggagatgactagttcgaccaaagctaatagtcgtacttacgtacggtaaccagacgaagaacgccgacggccgaccggtcccctgtccgttagactactaagtttaaactaagtacgtttagacggacgggtaccctacggaccggtaccctggacgtcgtatccgtcgcggtcctaccgtagcctacgacgaccgaacgaacgtacggttaccgtaacgttacgaacccttacgtacgaagggttcggacgggtacccgggagaaacggggttaacgggaccgggaggtaccgtacggtacgtttaaacttccggttgtaaccggtacgttacgtaaccgtacgtaaccgggtaaactacgggttaacgtcgggtaacccttacggtttcgtaccggtttacggttaccggtttccggggacgggttaaccgggaaccgtaacggtccgttaacgtaccccggttacggtaccggtaccgaacgtaccccgtagggtccctaccccccggg

SEQ ID NO: 21849 - DNA, 195 bp, Homo sapiens
  misc_feature: GYAE6OF02FPO1G.49.53.E09.1.454.CMB.1.raw
  modified_base (175)..(195): a, c, t, g, unknown or other
  misc_feature (175)..(195): n is a, c, g, or t
tcagagtcgagagacacgaccggtgctcgatttagagagagtgtgttgggtttggggggaaggaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnn

SEQ ID NO: 21850 - DNA, 871 bp, Homo sapiens
  misc_feature: GYAE6OF02GPDDY.49.53.E09.1.454.CMB.1.raw
  modified_base (190)..(190): a, c, t, g, unknown or other
  misc_feature (190)..(190): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccacccgtcggtgtctgtgtccnaggacagacggccagtactcacctgctcgtaggagatcgcattcgaccaaaagcaaattatgtactttaacgtaggtaccagacgaagaaacgcccgaacggacccgaacgggcccccgttggttaccttgtaacttacgttaattttaaaagtaaaacggttacctttttaggaacgggtaacggggtcccttaccggaaccggggtaaccccctaggtaacggtaccggtaacgttttcccgttaccggttcgggtacccctttacccgaacggtacccgttaccgaacgggtaacccgtaaacctaaaaccgtacggtttaccctaacgggtttaccgaaccctaacgttacgaacgggtttaggggaaccggttaccccggggacgaaacggggaaagggaaccggaacgggtccggttaaacgaaccgttttaaagtttaaccgttacggttaaccgtaacggtttacaaactttaccgaacgggaaaccgtttaaggttacggggttaaccgtacgttaaacccgttttacgttcgggttaaccggtttcgggttaccggggaacggggttaaccgggaaaacccggtaaccggttggttaacccgggtaacccggtttacccgttacggggtaacccacccgggttaccccgaaccgggttctacccccccggg

SEQ ID NO: 21851 - DNA, 526 bp, Homo sapiens
  misc_feature: GYAE6OF02GAXZT.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctacgacgggacccctgagcgattctctggctcagctcagcgaacaacagtcacgttcgaccatcgaggtggacggtccgggacaggacggacgaggctagacttattactgtacagtcatacagacaggtagtggactacgttcgtgttcgtagttcgggcgggtaacggaccaggctacggaccgtcgaggtccgagcccgtaggcctacccgg

SEQ ID NO: 21852 - DNA, 184 bp, Homo sapiens
  misc_feature: GYAE6OF02GYY3C.49.53.E09.1.454.CMB.1.raw
  modified_base (175)..(184): a, c, t, g, unknown or other
  misc_feature (175)..(184): n is a, c, g, or t
tcagagtcgagagacacgaccggtgctcgatttagagagagtgtgttggggtttggggggaagaggaagactgacggtcccccaggagttcaggtgctgggcacagcggccctgggctgcctggtcaaggactacttcctctctcgactctgagcgggctggcaaggcgcatagnnnnnnnnnn

SEQ ID NO: 21853 - DNA, 176 bp, Homo sapiens; identical to SEQ ID NO: 20270
  misc_feature: GYAE6OF02FOXAG.49.53.E09.1.454.CMB.1.raw
  modified_base (173)..(176): a, c, t, g, unknown or other
  misc_feature (173)..(176): n is a, c, g, or t

SEQ ID NO: 21854 - DNA, 656 bp, Homo sapiens
  misc_feature: GYAE6OF02IEKUP.49.53.E09.1.454.CMB.1.raw
tcagagtcgagagacacgaccggtgctcgatttagagagagtgtgttgggtttgggggtggtccaggaggcagaactctgggtgtctcaccatggcctggatccctctacttctccccctcctcactctctgcacagactctgaggcctcctatgagctgacacagccaccctcggtgtctgtgtcctcaggacagacggccagtactcacctgctctggagatgcattcgaccaaagcaatatgactttacgtacggtaccagacacgaacgccgacggccacggcccctgtctgatctatttataatctttgacgaggcctcgacggtacccctgacgcgtacttcctcgtcggtaccgtccacgtcctacgacggaccgaaccaaacgtacgttaccgtaccggtttacgaaccctagtaccgtagggttacgggaccgggtccggggtacgaaacgggacggggtaaccggagggtaccgttacggtaacttaacttaccgtgtaccgtacggtcttaacgaccgtacgaacgtaggtacgtaggccttacgttcgttcggtacgttacgtccggggtacgggaacgggaacctacggccgtaccgtacccgtccgtaggtccgtaccggaccctacgggtcctacccccgg

SEQ ID NO: 21855 - DNA, 174 bp, Homo sapiens; identical to SEQ ID NO: 20960
  misc_feature: GYAE6OF02FKKJ8.49.53.E09.1.454.CMB.1.raw
  modified_base (174)..(174): a, c, t, g, unknown or other
  misc_feature (174)..(174): n is a, c, g, or t

SEQ ID NO: 21856 - DNA, 765 bp, Homo sapiens
  misc_feature: GYAE6OF02G3EPQ.49.53.E09.1.454.CMB.1.raw
  modified_base (185)..(185): a, c, t, g, unknown or other
  misc_feature (185)..(185): n is a, c, g, or t
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (422)..(422): a, c, t, g, unknown or other
  misc_feature (422)..(422): n is a, c, g, or t
tcagagtcgagagacacgaccggtgctcgatttagagagagtgtgttgggtttgggggtgggtccaggaggcagaactctgggtgtctcaccatggcctggatccctctacttctccccctctcactctctgcacagactcgtgacggcccttctagtgatcagacacgacgccctcccgtggtntctgtacgtccagagacaggccgacagtctaccacgtgctacgaggatngctagtacgaacaaantaaatctcgtacttacgtacgacagacgaacggtacncgaacgccgaccgtccgttnttcgtagactacttaagttaaagtaacgttcgttagggaacggtcggtccctaacgggtaccccgggtaccgtaggtaccgtacgttacctttccgtcggtacggtcctaaccgngtaccgtagaaccggacctaaacctaaggtcggttaccaagggtttaccaaccgtagtacggaagggtttccgggaccgggacggaaacggacggggaaccggtaacgggcggtaaccttacggtttaaaccttacgttacgtcgtaacgtcggtaactacggtaacgaccgtaagggtacggttaacgggtcctaacgtttccggttaagttccgggtaccggtttacgggacccggggaaacggttaacccggaacgtacccgttcggttaaccccggtaacccgttccgggtaacggtccgaaaccccgggtacggtcccgtacccgttaaccccccggg

SEQ ID NO: 21857 - DNA, 816 bp, Homo sapiens
  misc_feature: GYAE6OF02HITWP.49.53.E09.1.454.CMB.1.raw
  modified_base (135)..(135): a, c, t, g, unknown or other
  misc_feature (135)..(135): n is a, c, g, or t
tcagagtcgagagacacgaccggtgctcgatttagagagagtgtgttgggtttgggggtgggtccaggaggcagaactctgggtgtctcaccatggcctggatccctctacttctccccctctcactctctgcanagactctgaggcctctatgagctgacacgagccacccgtcggtgtactgtagtcctgaggacaggacggccagtatccaccgtgtcctcgtaggagatgactagttcgaccgaaagctaaattgtacgtacctttacgtacggtaaccgagacgaaggaacgccgacggaccgaccggccccttggtcgttagactacttaattaaacgtaaagttacgtttaggaacggtacgggtcccttacggaccggggtaacccccgtaggaccggtacgttaactttcccgtaacggttccggtacctacccgtaacggtcccttacgacggaacccgaacgaacgtacggttactaacgttccgaacctataccgtaggttcggacgggtcccgggagtaaacgggacggtaaccggaggtccgtaacggtaccgtttaacgttacccggtagttaccgtacggttacgaagttaacggtaacggaaccgttaaggttaaggttaccgggtaaccgtttaacgttcggtttaccgggttcgggttttaacggggttaccgggtaaccgggggttaaccgggaaccgttaaccggggtccgttaacccgggttaccccgggtttacgttaccggggtacccgaccgggtaaaccccgggttcggtaaccccgtttccccccgggg

SEQ ID NO: 21858 - DNA, 174 bp, Homo sapiens
  misc_feature: GYAE6OF02FJ7ZN.49.53.E09.1.454.CMB.1.raw
  modified_base (174)..(174): a, c, t, g, unknown or other
  misc_feature (174)..(174): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctctctcgactctgagcgggctggcaaggcgcatagn

SEQ ID NO: 21859 - DNA, 620 bp, Homo sapiens
  misc_feature: GYAE6OF02FXQTA.49.53.E09.1.454.CMB.1.raw
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgctattgaccaaagcaatatgcttactggtaccagcagaacgcaggccacggcccctgttcttgactctatttaataaagtactttaggaggacgggcccttacgacgggtacccctgacgcgtattctcgtcgctccacgctacgacgcgaacaacagtccgtacgttcgaacctntactaggtggacgtccggganaggacggacgaggtctacgacttagttactcgtactagttcacgtcgaacgtaacgaggttacggtaggccttaacgtttcgtacggtttacgttacggttcggggacgggtaacgggaaccctaaggtcccgtaggttaaccccggttccgttaacgggtaccaaccgggtaccccgtaaggtccccgtaccccggg

SEQ ID NO: 21860 - DNA, 774 bp, Homo sapiens
  misc_feature: GYAE6OF02IITLS.49.53.E09.1.454.CMB.1.raw
  modified_base (183)..(183): a, c, t, g, unknown or other
  misc_feature (183)..(183): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgacggccttcctatgagctgacacacgcccaccctcggtntctgtcgtcctgaggacagaccggcagtactcacctgctcgtggatatgctattcgaccaaaagcaaattactgtactttacgtacggtaaccagacaagaacgccgacggccgaccggtccccgttagttccgtttagtacttacctaagtttttaaaacgtaaacggtttacgttttagggaacgggtaacgggtacccgttaccgggaaccggggtaccccgttagggacgtaccgttactttccgtcgttcggacccttccgaacggtccgtacgtaaccggaccgaaaacctaaccgtacgttaaccttaaccggttacgaaccctacgttacggtaacgggttagggtacgggtcccgggaagtaacgggaacgggtaacggacggtcttaacggtacttaacttacgtcgttacgacgttactacgtacggactaggttacggtacggtacgtcttaccgttgttacggtttaccgttacggttcggggacgggtaaccgggtaaccgtacggttaccgttacgggtaacccgttacgggtaacgttcccgaaccggtacccgtaccgggcccttacccccggg

SEQ ID NO: 21861 - DNA, 122 bp, Homo sapiens
  misc_feature: GYAE6OF02IOHJC.49.53.E09.1.454.CMB.1.raw
  modified_base (122)..(122): a, c, t, g, unknown or other
  misc_feature (122)..(122): n is a, c, g, or t
tcagagtcgagagacacgaccggtgctcgatttagagagagtgtgttgggtttggggggaagaggaagactgacggtccccccaggagttcaggtgctgggcacagcggccctgggctgccn

SEQ ID NO: 21862 - DNA, 175 bp, Homo sapiens; identical to SEQ ID NO: 21678
  misc_feature: GYAE6OF02F3A1H.49.53.E09.1.454.CMB.1.raw
  modified_base (174)..(175): a, c, t, g, unknown or other
  misc_feature (174)..(175): n is a, c, g, or t

SEQ ID NO: 21863 - DNA, 653 bp, Homo sapiens
  misc_feature: GYAE6OF02G89G1.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtactcgacctgcttctggagatgcattgacctaaaagcaatatgcttactggtaccagcagaagccaggccacgccctgtcttgatctatttaataaagtactttagagtagggtcctcgacggacccctagacgcgattcgtctacggctaccagtcctacgagtccgaacaacgtacgtacctaacgtttacgaaccctagtacgtaagtcgggtacggtcccgggacgtaaacgggagggaaaccggaggtaccgtcgtaaacgttaacgttacgttacgtaccgtacgttacgtaacttcgaagtacctaaggttaggtacggacttacttcgtacgtttacgttacggttcgggtacgggtacgggtaacccgtaaggtccgtaacgtacccggttacgtacgggtaccaccgggtaacccgtacggtacccgttacccccgg

SEQ ID NO: 21864 - DNA, 656 bp, Homo sapiens
  misc_feature: GYAE6OF02IVRKC.49.53.E09.1.454.CMB.1.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (371)..(371): a, c, t, g, unknown or other
  misc_feature (371)..(371): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccacccttggtgtctggtgtcctcgaggacagacggccagtancacctgctactgganatgctattcgaccaaagcaattatgtacttacgtacggtaccagacagaacgccgaggccgacggtcccctgttctgattactaatttaataaagtactttaggaggtacgggctacgacgggtacccctggacgtacgtattccncgtcggccttaccgagtcctacacgacgtacaacgtacgtaccgtacgttcgacctagtacagggtcggacgtccgggacacgggacggacggacgtgttacgtaattacgttacgtacgtcgtagtacaccgttacgacgtacgtaacggttagtaccgtcgtaaccttgttaacgttccggttagttacccggggtaggggaaccgtaaccggtactacggtacccgttacggttcccgtaaggtacccgtaccggacccgtaacggtccccgttaccccggg

SEQ ID NO: 21865 - DNA, 599 bp, Homo sapiens
  misc_feature: GYAE6OF02HM21D.49.53.E09.1.454.CMB.1.raw
  modified_base (220)..(220): a, c, t, g, unknown or other
  misc_feature (220)..(220): n is a, c, g, or t
  modified_base (301)..(301): a, c, t, g, unknown or other
  misc_feature (301)..(301): n is a, c, g, or t
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgaggcctctatgagctgacacagccaccctcggtgtctgtgtcctcaggacagacggccagtatcacctgctctgganatgctattcgaccaaaagcaaatatgcttactggtaccagacagaagccaggccacggcccctgtctgatctattaataanactttgagaggctcgacgggacccctgacgcgattctctcggctccagctcgacgccgaacaacacgtctacgttacgaaccatcgaaggtgggacgtccgggacaggacggacgaggcgtagtaactacttaacgtgtacgtagtacgtaattacgaagacgaggttaacgcggtacctacttcgttcgttacgttacgttacggggaccggaacgggtacccaaagggtcccttacgggacccggttaccggttacgggtacccgaaccggacccgtaacgggtaccctcccccgg

SEQ ID NO: 21866 - DNA, 179 bp, Homo sapiens
  misc_feature: GYAE6OF02HR63V.49.53.E09.1.454.CMB.1.raw
  modified_base (174)..(179): a, c, t, g, unknown or other
  misc_feature (174)..(179): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 21867 - DNA, 684 bp, Homo sapiens
  misc_feature: GYAE6OF02HH89O.49.53.E09.1.454.CMB.1.raw
  modified_base (233)..(233): a, c, t, g, unknown or other
  misc_feature (233)..(233): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacagcccaccctcggtgtcttgtcgtccctcaggacaggaccggccagtactccactgccttcgtgganatgacctattcgaccaaagcaattatcgtacttacgtacggtaaccagacagaacgccgacggcccgacggtcccctgtccttagactctaatttaataaagtacgtttggaggacgggtccctcgaaccgggacccctggacgcgtacgttctcgtcgcctccgcgtctacgacgaccaacgtaacacgttaccgtacgtacgacctagtcgtagggtcgggtaccggtcccgggagacgggaacggacgggtaacggtcgtacgttaacttacgttcgttcgtaccgagttacacgttaccgaaggactaggttaggtacgtccgttacttagtcggttacggtacggttccgggggaccgggtaacggggaaccctacggggtccgtacccggtacccggttacgtacggcccgtaaccgggtacccggacggttccccgtaccccgg

SEQ ID NO: 21868 - DNA, 693 bp, Homo sapiens
  misc_feature: GYAE6OF02IQI1G.49.53.E09.1.454.CMB.1.raw
  modified_base (182)..(182): a, c, t, g, unknown or other
  misc_feature (182)..(182): n is a, c, g, or t
tcagagtcgagagacacgaccggtgctcgatttagagagagtgtggttgggtttggggtggtccaggaggcagaactctgggtgtctcaccatggcctggatccctctacttctcccccctcctcactctctgcacagactctgaggcctcctatgagctgacactagcccacccgtcggtntctggtacgtcctcgaggacaggacggccagttactccaccgtgcttctggagattcgacctaagttcggaccaaaagtcctaattactgtcttacgtcggtaccagtcagaacgccgacggccacggtcccctgtcttgatctaagtttaataaagtacgtttggaacggtacggccctcgaacgggacccctaggtacgtacgtacttccgtcgtacggccgtaccacgtcctacgaacgccgtaaccaacgacgtacgtaacggttcgaacctagtaccgtagggtcgggtacggtcccgggacgtaacgggaacgggtacggacgggtccgtacggtaacctttacgttaccgttcgtacctaacgttccaacttaccggagaaccgtaggtaacgtcggtacctacgttacgtcgtttacgtacgttacgggcgggtaacggtaaccgtacggtcctacggtacccgttacggtacggtccaccggtacccacggtccctccccgg

SEQ ID NO: 21869 - DNA, 585 bp, Homo sapiens
  misc_feature: GYAE6OF02I1FVO.49.53.E09.1.454.CMB.1.raw
  modified_base (134)..(134): a, c, t, g, unknown or other
  misc_feature (134)..(134): n is a, c, g, or t
  modified_base (190)..(190): a, c, t, g, unknown or other
  misc_feature (190)..(190): n is a, c, g, or t
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (301)..(301): a, c, t, g, unknown or other
  misc_feature (301)..(301): n is a, c, g, or t
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
tcagagtcgagagacacgaccggtgctcgatttagagagagtgtgttgggtttgggggtggtccaggaggcagaactctgggtgtctcaccatggcctggatccctctacttctccccctctcactctctgcanagactctgaggcctctatgagctgacacagcccaccgtcggtgtctggtcgtcctnaggacaggacggccagtancacctgctntggganatgacattcgaccaagcaatntncttaacgnggtaccagcagaacgccaggccagcccctgtctagatctaatttanaaagtcgtttaggagtagggcctagaccggtacccngacgcgtattcncgtacggcctacganctacgacgccgaanacgagtccacgttnaccatcgaagtcggaggtccgganaggacggtacggacggactacgtacttagttactgtactacgtacagttaccagtacgaggtttaacgtcgtactaacgtttctacggttcgttacgtcgggaccgggtaaggaaccccgaggtctacggtacgtcgtacggtacgaccacggtaccgccgtaccccgg

SEQ ID NO: 21870 - DNA, 180 bp, Homo sapiens
  misc_feature: GYAE6OF02I46GX.49.53.E09.1.454.CMB.1.raw
  modified_base (174)..(180): a, c, t, g, unknown or other
  misc_feature (174)..(180): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctctctcgactctgagcgggctggcaaggcgcatagnnnnnnn

SEQ ID NO: 21871 - DNA, 190 bp, Homo sapiens
  misc_feature: GYAE6OF02FJC3M.49.53.E09.1.454.CMB.1.raw
  modified_base (174)..(180): a, c, t, g, unknown or other
  misc_feature (174)..(180): n is a, c, g, or t
  modified_base (182)..(190): a, c, t, g, unknown or other
  misc_feature (182)..(190): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnnnncnnnnnnnnn

SEQ ID NO: 21872 - DNA, 615 bp, Homo sapiens
  misc_feature: GYAE6OF02I3FEM.49.53.E09.1.454.CMB.1.raw
  modified_base (410)..(410): a, c, t, g, unknown or other
  misc_feature (410)..(410): n is a, c, g, or t
  modified_base (499)..(499): a, c, t, g, unknown or other
  misc_feature (499)..(499): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtactcacctgctctggagatgctattcgaccaaaagcaattatgtccttaactcggtaaccagacaaggaacgccgacggccgacggtccccttttcttacgacttactaatttaataaagtacgtttagaggacgggccttacgacgggtacccctgacggtcgtattcctcgtggcctccacggctcgacgacgaacaaacncgtactacgtcgacctagtacaggtcggacggtccggacgagacgggacggacggctaggtacttacttactgtacagtcatacagtanaggtagtgtaccgtattctcgttacgttaggtacgggcggtacggaacggacgtcgtccggtaccgttaccggtcggtaccgaccgaccggtaccggtaccgtccggttcccccgg

SEQ ID NO: 21873 - DNA, 656 bp, Homo sapiens
  misc_feature: GYAE6OF02IQBBQ.49.53.E09.1.454.CMB.1.raw
  modified_base (250)..(250): a, c, t, g, unknown or other
  misc_feature (250)..(250): n is a, c, g, or t
  modified_base (351)..(351): a, c, t, g, unknown or other
  misc_feature (351)..(351): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgacggcctcctatgagctgaccacacgcccacccgttcgggtctctggtcgtccctacgacggaccaacggccggaccaggtactccacctggtccttcgaggganatggactagttacgaccaaaagacaatatgtacttacgtcggtaccagacgagaacgccgacggccacggcccctggtactgatactattaaagtaacgtnttaggagacgggtcctcgtacgggtaccccaggtacgactacgttcgtcgtcggcctaccgacgtcgtcgacgtacgaactaacgacgtactacggtacacactcgtaaggcggtacggtccggagaacgggacgggacggtacggagttcgtaacttacgttcgtagttacgaagtcagtacgacggtagtacgtacgtaggtccttagtcgttacgttcgttacgtcgggtacgggaacggtacctagaccggttctaccgggtacccgtggtaccgcggacccggtacgacccgttccccgg

SEQ ID NO: 21874 - DNA, 783 bp, Homo sapiens
  misc_feature: GYAE6OF02I5YYJ.49.53.E09.1.454.CMB.1.raw
tcagagtcgagagacacgaccggtgctcgatttagagagagtgtgttggggtttgggggtgggtccaggaggcagaactctgggtgtctcaccatggcctggatccctctacttcctcccctcctcactctctgcacagactctgaggcctctatgagctgacacacgcctacccgtggtgtctgtacgtcctagaggacaggaccggccagtactccaccgtgcttcgtaggatatcgctaattcgaaccaaaagtctaattagtgtacctttacgtacggtaaccagacagtaaccgcgacggacctaccgggtccccttaggtaccttagtaaccttacgttaattttaaaacgtaaacggttacgtttacggaaggtaaccgggtccgtacccgggtaaccggggtaccccgtaaggtaccggacgtttacctttccgtaccggttcgggcctaccgtagcccgttaagacggtaccaaaccgtactacggtaccctaacggtacgaactacgtcggtaaggtaccgggtcggtacccgggagacgggaaacggtacggacggttacgtaagttaacgtttaacgtccgtacgttactaccggtataacgttacggaacgtagttacgggttaacggtcttaaccgttcgttaccggttcggttaacggtttacggtaccggggaacgggtaaccgggaacctaaacgggtcctaccggttaccggttaccgtacgggtaccgaacccgggtacctaccggggtccctaacccccgggg

SEQ ID NO: 21875 - DNA, 183 bp, Homo sapiens
  misc_feature: GYAE6OF02F5PA8.49.53.E09.1.454.CMB.1.raw
  modified_base (174)..(183): a, c, t, g, unknown or other
  misc_feature (174)..(183): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnnnnnnn

SEQ ID NO: 21876 - DNA, 186 bp, Homo sapiens
  misc_feature: GYAE6OF02FYR7X.49.53.E09.1.454.CMB.1.raw
  modified_base (175)..(186): a, c, t, g, unknown or other
  misc_feature (175)..(186): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatagnnnnnnnnnnnn

SEQ ID NO: 21877 - DNA, 177 bp, Homo sapiens
  misc_feature: GYAE6OF02GX9TI.49.53.E09.1.454.CMB.1.raw
  modified_base (172)..(177): a, c, t, g, unknown or other
  misc_feature (172)..(177): n is a, c, g, or t
tcagagtcgagagacacgaccggtgctcgatttagagagagtgtgttgggtttgggggaagaggaagactgacggtcccccaggagttcaggtgctgggcacagcggcctgggctgcctggtcaaggactacttcctctctcgactctgagcgggctggcaaggcgcatagnnnnnn

SEQ ID NO: 21878 - DNA, 178 bp, Homo sapiens
  misc_feature: GYAE6OF02FRZ1R.49.53.E09.1.454.CMB.1.raw
  modified_base (175)..(178): a, c, t, g, unknown or other
  misc_feature (175)..(178): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatagnnnn

SEQ ID NO: 21879 - DNA, 178 bp, Homo sapiens
  misc_feature: GYAE6OF02I6TAY.49.53.E09.1.454.CMB.1.raw
  modified_base (171)..(178): a, c, t, g, unknown or other
  misc_feature (171)..(178): n is a, c, g, or t
tcagagtcgagagacacgaccggtgctcgatttagagagagtgtgttgggtttgggggaagaggaagactgacggtcccccaggagttcaggtgctggcacagcggccctgggctgcctggtcaaggactacttcctctctcgactctgagcggctggcaaggcgcatagnnnnnnnn

SEQ ID NO: 21880 - DNA, 702 bp, Homo sapiens
  misc_feature: GYAE6OF02H0EDU.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccacccgtcggtgtctgtgtccctacaggacagacggccagtactcaccctgctcgtggagatgactattcgaccaaaagcaaagttatgtccttacgtaggtaaccaggacaaggaaacgccgaaggcccaccgggtccccttaggttccgttagacttactaagttttaaagtaaacggttaactttgggaacggtacggtccctacggaaccgggtaccccgtgaggtaccgtatttcccgtcgttcgggcctaccgaacgtcttacgagtaccgaaacaacgtacgtacgtaccggttcaacctagtaccgagggttcggacgggtacggagaacgggtacgggacgggaggttacgtaaccggtaactttaacgtttacgtacggtactacggttactaaccgtagacgtacgtaggtacggtacgactccgttagttggtaccgttagttcgggacggtaacggtaccaagtacccgtagtacccggttccggtaggtacccaccggtaccgacggttccctccccgg

SEQ ID NO: 21881 - DNA, 602 bp, Homo sapiens
  misc_feature: GYAE6OF02FUGXK.49.53.E09.1.454.CMB.1.raw
  modified_base (191)..(191): a, c, t, g, unknown or other
  misc_feature (191)..(191): n is a, c, g, or t
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
  modified_base (406)..(406): a, c, t, g, unknown or other
  misc_feature (406)..(406): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctnaggacagacggccagtatccactgctctggagatgcagttgaccaaagcaatatgcttactggtaccagcaagaagccaggccacggcccctgtccttgatctatttaanaaagtctttagagaggcctacgacgggacccctgagcgtattcgtcgtcgctccagctcacgcgacaacgngtacacgtcgacctatcgagtggacggtccgggngaaggacggacgacggcttaggacttagttaccgtgtactagtactatacgagtacgtacggtaggtacgtccttacgtttcgtcggttcggttaggttccgggaccgggtaacgggtaccctaagggtccgttacggtaacccggttaccggttacgggtaccaccgggacccctaagggtcccttacccccggg

SEQ ID NO: 21882 - DNA, 655 bp, Homo sapiens
  misc_feature: GYAE6OF02HNKCW.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtcgtcctcaggacagacggccagtactcacctgctcgtaggagtatgactagttcgacctaaaaggcaaattatcggacttacgtcggtaaccagacgaagaagccacggccacggcccctgtctgatctaatttaataagtactttgagaggacctcgacggacccctgacgtcgtacttctacgtcggactccgaacgctacagcgaaccaacgacgtacacgttacaacgattaccgagggttcggaacgggttccgggacaacgggtacgggaacggaggccgttaaggacgttaacgtttaacgtcggttacgacgttaccaagttacgaacgaacgtagggtacggttcgacgttacttagtcgttacgttacggttcgggtacgggaacggaaccgtaacggtcgttaccggtacccgttacgttacgggcccgtaacggaccccgtacgggtccctaccccggg

SEQ ID NO: 21883 - DNA, 744 bp, Homo sapiens
  misc_feature: GYAE6OF02F5GW8.49.53.E09.1.454.CMB.1.raw
  modified_base (499)..(499): a, c, t, g, unknown or other
  misc_feature (499)..(499): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgctattgaccaaaagcaaatatgtcttacgtggtaaccagacaagaagcccaggcccgacggccccctgttccttgacttactaatttaacgttaaaggtacttttaggaaggaccgggcctaccggaaccggggtaacccccgttggacggtaccggtactttccgtcgttacgggcccttacgacgtccgttagacggtaccggaaacctaaacgtacgttaccgaccggttacaaccctagtaccgtaaggtcgggaacggttcccggggntaaaggggaacgggaacgacgggtacgttaagtaacctttaagttaccgtgtaccgtagtacgtactacaaggaccgttaaggttggtacgggtccttacgttcgttacgggttcggtttaccgttacgggggaccggggaaacgggtaacccgttaacggtcccggttacggttaccccggttaccgggttacggtacccggaaccggtaccccggttaaaccgggtcccgttaccccccgggg

SEQ ID NO: 21884 - DNA, 178 bp, Homo sapiens; identical to SEQ ID NO: 21878
  misc_feature: GYAE6OF02FZTD2.49.53.E09.1.454.CMB.1.raw
  modified_base (175)..(178): a, c, t, g, unknown or other
  misc_feature (175)..(178): n is a, c, g, or t

SEQ ID NO: 21885 - DNA, 201 bp, Homo sapiens
  misc_feature: GYAE6OF02GVMLZ.49.53.E09.1.454.CMB.1.raw
  modified_base (175)..(175): a, c, t, g, unknown or other
  misc_feature (175)..(175): n is a, c, g, or t
  modified_base (181)..(201): a, c, t, g, unknown or other
  misc_feature (181)..(201): n is a, c, g, or t
tcagagtcgagagacacgaccggtgctcgatttagagagagtgtgttgggtttggggggaacgaggaagactgacggtccccccaggagttcaggtggctgggcacagcggccctgggctgcctggtcaaggactacttcctcgtctcggactctcgagcgggctgggcaaggcncatagnnnnnnnnnnnnnnnnnnnnn

SEQ ID NO: 21886 - DNA, 705 bp, Homo sapiens
  misc_feature: GYAE6OF02GCQRL.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctcgtggagatgctattgaccaaagcaaatatgacttactggtaccagacagaagccgaggccacggcccctgtcttgatacctattttaataaagtactttaggagacgggcctcggacgggtaccccgtgacgcgtaacttctcgttacgggcctccgagtccctacgacggaccgaaccaaaccgtacggtaccctaacgggtttcgaaaccctagtaccggtaggtcgggtaccgggttacccgggacgaaacgggacgggaaccggtacgggtaccgttaggtaaacccgtttagtttaaaccgtcggttactaacggttaccaagttaccggaagaaccgttaaggttagggtacggtacctacgtttgttaccgttcggtttacggtcccggggtagggaaccggggtaaccctaacgggccgttaacggaccgttccggtaacggtaccgccgtaaccccggtagggcccttaaccccccggg

SEQ ID NO: 21887 - DNA, 175 bp, Homo sapiens
  misc_feature: GYAE6OF02HKXDA.49.53.E09.1.454.CMB.1.raw
  modified_base (169)..(175): a, c, t, g, unknown or other
  misc_feature (169)..(175): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacacgnnnnnnn

SEQ ID NO: 21888 - DNA, 596 bp, Homo sapiens
  misc_feature: GYAE6OF02FZ8HH.49.53.E09.1.454.CMB.1.raw
  modified_base (441)..(441): a, c, t, g, unknown or other
  misc_feature (441)..(441): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacaggacggccagtactcacctgctctggagatgctattgaccaaagcaatatgcttactggtaccagcagaagccgaggccacggccctgtctgactctaattaataaagtactttggagtacggcctacgacgggtaccccgtgacgcgtacttctcgtggcctccgacgtctcgagtaccgaacctaaacagtactacggttcgaaccctagtcaggtaggacggtccgggacaggacggacggnggctagacttacttactgtactagtctagtacgaagtacaggttagtcggacctacgttcgtgtaccgttaggttccgggacggtaacgggacctaacggtcgtaccggtaccgttacgtacggtacgaccggaaccgtaggtccctaccccggg

SEQ ID NO: 21889 - DNA, 183 bp, Homo sapiens
  misc_feature: GYAE6OF02G17ZY.49.53.E09.1.454.CMB.1.raw
  modified_base (174)..(183): a, c, t, g, unknown or other
  misc_feature (174)..(183): n is a, c, g, or t
tcagagtcgagagacacgaccggtgctcgatttagagagagtgtgttgggtttggggggaagaggaagactgacggtcccccaggagttcaggtgctgggcacagcggccctgggctgcctggtcaaggactacttcctcgtagcactctgagcgggctggcaaggcgcatagnnnnnnnnnn

SEQ ID NO: 21890 - DNA, 727 bp, Homo sapiens
  misc_feature: GYAE6OF02I1SN2.49.53.E09.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
  modified_base (461)..(461): a, c, t, g, unknown or other
  misc_feature (461)..(461): n is a, c, g, or t
  modified_base (643)..(643): a, c, t, g, unknown or other
  misc_feature (643)..(643): n is a, c, g, or t
tcagagtcgagagacacgaccggtgctcgatttagagagagtgtgttgggtttgggggtgggtccaggaggcagaactctgggtgtctcaccatggcctggatccctctacgttcctccccctcctcactctctgcacagactctgaggcctcctatgagctgacactagccaccctggtntacctgtgtccctnaacggtacaggaccgggcctaagtactccgaaccttgcccttgtagggaagtctcgactattcggaacctaaaagctaattactgtccttaacgtcggtaccagctaagaacgtcccgaggacccgacggtccccgtgttacttcggaagtccttaagtttaaacgaaacttacggttggacggtaacgggtaccctacggtacggaccccgttaggacgtacccgtaattcccgttcgtaccgggttccctaccggtagtcctanacggtacgaaccaaaccgtcggtaaccttaaccggttcgacgtaaccttacgtaagtccggtacggtaccgacggtacggaacggttacggacggtccttaggtaaccttagttaccgtcggtacgtaactcggtaactaccggttacgaacgtacgttagccgttaaccgattttacccgngtttacgtaccgtcggtacggtaacgtaccgtcgtaccgtaccggtaccggtactacggcgtcccggtaaccagtcccgtacgg

SEQ ID NO: 21891 - DNA, 721 bp, Homo sapiens
  misc_feature: GYAE6OF02GD2IF.49.53.E09.1.454.CMB.1.raw
  modified_base (227)..(227): a, c, t, g, unknown or other
  misc_feature (227)..(227): n is a, c, g, or t
tcagagtcgagagacacgaccggtgctcgatttagagagagtgtgttgggtttgggggtgggtccaggaggcagaactctgggtgtctcacaatggcctggatccctctacttctccccctcctcactctctgcacagactctgaggcctcctatgagctgacacagccaccctcggtgtctgtctcctcgaggacaggacggccaagtactcactgcttcgtgganatgctagttacgaaccaaagcaattatcgtacttacgtcggtaccagacaagaacgcccgaggacccgacggcccctgtcttgacttactaatttaagtaaagttctttaggaaggtacgggtacctaccggaccgggtaccccgtgacggcgtactttaccgtcgttcggccttaccgacgtcctacgaaccgaccgaaacgtaaccgtaacgttccgtaacgttacggaaccctacgttacgagggttacgggccgggttacccgggcgaaagggtaccgggacggacgggacgttagtaacctttagttacgttcgtactagtcgtactacgacgtaacgtaggttacggtacgtacgttaccgttcggttcgttaccgttagggttacccggggacggggtaaccggtaaccgaacgggtccgtacggtaaccccggtttaccgtacgggtaccccgtaaccggcccggaacggttcccgttccccccgg

SEQ ID NO: 21892 - DNA, 190 bp, Homo sapiens
  misc_feature: GYAE6OF02GJYAB.49.53.E09.1.454.CMB.1.raw
  modified_base (176)..(190): a, c, t, g, unknown or other
  misc_feature (176)..(190): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgacatagnnnnnnnnnnnnnnn

SEQ ID NO: 21893 - DNA, 180 bp, Homo sapiens; identical to SEQ ID NO: 21408
  misc_feature: GYAE6OF02GGO3O.49.53.E09.1.454.CMB.1.raw
  modified_base (173)..(180): a, c, t, g, unknown or other
  misc_feature (173)..(180): n is a, c, g, or t

SEQ ID NO: 21894 - DNA, 738 bp, Homo sapiens
  misc_feature: GYAE6OF02G4OHR.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcactgctctggagatgcattgaccaaaagcaaatatgtcttacgtggtaaccagcagaacgccaggccacggcccctgtctgatactatttaataaagtactttgagacggtcctacgacgggtacccctgacgcgtacttccgtcgtcggcctccacgtcctacgacgtaccgaactaaaccgacggttaccgtaacggtttacgaacccgtaagtaccgtaacgggttacggggtaacccggggttacccggggaacgaaggggaaaccggggaaccgggtaacggggtccgttaaacgggtaacctttaacgtttaccgttacggttacgtaacgggttactaacggttaccgaagaaacgttacgggttaacggtcggtaccttaacgtttccgttacggttaccgttaccggttccgggggtaccggggtaacgggaaccgtaacgggtcccgtaaccgggtacccggttcccgttaacggggtcccgaaccgggtaccccggtaacggtcccgttccccccggg

SEQ ID NO: 21895 - DNA, 198 bp, Homo sapiens
  misc_feature: GYAE6OF02HK1EE.49.53.E09.1.454.CMB.1.raw
  modified_base (171)..(171): a, c, t, g, unknown or other
  misc_feature (171)..(171): n is a, c, g, or t
  modified_base (177)..(198): a, c, t, g, unknown or other
  misc_feature (177)..(198): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctcgtcgacttctgagcgggtctggacaaggcntatagnnnnnnnnnnnnnnnnnnnnnn

SEQ ID NO: 21896 - DNA, 185 bp, Homo sapiens
  misc_feature: GYAE6OF02IYN2K.49.53.E09.1.454.CMB.1.raw
  modified_base (173)..(185): a, c, t, g, unknown or other
  misc_feature (173)..(185): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggctacttcctctctcgactctgagcggctggcaaggcgcatagnnnnnnnnnnnnn

SEQ ID NO: 21897 - DNA, 727 bp, Homo sapiens
  misc_feature: GYAE6OF02HJ6F5.49.53.E09.1.454.CMB.1.raw
  modified_base (177)..(177): a, c, t, g, unknown or other
  misc_feature (177)..(177): n is a, c, g, or t
  modified_base (571)..(571): a, c, t, g, unknown or other
  misc_feature (571)..(571): n is a, c, g, or t
tcagagtcgagagacacgaccggtgctcgatttagagagagtgtgttgggtttgggggtggtccaggaggcagaactctgggtgtctcaccatggcctggatccctctacttctcccctctcactctctgcacagactctgaggcctcctatgagctgacacacgccacccgtggtntctgtcgtcctcgaggaccaggaccggcagtactccaccgtgtctcgtggagtatcgacctaagttccggaacccaaaagtcctaaaagttagtcgtaccgttttaacgttacgggtaaccaggaacaacggaacgacccgacgggacccgacccggtccccgttgttccgtttagtaacttacgttaatttaaacgtaaagttacgtttaggacgggtacggtccgtacggtaccgggtacccctggaccgtcgtactttcgtccgtcggcctacgacgtcctacgacgaaccgtaacgaacgtacgtacgtacttacgaacgtacgtacgtaggtaccggacgtcggacgaagggtcggaacggtcgacttagtaactttacgtctagtacncgttaacatacgaagtacgtaaggttcgacgttaccttacgttccgttgttaaccggttggttaccggggtcggaaaccgggactacgggttcgtaacccggtaccggttacggttaccggtcctaaccggtcccggaccgtcccgttacccccgg

SEQ ID NO: 21898 - DNA, 196 bp, Homo sapiens
  misc_feature: GYAE6OF02ISXM4.49.53.E09.1.454.CMB.1.raw
  modified_base (178)..(196): a, c, t, g, unknown or other
  misc_feature (178)..(196): n is a, c, g, or t
tcagagtcgagagacacgaccggtgctcgatttagagagagtgtgttgggtttgggggaagaggaagactgaccggtcccccaggagttcaggtgctgggcacagcggccctgggctgcctggtcaaaggactacttccctctctcgactctgagcgggctggacaaggcgcaatagnnnnnnnnnnnnnnnnnnn

SEQ ID NO: 21899 - DNA, 194 bp, Homo sapiens
  misc_feature: GYAE6OF02IWIWF.49.53.E09.1.454.CMB.1.raw
  modified_base (176)..(194): a, c, t, g, unknown or other
  misc_feature (176)..(194): n is a, c, g, or t
tcagagtcgagagacacgaccggtgctcgatttagagagagtgtgttgggtttgggggaagaggaagactgaccggtccccccaggagttcaggtgctgggcacagcggccctgggctgcctggtcaaggactacttccctctctcgactctgagcgggctggcaaggcgcatagnnnnnnnnnnnnnnnnnnn

SEQ ID NO: 21900 - DNA, 760 bp, Homo sapiens
  misc_feature: GYAE6OF02GRVHD.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtactcacctgctctggagatgcattgcaaagcaatatgcttactggtaccagcagaagccaggccacggcccctgtctgactctaatttaataaacgtactttaggaacggtagggtccctaccggaaccggggtacccccgttaggacggtaccggtactttacccgttcgttacgggtcccttaacccgaaggtcccttacgaacggacccgaaaccgtaaaaccgtaggttaccctaaacgggtttccgtaaaccctaaacgtacccgtaaggggttacgggaaccgggttcccggggaacgtaaacgggaaccggggtaacgggacgggtaccggttacggtaaacccttaaacgtttaccgttacggttacctaacgggttactaacgttacgaaacggtaccttaaagggtagttaccggacttaaccgtttgttaccgttaccggttagtttcccggggacggttaacgggaacctaacggtcgtaccggaacccgtttacggtaccggttacccgaacggtaccccgaaggtcccggttacccccgg

SEQ ID NO: 21901 - DNA, 202 bp, Homo sapiens
  misc_feature: GYAE6OF02I6UY4.49.53.E09.1.454.CMB.1.raw
  modified_base (173)..(202): a, c, t, g, unknown or other
  misc_feature (173)..(202): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnnnnnnnnnnnnnnnnn

SEQ ID NO: 21902 - DNA, 197 bp, Homo sapiens
  misc_feature: GYAE6OF02F224I.49.53.E09.1.454.CMB.1.raw
  modified_base (175)..(197): a, c, t, g, unknown or other
  misc_feature (175)..(197): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatagnnnnnnnnnnnnnnnnnnnnnnn

SEQ ID NO: 21903 - DNA, 813 bp, Homo sapiens
  misc_feature: GYAE6OF02HEF3O.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacagccctacccgttggtgtctgtcgtcctcgaggacagacggccagtatccgacctgctcgtggagtatgctattcgaccaaagctaattagtcgtcctttaacgtcggtaccaggaccaaggaacgccgacggcccgacggtccccttggtcttgacttctaatttaataacgtacgtttaggaacggtcgggtacctaccggacgggtacccccgtggacgtcgtactttccgtccgtacgggccttccgacggtcctacgaacgaccgaaccgaacgtacgtaccgtacgttaccgtactaactcggtaagggtcggtaccgggtacccgggaggtaaacgggaccggggtaacgggtacgggtaccttaacggtttaaccgttaaacgttttaccggtccggttaaccgttaacggttaacctccggttaaacgttaccggaacggtttaaacgggttcgggtttaccgtacccgtttaagtttcccgttacggtttaccgggttaacgggttccggggaacccggggttaaacgggaaccgtaacccgggttcccgttaacccgggtacccggttttaaccgggtaaccgggttacccaaccccggggtaaccccggtacggtaccccccggttacccccggg

SEQ ID NO: 21904 - DNA, 651 bp, Homo sapiens
  misc_feature: GYAE6OF02HAX2R.49.53.E09.1.454.CMB.1.raw
  modified_base (524)..(524): a, c, t, g, unknown or other
  misc_feature (524)..(524): n is a, c, g, or t
tcagagtcgagagacacgaccggtgctcgatttagagagagtgtgttgggtttgggggcatcacataacaaccagattcctcctctaaagaagcccctgggagcacagctcatcaccatggactggacctggaggttcctcttgtggtggcagcagctacaggtgcccagtcccgggtccagctggtgcaatctgggctgaggtgagaaagcctgggtcgtcggtgaaggtctcctgcaaggcttctggagacaccttcaactaactttgctgtcagctgggtgcgtacgacggccccgtggaccaaggtccgttggtagggtggggtagggaagggactacctacccccgtaattcccttaaagtactaacgtactaaaacttagtacgacaaccgaagtaacctattaacccgaacgaactaacggtacgtacctaaccctttagaccgtaccggaaacctaaactcccgaaaccgaaccaacgtaacgtaacctaacgaacgtaggaaacctggtacccgngaaccgccgtaaggacctcgtacgacccgacgaccggtccttaagttctttcgtagtgacgtagagttagacgtttcttacgtttcgtaagttagtagttaacgttactacggttctagttactacg

SEQ ID NO: 21905 - DNA, 217 bp, Homo sapiens
  misc_feature: GYAE6OF02G4TYD.49.53.E09.1.454.CMB.1.raw
  modified_base (175)..(176): a, c, t, g, unknown or other
  misc_feature (175)..(176): n is a, c, g, or t
  modified_base (178)..(217): a, c, t, g, unknown or other
  misc_feature (178)..(217): n is a, c, g, or t
tcagagtcgagagacacgaccggtgctcgatttagagagagtgtgttggggtttggggggaagaggaagactgacggtcccccaggagttcaggtgctgggcacagcggccctgggctgcctggtcaaggactacttcctctctcgctctgagtcgggctggcaaggcgcatagnntnnnnnnnnnnnnnnnnnnnnnnnnnnnnnnnnnnnnnnnn

SEQ ID NO: 21906 - DNA, 173 bp, Homo sapiens; identical to SEQ ID NO: 20229
  misc_feature: GYAE6OF02G98IE.49.53.E09.1.454.CMB.1.raw
  modified_base (173)..(173): a, c, t, g, unknown or other
  misc_feature (173)..(173): n is a, c, g, or t

SEQ ID NO: 21907 - DNA, 184 bp, Homo sapiens
  misc_feature: GYAE6OF02HDH9L.49.53.E09.1.454.CMB.1.raw
  modified_base (175)..(184): a, c, t, g, unknown or other
  misc_feature (175)..(184): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggacaaggcgacatagnnnnnnnnnn

SEQ ID NO: 21908 - DNA, 778 bp, Homo sapiens
  misc_feature: GYAE6OF02F7MKJ.49.53.E09.1.454.CMB.1.raw
  modified_base (258)..(258): a, c, t, g, unknown or other
  misc_feature (258)..(258): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccacccgtggtgtctgtcgtcctcgaggacaggaccggccaagtactccacgtgcctcgtgggacatgctattcgaccaaaagtcaaatntcgtactttaacgtaggtaacccagacgaagaacggaccacgggaccccacgggtccccccttggtttacctttacggaacttaccttaagtttttaaagtaaaacggttaccgttttagggaacgggtaaccggggtacccttaccgggaacccggggtacccccgtaggacgtaccggttaactttccgtcggttcggccttacccgaacgtcctacgaccggtaccgaacctaaaccgtacggttacccgaacggtttacgaacccgtaacgtacggtaagggtacgggtaccggtacccgggggacgaacgggaacgggtacggagggtccgtaacggtaacctttaacgttacgttcggtacgtagttaaccgtactaccgtacgaacgttagggtacggtacggtacctacgtttaccgttggtaccgtttacggttcggggaacggttaacgggactaacggtcctacggtacccgtacgtacggtacgaccgacccgtcggaccttccccgg

SEQ ID NO: 21909 - DNA, 743 bp, Homo sapiens
  misc_feature: GYAE6OF02FNR3H.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagaccaccctcggtgtactgtgtcctcaggacagacggccagtactcacctgtctcgtggacgatgactattacggaccaaaggcctaaagttatgtacttacctaggttaccagtcaagtaacgccgtaggacccgacgggtaccccctagttccttaggactacttaagttttaactaaaacgtaccgttttaaggtacggtaacggggtaccctttacgggacccggggtaaacccccgtggaaccgggtaccggtaccgtttaccgttaccgttcgggtaccgttaccgtacggtcctacgtaacgggtaccgaaacctaaacggtacgttaccgtaacgttacggtaccctacgttacgtacgttagggaccggttcccgggagtacgggaaggacggacggtacgtcgtacttacgttactgtacgtacgtagtagtactagacctaggtagttaccggataccgttcgttcgttacgttacgttaccggtacgggaacggacccgtaacgtacggttacgtaccggtacgttacgggtacccgttacggacccgtacggtccgtaccccgg

SEQ ID NO: 21910 - DNA, 700 bp, Homo sapiens
  misc_feature: GYAE6OF02F7IBJ.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccacccgtcggtgtctgtgtcctcgaggacagacggccagtatccacctgctcgtggagtatcgcagttcgaccaaagactaatatcgtacttaacgtaggtaaccagacgaagaacgaccgacggccgaccggtccccgtgtcgttagatctaattaataaagtactttggacggtacggcctaccggaacggtacccctaggacgtcgtacttcgtacgtcgtcctcacgtcgtacgacgaccgaacgtaacacgttaccgtaccgttacgacctagtacggtaacggtcgggtaacgggtcccgggacgaacggggaacggaacggacggtcttaacggttacttaacgttccgttagtaccgtgtacacgtacggaacgtaacgttacggtaggttacgaaccttcgttacgttacgttaccggttacgttccggggaaccgggtacgggtaaccctagggtaccgtaccggtaacccgttaccggtacgggaccgtaccgggaccctacgggtcccctacccccggg

SEQ ID NO: 21911 - DNA, 766 bp, Homo sapiens
  misc_feature: GYAE6OF02IV7YQ.49.53.E09.1.454.CMB.1.raw
  modified_base (179)..(179): a, c, t, g, unknown or other
  misc_feature (179)..(179): n is a, c, g, or t
  modified_base (228)..(228): a, c, t, g, unknown or other
  misc_feature (228)..(228): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctctatgagctgacacagcccaccctggtntctgtcgtcctcaggacaggaccggcagtactccacctgctacgtgganatgctagttcgaccaaagcaattatcgcttactacggtacagcagaacgccacggccgacggccccttgtccgttgacttcgtaatttaataaagttaccgtttggaacggtacgggtccctacggaaccgggtacccccgtaggacgtacggtactttaccgtccgttcgggacctaccgtacgtctccgaacgaccgaaaccaaacgtacggttacctacggttacgaaccctatcgaagggttcgggaacgggtcccgggactaaggggaacgggtaaccggacgggtcgttaacggtaacccttttaaagttacccgttacggtaccgtaacggttaacctacgttacgtaaccggaacgttaggggttaaacgttcgggtaaccgtttaccgtttcccgtttacgggtttaccgttacggttttaccggggacgggtaaacccgggaaccgttaaccggccgttaaccgggtaccccgttaccggtaaccggtacccgtaaccggtaccccggtaggtaccccgtcccccggg

SEQ ID NO: 21912 - DNA, 716 bp, Homo sapiens
  misc_feature: GYAE6OF02H23E4.49.53.E09.1.454.CMB.1.raw
  modified_base (181)..(181): a, c, t, g, unknown or other
  misc_feature (181)..(181): n is a, c, g, or t
  modified_base (262)..(262): a, c, t, g, unknown or other
  misc_feature (262)..(262): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgacggcctcctatgagctgacacagcccaccctcggtntctgtcgtcctcgaggaccaggaccggccaagtactcaccgtgccttcgtaggagatgccagttcgaccaaaagcaaattntgtctttacgtgtaaccagaccaagaaccgcgacggccgtacggtccccgttagttcctttagattaccttaaagttttaaacgtaaaacgtttcgttttaagggaacgggtaccgggtaccccgtaccgggtaaaccgggtacccccgttagggaaacggtccgttaactttccgtaccgttcgggtaccctccgtaacgtccgtacgacgaccgtaaaccaccgtacgtaccgttaaccgttacgacccttaagtccgagggtcggaccggttccggagacggtagggacgtcgtagtacgtattagttactacgataccgtataacgacgaacgtcgtaggtcgtcgtaactaccgttgtcgttacgtcggtacggggcggaacggtaccgtcgtaacccgtcggtacccgtacggtcggaacctaccggtaccgacggtccctaccccgg

SEQ ID NO: 21913 - DNA, 181 bp, Homo sapiens; identical to SEQ ID NO: 20539
  misc_feature: GYAE6OF02H7AKI.49.53.E09.1.454.CMB.1.raw
  modified_base (173)..(181): a, c, t, g, unknown or other
  misc_feature (173)..(181): n is a, c, g, or t

SEQ ID NO: 21914 - DNA, 662 bp, Homo sapiens
  misc_feature: GYAE6OF02HGTGX.49.53.E09.1.454.CMB.1.raw
  modified_base (308)..(308): a, c, t, g, unknown or other
  misc_feature (308)..(308): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacaggacggccagtatcacctgctctggagatgcattcgaccaaaagcaaatatgacttacgtacggtaccagacaagaacgccgaaggccacggcccctgtctgatctaattanaaagtacgtttgaggacggcctcgaccggggaccccgtgggacgtacttaccttcgtcggtccgttccacgtctcgacgaccgaaccaacgaacgtacgtacgttacgacctaataccgtagtacgggtacggtccgggtacggaggacggacggacggacgtacgtaacgttaacttacgtcgttacgacgtactactacgtaacgtaccgtagtaggtcggtacgtaccttcgttcgttacgtacggttacgggacgggaccgggtacccggaaaggtcccgttacggtacccggttacccggttaacggttaccggaccgacccggtacggtccgtacccccggtccccgg

SEQ ID NO: 21915 - DNA, 681 bp, Homo sapiens
  misc_feature: GYAE6OF02HI7WL.49.53.E09.1.454.CMB.1.raw
  modified_base (179)..(179): a, c, t, g, unknown or other
  misc_feature (179)..(179): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
tcagagtcgagagacacgaccggtgctcgatttagagagagtgtgttgggtttgggggtgggtccaggaggcagaactctgggtgtctcaccatggcctggatccctctacttcctccccctctcactctctgcacagactctgaggcctctatgagctgacacacgccaccctgggtntctgtcgtcctcgaggacaggccgcagtactccactgcttcgngganatgacctagttcgaaccaaagctaaagttctgtaccttacgtacggtacctacgacgaagaacgtacgacggaccgtaccggtcccgttgttacgttacgtactacgttaattaacgtaacgttacgttagacggtacgggtccgtaccgaacgggtaccctaggacgtacgtattcccccgtagtcgtcctacgacgtacgtacgacgaccgtaaacgtaacgtacgtacgtaccgtacgaactacgtactacgggtacgacgggtccggacgtaacgggacggacggtacggtacgtacgtacgttattaccgtagttacgtacgtaacgtacgtacgacgtaacgtacgtacgtgtccgttactccgtagttacggtacgttcggacggtaacggtacgacgtcgtacgtaccgtcgtacggaccgtaccggtacgtacggtccgtacccgg

SEQ ID NO: 21916 - DNA, 660 bp, Homo sapiens
  misc_feature: GYAE6OF02FX45E.49.53.E09.1.454.CMB.1.raw
  modified_base (552)..(552): a, c, t, g, unknown or other
  misc_feature (552)..(552): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtactcacctgctctggagatcgctattgaccaaagcaatatgcttacgtggtaccagacaagaacgccaggccacggtccctgtcttgactctaatttaagtaaagtactttaggagtacggtcctacgacgggtacccctggacgacgtacttcgtcgtcggccttaccgagtccttacgacggtaccgaaacctaaccgtaggtacctaaccgttcgtaacctagtaccggaaggtcgggtaccgggtccgggagaagggtacgggaaccgggacggtcgtacgtaactttacgttaccgcgtttacacggtacacgtacgacgtaagtaacggtacgtcgggtntaccgtttgtacgtcgtttacgtcggggtaacgggtcgggaaccaggtaccgttacgtacccggtaccgtagggttacccacggacccggtaaccggctacccccggg

SEQ ID NO: 21917 - DNA, 687 bp, Homo sapiens
  misc_feature: GYAE6OF02HFAVH.49.53.E09.1.454.CMB.1.raw
  modified_base (194)..(194): a, c, t, g, unknown or other
  misc_feature (194)..(194): n is a, c, g, or t
tcagagtcgagagacacgaccggtgctcgatttagagagagtgtgttgggtttgggggtgggtccaggaggcagaactctgggtgtctcgaccatggcctggatccctctacttctccccctcctcactctctgcacagactctgacggcctcctatgagctgacacagcccaccctcggtgtctgtcgtcctnaggacaggaccggccaggtactccacctgcctcgtggagatgctagttcgaccaaagctaatagtgtaccttacgtcggtaaccagacaaggaacgcccgacgggcccgaccggtcccccttgttccgttaggacttacttaattttaataaacggtacgtttaggacggtacgggtcctacggaccgggtacccctaggacgtcgtacgttctcgtcgccctcgacgctcgacgaccgaacacgtacgtacgtacgttacgaacctagtcgaggtacggacgggtcccggagacgggacggacggacggcgttacggtacttagttcgtagtactacgtactagtacgagtacgtaggttaggtccgtaccttacgttcgttacgtacgggtttacgtacggggaaccgggtaacggaaccggtaacggtcccgtaccggtaccgttaccggtacggtccgaccggtacccggtacggtcccgtcccccggg

SEQ ID NO: 21918 - DNA, 735 bp, Homo sapiens
  misc_feature: GYAE6OF02GLLNH.49.53.E09.1.454.CMB.1.raw
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacacgcccacccgtcggtgtctgtgtcctcgaggacaggacggccagtctcacctgctcgngganatcgactagttcgaccaaagcaaatngtacttacgtgtacagacaagacgccgacggccgacggccccttgtcttggactctaagtttaacgtaaagtacgtttaggaggtaccggtcctacggaccgggtaccccgttaggaccgtacgttactttccgtcgtcggtacctccgtagtccgtacgaagtaccgaaacaaccgtaggtaccctaacggttacaccgtaacgtcggaaacgggtcgggtacgggtcccgggacgtaagggaccgggtaacggtacgggactacggtactttacttaaccgttcggtactacgtaacctagaccgtaacgtacgtaggttacggcgtacctttacgtcgttacggttacgtttacgggtaccgggtaaccgggaacgggtaaacccgttaaacgggccgtttaaaccccgggaccttaaccgggttaccgggttaccgaaccgggaccccggtaaccgggtcccgtttaaccccccggg

SEQ ID NO: 21919 - DNA, 630 bp, Homo sapiens
  misc_feature: GYAE6OF02HJ8JO.49.53.E09.1.454.CMB.1.raw
  modified_base (189)..(189): a, c, t, g, unknown or other
  misc_feature (189)..(189): n is a, c, g, or t
  modified_base (257)..(257): a, c, t, g, unknown or other
  misc_feature (257)..(257): n is a, c, g, or t
tcagagtcgagagacacgaccggtgctcgatttagagagagtgtgttggggtttgggggtgggtccaggaggcagaactctgggtgtctcaccatggcctggatccctctacttctccccctcctcactctctgcacagactctgaggccctcctatgagctagaccacagcccaccctggtgtctgtntcctcaggacaggaccggccagtactcacctgcttcgtaggatatgctagttcgaaccaaagcaaatntcgcttacgtggtaccagacaagacgccagccgacggtcccctgtctgatctattaataacgtacttgacggtacggcctacgaccgggtaccctgacgcgtattctcgtcggctaccagccgtacaggccgaacaacgtacgtactacggttacacgtacttcgaagggtacgggacgggtacccgggagtaacgggaacgggacggaggacgttaggtaacctttcttaacgtcgtctaacgttacaacgttccgagacgtaggtagtacggaccttacgttcgttcgtacgttacgggtcgggacgggaagggacccaggtccgtcggtaccttcggacggtccgacgacccggtacggccctacccggg

SEQ ID NO: 21920 - DNA, 664 bp, Homo sapiens
  misc_feature: GYAE6OF02GJ70A.49.53.E09.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
tcagagtcgagagacacgaccggtgctcgatttagagagagtgtgttggggtttgggggtgggtccaggaggcagaactctgggtgtctcaccatggcctggatccctctacttctcccccctcctcactctctgcacagactctgaggcctcctatgagctgacacagccaccctcggtgtctgtgtcctcaggacagacggcagtactcacctgctctgganatgcattgaccaaagcaatntgcttactggtaccagcagacgccaggcacgccctgtcttgatctattataagtacttgagacggcctacgacgggacccctggacgcgtacttctacgtcggtcctcagctacgagaccgaacaacgtcgtacctaacgttcgaaccctagtcgaaggtcgggtaccgggtccgggacgaaagggaccgggacgtacggtcgttacggtaacctttaacgtttaccgtcgttaccgagttacctaacgtacgagtaaccgtaagggttacggtcgtaaccttcgtttaccgtcgtttaccggttacggttccggggaacggggtaccgggtaacctacgggtcccgttaaccggacccggtttaccggtaccgggtacccgtacgggtaacccccgtaacggggtccctaccccccggg

SEQ ID NO: 21921 - DNA, 757 bp, Homo sapiens
  misc_feature: GYAE6OF02F7RFK.49.53.E09.1.454.CMB.1.raw
  modified_base (138)..(138): a, c, t, g, unknown or other
  misc_feature (138)..(138): n is a, c, g, or t
  modified_base (530)..(530): a, c, t, g, unknown or other
  misc_feature (530)..(530): n is a, c, g, or t
tcagagtcgagagacacgaccggtgctcgatttagagagagtgtggttggggtttgggggtggtccaggaggcagaactctgggtgtctcaccatggcctggactccctctacttctccccctctcactctctgcacngactctgaggcctcgtatgagctagacactgccctacccgtgggtattcctaggtccgtccgtcgaggacagtaccggcctagtactcacctgctcgtggagtatgactagttcggaacccaaaaggctaaacgtttagtacgtactttacgtacggttaaccagaccgtaagaacgcccgaacggtacccgaaccggtcccccgttaggttccgtttaacgtacttaccttaaattttaaacgttaaagtaccggttttaaggaacggtacgggttccctaccggaaccggggtaccccctagggtaccggacgttacgttccgtcgtacgtccgttacacgtctcgacgccgtaaccgacaccgttaccgtagttacgacctacgtacgnggttacgggtaccggtccgggtagaacgggacgggaggtacgggtccgtaagttacttaacgtttcgtacgttacgtacggttctagtaacccgtagtaaccgttagggttacgtcgtacttacgttccttagggtacttacgggtcggacgggtaacggaccgtacggtcgtaccgttacccggtaacggtttcgacgacccgtaccggtaggtccctaccccggg

SEQ ID NO: 21922 - DNA, 198 bp, Homo sapiens
  misc_feature: GYAE6OF02GRAW4.49.53.E09.1.454.CMB.1.raw
  modified_base (177)..(198): a, c, t, g, unknown or other
  misc_feature (177)..(198): n is a, c, g, or t
tcagagtcgagagacacgaccggtgctcgatttagagagagtgtgttggggtttggggggaagaggaagactgacggtccccccaggagttcaggtgctgggcacaggccggcctgggctgcctggtcaaggctacttcctctctcgactctgagcgggctggacaaggcgcatagnnnnnnnnnnnnnnnnnnnnnn

SEQ ID NO: 21923 - DNA, 744 bp, Homo sapiens
  misc_feature: GYAE6OF02GVJY9.49.53.E09.1.454.CMB.1.raw
  modified_base (190)..(190): a, c, t, g, unknown or other
  misc_feature (190)..(190): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggcagtatcacctgctcgtggagatgcaattcgaccaaaagcaaatatgtcttaactggtaccagacagaacgcaggccacggcccctgtcttagatactaatttaataaagtactttagacggtacgggaccttcggaacggggtacccctggacgacgtacttcctcgtcggcctaccgaacgtcctcgaagacccgtaaacgaaacctacggtaccgtaaccggtttacgaacccctaagttaccgtaacggggtagggtacccgggttacccgggggaagaacgggaacggggtaacggaacgggttaccgttaacggaaaccgttttaagttaaccgttacgggttacccgaaagttccaaagttacccaaggtaaaccgtaagggttaggtaccggtacccttaaccgtttacgttacggttaccggttttaggttcccgggaacggggtaccgggaaaccctagggtaccgttaccgggacccggttaccgttaagggtacccccaacggtaacccggaaccggttccctaccccggg

SEQ ID NO: 21924 - DNA, 651 bp, Homo sapiens
  misc_feature: GYAE6OF02G9477.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtcgtcctcaggacagacggccagtactccacctgcctcgtggagatgcattcgaccaaagacaatatgtcttacgtaggtaccagcaagaacgccaggccacggccctgtctgatctattataagtactttgagacggcctacgacggaccctgacgcgtacttctcgtcgcttccgagtctacgacgtaccgaccgaaactcgtacctacgtttacgaccctagtaccggaggtcgggacggtcccgggagtaacgggacgggaacggtacggacgttacgtaacctttaagttaaccgtgtacgtacggttcaacgttacgaaggaccgttaggttcgtacggtactttacgttgttaccgttacggttacggttcggggaccgggtaacgggacctaacggtaccgtaccgttaacccggtcgttaacgggaccgtaaccggacccggtacggccgttcccccgg

SEQ ID NO: 21925 - DNA, 197 bp, Homo sapiens
  misc_feature: GYAE6OF02III8D.49.53.E09.1.454.CMB.1.raw
  modified_base (167)..(167): a, c, t, g, unknown or other
  misc_feature (167)..(167): n is a, c, g, or t
  modified_base (171)..(197): a, c, t, g, unknown or other
  misc_feature (171)..(197): n is a, c, g, or t
tcagagtcgagagacacgaccggtgctcgatttagagagagtgtgttggggtttggggggaagaggaagactgacggtcccccaggagttcaggtgctgggcacagcggcctgggctgcctggtcaaggactacttcctgtagcactctgagcgggctggcaaggcnatgnnnnnnnnnnnnnnnnnnnnnnnnnnn

SEQ ID NO: 21926 - DNA, 922 bp, Homo sapiens
  misc_feature: GYAE6OF02ICU27.49.53.E09.1.454.CMB.1.raw
tcagagtcgagagacacgaccggtgctcgatttagagagagtgtgttggggtttgggggtgggtccaggaggcagaactctgggtgtctcaccatggcctggatccctctacttctccccctcctcactctctgcacagactctgacggcctctatgagctgacacagccacccgtggtgtctgtgtcctcaggacacggaccggccagttactccacctgccgttcgtggagtacgtgacctagttacgacccgtaaaagctaaagttacgtacgttaccgttaacgtcggtaaccacggacgaacgaacgcccgacggcccaaccgggtccccttgttaccgttagtaacgtttacttaattttaaagttaaaacggttaccgttttagggaacgggtaccgggttaccccgtaaccgggtaacccggggtaacccccgttaggaccggaccggttaacgtttcccgtaccggttcgggtaccctaccgaacgtccgttaccgaacggaccgaaacctaaccgtacggtaccgttaccggttaaccgaacccttacgtaccggtaagggttaccggggtaaccgggttacccggggggacaacgggggtaaaacgggtacccggggttaaacgggtaccgttaacggttaaaccgtttacgtttaaccgttacggttacctaaacggttctaaacccgttacgaacggttaacggtaagggttaacggtccggttaaccgtttaccggttttaaccggttccgggttaacgggtttaccggggttacccggggtaacggggtaacccggttaacccggtaacgggttacccggttacccggtaacccgggtttaacccggtacgggttaacccccggaacgggttaaccccggttaccggttacccccggtacccccggg

SEQ ID NO: 21927 - DNA, 690 bp, Homo sapiens
  misc_feature: GYAE6OF02I2DYI.49.53.E09.1.454.CMB.1.raw
  modified_base (178)..(178): a, c, t, g, unknown or other
  misc_feature (178)..(178): n is a, c, g, or t
  modified_base (219)..(219): a, c, t, g, unknown or other
  misc_feature (219)..(219): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgagcctcctatgagctgacacagcccaccctggtntctagttcgtcctacgaggacacggaccggtccaagttacnccaccgtgccttcgtaggatatcgactagttcgaaccaaagtccaattacgtgtacctttacgtcgtaaccagacgaagaaccgccaggccgacggtcccttgtcttacgattactattaagtaacttacgttaggacgacggcctacggaccggtccctagacgtcgtacttcgcgtcggtcctctagcctacgacggaccgtaacaaaccgtcgtaccgtaaccggttacaacctacgtacggtacgggtacgggtaccggtaccgggacgtaagggaccggacggacgtacgtacgtaacgttacttaccgttagactacgtacaggtacaagtaacgtacggttacggcgtaccttaccgtttcgtacggttacgttacggttcgggacggtaacggaccgtaggtccttaccggtacccgttacgtccggtaaccggaccgacccggtacgtccccgtaccccggg

SEQ ID NO: 21928 - DNA, 771 bp, Homo sapiens
  misc_feature: GYAE6OF02FX98C.49.53.E09.1.454.CMB.1.raw
  modified_base (181)..(181): a, c, t, g, unknown or other
  misc_feature (181)..(181): n is a, c, g, or t
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccctaccctcggtntctgtcgtcctnaggacagacggccagtatcactgctctgganatgctattcgacctaaagctaatatcgtacttacgtggtaccaggcaagaacgccaacgggcctacggcccctgttcttagacttctatttaacgtaaagtcgttttaggaacggtacgggcctcgaaccgggtaccccttggacgaccgtatttcctacgtcggtcctccgacgtcctacgaccggaccgaaacctaacgtacgtaccgtacggtttaccgaacccttagtaccggtaagggttacgggtccgggtaccgggtacgaaggggaccggtaacgggtacgggtaccgttaacggtaaccgtttaacgtttaaccgtagttaccgtaacgttaccgaattaccgaaacggtaaccgttaagggttaacggtccggtaacctttacggtttaccgttacgggtttaaccggttacggttaccggggacccggggtaaacgggtaacccgttaaacgggcccgtttaacccggaaccccggtttaaccgttacgggtaacccgtacccggtaaccccggtagggtccccttaacccccggg

SEQ ID NO: 21929 - DNA, 177 bp, Homo sapiens
  misc_feature: GYAE6OF02I1OHB.49.53.E09.1.454.CMB.1.raw
  modified_base (175)..(177): a, c, t, g, unknown or other
  misc_feature (175)..(177): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatagnnn

SEQ ID NO: 21930 - DNA, 729 bp, Homo sapiens
  misc_feature: GYAE6OF02H2BFJ.49.53.E09.1.454.CMB.1.raw
  modified_base (133)..(133): a, c, t, g, unknown or other
  misc_feature (133)..(133): n is a, c, g, or t
  modified_base (253)..(253): a, c, t, g, unknown or other
  misc_feature (253)..(253): n is a, c, g, or t
  modified_base (334)..(334): a, c, t, g, unknown or other
  misc_feature (334)..(334): n is a, c, g, or t
  modified_base (452)..(452): a, c, t, g, unknown or other
  misc_feature (452)..(452): n is a, c, g, or t
  modified_base (491)..(491): a, c, t, g, unknown or other
  misc_feature (491)..(491): n is a, c, g, or t
tcagagtcgagagacacgaccggtgctcgatttagagagagtgtgttgggtttgggggtgggtccaggaggcagaactctgggtgtctcaccatggcctggactccctctacttcctccccctctcactctcngcacagactctgaggtcctcctatgagtctgaaccacacgccccacccgttcggtgtccttggtcgttccacgaggaccaggtaccggctaagtactccgaccgtgcttcggtaggaatntcgacctattcgaaccaaaagtctaaacggttatccggttaacttacgtaacgtaccgagacgaggacgccgacggtaccnccgggtcccttaggttacgttcggtaagttaacgtttaaaacgtaagtttaccggtaggacggtaacccggttcctaacgggacccggtacctggaaccgtgtattcctgcggtaccncagtcgaaggaacgtacaacgcgtaccaacgtcactacncgagtacgtacggtcccgaggtaacggcggaacggtacgacgtaacgttaaacgttgttaaccggttacgtacgtacgaccgacgtaacgaccgtagaccggtaagtcgggtaactttaaagtcggttaccggtaagttacgggttaccgggtagggtaacggtacgtacggtacctacgggtaccgtttaacggcgtaccgacggtaccgacggtcccgttacccgcccgttaccgg

SEQ ID NO: 21931 - DNA, 200 bp, Homo sapiens
  misc_feature: GYAE6OF02HHNHZ.49.53.E09.1.454.CMB.1.raw
  modified_base (174)..(200): a, c, t, g, unknown or other
  misc_feature (174)..(200): n is a, c, g, or t
tcagagtcgagagacacgaccggtgctcgatttagagagagtgtgttgggttgggggaagaggaagactgacggtccccccaggagttcaggtgctgggcacagcggccctgggctgcctggtcaaggactacttcctctctcgactctgagcgggctggcaaggcgcaatagnnnnnnnnnnnnnnnnnnnnnnnnnnn

SEQ ID NO: 21932 - DNA, 709 bp, Homo sapiens
  misc_feature: GYAE6OF02GWY8Y.49.53.E09.1.454.CMB.1.raw
tcagagtcgagagacacgaccggtgctcgatttagagagagtgtgttgggtttggggtgtgttgggtttgggttgagaacctatgaaaattctgcaggggccactgtcttctccacggtgctcccttcatgcgtgacctggcagctgtagcttctgtgggacttccactgctcgaggcgtcaggctcagatagctgctggccgcgttacttggttgttgtcttttggttggagggtgtgggtggtcctcccactcccgcgttggaccgggggtctggctagtcgtgtcccttccgacggtccccttgttcttgactactatttaataaacgtactttaggaggtacgggcctcggaacgggtaccctggacgtcgtacttcctcgtcggcctccgagtcctcgacggtccgaacaaacgtcgtactacggttcaccattcgacggtcggacggtccggtcgaagggtacggacggtacggacgtaggtaaccgttaagtttcgttacgttactaacggtctaacgttaccgaagtaaccgtaggttaacggtcgtacttaaccgttcgttagttccggtaacggttcggggtaccggggtaacgggaccgtaacggtccgtacggtaccccggttaacgtaccgggttacaacccgggtacccggtacgggtacccgtcccgggtcccccgttcggtacccttacccgg

SEQ ID NO: 21933 - DNA, 186 bp, Homo sapiens
  misc_feature: GYAE6OF02HMF11.49.53.E09.1.454.CMB.1.raw
  modified_base (172)..(186): a, c, t, g, unknown or other
  misc_feature (172)..(186): n is a, c, g, or t
tcagagtcgagagacacgaccggtgctcgatttagagagagtgtgttgggtttgggggaagaggaagagtgacggtcccccaggagttcaggtgctgggcacagcggccctggctgcctggtcaaggactacttcctctctcgactctgagcgggctggcaaggcgcatagnnnnnnnnnnnnnnn

SEQ ID NO: 21934 - DNA, 540 bp, Homo sapiens
  misc_feature: GYAE6OF02GLPHE.49.53.E09.1.454.CMB.1.raw
  modified_base (222)..(222): a, c, t, g, unknown or other
  misc_feature (222)..(222): n is a, c, g, or t
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (392)..(392): a, c, t, g, unknown or other
  misc_feature (392)..(392): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctgganatgctattgaccaaagcaatatgcttactggtaccagcaagaagccaggccacggacccctgtactgattcaattataaagatttgagaggcctnacgggtacccngagcgtattcgtctggcctacagctcagcanaacngtacacgttcgacatcagtggagtccggnagacggacgaggctgtaactagttactgtacaggccattacgagaacgtaggtagtcggtactacttcgtagtacggttactcgggaggccggtaacacgtcgtacgcgtaccgttaggacctaccggaccgtaacggtcctacccgg

SEQ ID NO: 21935 - DNA, 726 bp, Homo sapiens
  misc_feature: GYAE6OF02JP2OX.49.53.E09.1.454.CMB.1.raw
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
tcagagtcgagagacacgaccggtgctcgatttagagagagtgtgttgggtttgggggtgggtccgaggaggcagaactctgggtgtctcaccatggcctggactcctctacttcctcccctcctcactctctcgcacagactctgacggcctcctatgacgctgacacacgccaccctggtgtctgtcgtccngacggcagacggccagtacncacctgctcgtagganactgcattacggaccaaaaggcctaaagttctacgttaccttaacgtcggttaaccacggacaacggaacgtccgaacgggcccgaaccgggtccccttggtaccgttagtacttacgtaacgtttaaacgttaaacggtacgtttaggaacggtacgggtacccgtaggacccggtaccctggacgtaccgttaagttcctcgtacgccgtacctaggtcctacgaacgtcgaaaccaacgtacgttcgacggttacaaccgttacgtacgtgggtaacggtcgggtaccgggacgaacggtacgggacgaacgggtcttacgggtaacttacgttacgcgttaccgagttaacgtacgtacgaaacggtcgttacgggtaagttccggaacttacggttcgtacggtttcgtaccggttacgggccggggtacgtaacgacgtcggttacggtaccgtacgtcggaaccctcggaaccggagtcccgtacccgg

SEQ ID NO: 21936 - DNA, 190 bp, Homo sapiens
  misc_feature: GYAE6OF02JR50V.49.53.E09.1.454.CMB.1.raw
  modified_base (174)..(190): a, c, t, g, unknown or other
  misc_feature (174)..(190): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggctacttcctctctcgactctgagcgggctggacaggcgcatagnnnnnnnnnnnnnnnnn

SEQ ID NO: 21937 - DNA, 680 bp, Homo sapiens
  misc_feature: GYAE6OF02GL37D.49.53.E09.1.454.CMB.1.raw
  modified_base (186)..(186): a, c, t, g, unknown or other
  misc_feature (186)..(186): n is a, c, g, or t
  modified_base (237)..(237): a, c, t, g, unknown or other
  misc_feature (237)..(237): n is a, c, g, or t
  modified_base (419)..(419): a, c, t, g, unknown or other
  misc_feature (419)..(419): n is a, c, g, or t
  modified_base (563)..(563): a, c, t, g, unknown or other
  misc_feature (563)..(563): n is a, c, g, or t
tcagagtcgagagacacgaccggtgctcgatttagagagagtgtgttggggtttgggggtgggtccaggaggcagaactctgggtgtctcaccatggcctggatccctctacttcctcccctctcacttctctgcaacagactcgtgaggccctactaatgagctagacaacagcccaccctggtntctgtgtcctgaggacaggacgcaagtactcacctgactcgtaggacgtangactagttacgacaaaacgcaaagtagtcgtacttaacgtacgtaaccgaacgacgaaggaacgaccgacgggaaccacggtaccccgtagtcgttagacgttacctaatttaaacgtaaaacgtactttaggaagacgggtaccgttacgaccggtacccgtagacgtacgtaacgtttcncgtacgcttaccgaacgcgtacgacgtacaaacgaacgtaacgtacgtaacggtactaaccgaactaccgtaaggtacgacgggttaccggagaacgggtacggacggacgtacgttacgaacgttattacgtgacacgtacanaacgacgatagttagcgtacctagtacgttgtacgttacgtcggtacggaacgggtaacaaggtccgttacggtaacccggtcgtaacgtacaccggtaccggacgtaccgtacccg

SEQ ID NO: 21938 - DNA, 185 bp, Homo sapiens; identical to SEQ ID NO: 20744
  misc_feature: GYAE6OF02ILVYG.49.53.E09.1.454.CMB.1.raw
  modified_base (173)..(185): a, c, t, g, unknown or other
  misc_feature (173)..(185): n is a, c, g, or t

SEQ ID NO: 21939 - DNA, 211 bp, Homo sapiens
  misc_feature: GYAE6OF02FLIJP.49.53.E09.1.454.CMB.1.raw
  modified_base (104)..(104): a, c, t, g, unknown or other
  misc_feature (104)..(104): n is a, c, g, or t
  modified_base (174)..(211): a, c, t, g, unknown or other
  misc_feature (174)..(211): n is a, c, g, or t
tcagagtcgagagacacgaccggtgctcgatttagagagagtgtgttgggtttggggggaagaggaagactgacggtccccccaggagttcaggtgctgggcanagcggccctggctgcctggtcaaggactacttcctctctcgactctgagcgggctggcaaggcgcatagnnnnnnnnnnnnnnnnnnnnnnnnnnnnnnnnnnnnnn

SEQ ID NO: 21940 - DNA, 677 bp, Homo sapiens
  misc_feature: GYAE6OF02FYIMB.49.53.E09.1.454.CMB.1.raw
  modified_base (223)..(223): a, c, t, g, unknown or other
  misc_feature (223)..(223): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtactcacctgctctggantnctattcgcctaaagcaatntgtcttacgtggtaccagctagaacgccgaggccacggcccctgttcgttcgtatcgttatttaagtaaagtacgtttaggaggtacgggtcctacggacggacccctggacgcgtacgttcgtcgtcggtcctaccgagctacgacgacgaactaacgacgtacgtacgttacaaccgtactaccgtagggtcgggtacggtcccggggacgaacgggtaacgggaccggacgggtccgtaggtaaacctttacgtttaccggttacgtacgtaacgttacgtactaacgtaacggtaactacgggttacgtcgggtaaccttacgttcgtccgttaggtttaccggtcgggaccgggtaacggtaaccggacgtacgtaccggttacccgtacggttacggtccgtacggacccggacgtcccgtccccgg

SEQ ID NO: 21941 - DNA, 994 bp, Homo sapiens
  misc_feature: GYAE6OF02HDLHB.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttctcccctcctcactctctgcacagactctgacggcctcctagtgagctgacacacggccctacccgtcggtgtctgtcgtcctacgaggacacgacggctagtactaccgacctgctcgtaggatagtcgactagttacgaaccgtaaagactaagtacgtacgttaccgttacgtacggtaccgaaggaacgaacggaaccgaccggaaccgggcccgtaacccgggtccccgttttacggttaccgtttacgtaacgtttaacgtttaaacgtttttaaaacgtaaacggtttaccgtttagggtaacgggtaccgggtacccgttaaccgggacccgggtaaccccgtaggtacggtaccgttaccgttttaccgtacgtccggtacccgtacccgtacggtcccgaaccggtacccggaaccgaaaccgtaaccggttaacggttaccgttaaccggttaccgaaaacccgttcgttaaaccgggagggggttaaccgggtacccggggtacccggggtaaacggaacggggaaccgggtacgggtaacgggttacgttaccggttaaaacgtttaccgtttaaccgggtcgtttaaaccggtacgttaacccggaagttaacccggtaacggtaaccggttaaacgggtttacggggtacccgtaccgtttttaaccggtttaccgggttccggtttaaccggggttccggggtttaacccggggaaccgggggtttaaaccccgggaacgtttaaccccggacccgggtttaacccccgggtttaacccgggtttaccggttaacccggggtaaaccccgtaccccgggggttaaaccctcccccgggggttaccccccgttaacccccccgggg

SEQ ID NO: 21942 - DNA, 751 bp, Homo sapiens
  misc_feature: GYAE6OF02I377X.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctcccccctcctcactctctgcacagactctgacggcctcctatgagctgacacagcccaccctcggtgtctgtctcctcgaggacacggacggcctagtactcacctgctcgtaggagtatgactacttacgaccaaagactaagtatacgtacttaccgtaggtaaccagtaccaagaacgccgaggaccgaccggtaccccttgttacgttagtacttcgttaaatttaaacgtaaagtacgtttaggacggtacgggtcctaccggaaccgggtaccctaggaccggtccgttactttccgtacggtccgtaccgtaccgtacgcgttacaaccggtaactaacgtaaccgtacgttaccgtaacggtttactaccgtaacgttacggtaacggtacgggtcccggggtaccggaggtaaacgggacggggaccggaaggttaccgtaagttaacctttacgttacgtcggtactacgttacagtaccgaagtaacgttagggttataccgtttacttcggttagttaccggttacggtcggggaggaacccgggacgttacgtaccggaccggttaccgtaccggttacggacccgtaaccggtccggaacccggtcctccccggtacccgg

SEQ ID NO: 21943 - DNA, 173 bp, Homo sapiens
  misc_feature: GYAE6OF02IMRSH.49.53.E09.1.454.CMB.1.raw
  modified_base (173)..(173): a, c, t, g, unknown or other
  misc_feature (173)..(173): n is a, c, g, or t
tcagagtcgagagacacgaccggtgctcgatttagagagagtgtgttgggtttgggggaagaagaagactgacggtcccccaggagttcaggtgctgggcacagcggccctgggctgcctggtcaaggactacttcctctctcgactctgagcgggctggcaaggcgcatagn

SEQ ID NO: 21944 - DNA, 834 bp, Homo sapiens
  misc_feature: GYAE6OF02ILLNS.49.53.E09.1.454.CMB.1.raw
tcagagtcgagagacacgaccggtgctcgatttagagagagtgtgttgggtttgggggtgggtccaggaggcagaactctggggtgtctcaccatggcctggatcctctacttctccccctctcactctctgcacagactctgaggcctctatgagctgaccacacgacccacccgttcggtgtcctggtcgtccctcgaggacaggtaccggccagtactccacctgactcgtgggacgatcgcctattcggacctaaagctaattacgtacgtacctttaacgtaggtaaccgaacgtcgaacggtaaaccgcggtaaccggacccgaccgggtacccccgtttggttaccttaggtacttttaacgtaaacttttaaacggtaaaacttcggttttaacgggaacggtaccgggtaaccgttaccggtaaccggggtaacccccgtaggtaaccggtacggtttaacgtttccggttaccgtacggtacccgtttaccgaacgggtccttacggacggtaaccgtaacaaacggtacggttaccttaccgttacgaacctagtaccgttaagggtacgggtaccggtaccggggactaaacgggtacgggaaccggtaggttactacggttaacttacgtttaccgtacgtactacgtacttaacggtacgaaacggtctaagggttaccggagtaacccgttttaggtaccgttgggttaccgttacggtaaccggggacgggtaaccggtaacgtccggtaccggtacggttaccccgtggtttaacccgggattaccccggggaacttccgggacccgtttaccccgg

SEQ ID NO: 21945 - DNA, 721 bp, Homo sapiens
  misc_feature: GYAE6OF02GAUL4.49.53.E09.1.454.CMB.1.raw
  modified_base (375)..(375): a, c, t, g, unknown or other
  misc_feature (375)..(375): n is a, c, g, or t
  modified_base (441)..(441): a, c, t, g, unknown or other
  misc_feature (441)..(441): n is a, c, g, or t
  modified_base (481)..(481): a, c, t, g, unknown or other
  misc_feature (481)..(481): n is a, c, g, or t
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgaggcctcctatgagctgacacagcccaccctcggtgtcgtgtgtcctcgaggacgaggacggccagtactcacctgtcctctggagactgcctagttcaccgaaagctaattatcgtcttacgtaggtaccagaccgaaggaacgacgacggccgaccggccctgttctgtactacttaatttaactaaagtatttggaggcggtacccgtcgaccggacccctagacgngttacgttcgtcgtcgacctcgacgctacgacgtaccgacctactagtctacgtacacacgtacgnggtacgggtacgtaccgggacgtacggaaagggaccgggnggtacggttaaccgtaacgtttacttacgttcggtactacgtacgtacgttacgaacggtacgtaaggttacggttccggtaaccttacgtttacggtttgtttaccggttaccgggttcggggtaccgggtaacggggtaaaccgttaccggtacccggttaccggttaacccggttaccggttaccgggtaaccgttaaccccgggaccggttacccgggaccccggtttcccccggg

SEQ ID NO: 21946 - DNA, 774 bp, Homo sapiens
  misc_feature: GYAE6OF02FR9DV.49.53.E09.1.454.CMB.1.raw
tcagagtcgagagacacgaccggtgctcgatttagagagagtgtgttggggtttgggggtgggtccaggaggcagaactctgggtgtctcaccagtggcctggatccctctacttctccccctctcactctctgcacagtactctgaggtcctcctatgagtctgacacagcccaccctcggtgtctgtgtcctgaggacgaggacggcctagtactcacgtgctcgtggatactgctatcgacaaagctaaatgtgcttacgtaggtaccagtacaagacgccgaggccacggtcccctgtactcgatactaatttactaaaagcgttttaggacggtacgggtacctacggtacgggtaccccctaggtacggtaccggtactttcgttaccgttcgggtacccttccgaacggtcctaccggtaaggtacccgtaaaccgaacgtaaccggttccgaacgtttcggaaccctacgtacgacgggttacggacgggtcccgggtacgaacgggtagggaaccgggacgggtaccgttaacgggaaccttttaacggtacccgtttaggtacgtaaaccggttcgtaacgttaccgaggtaaaccgtaggtaacgggtttacgaccgttaactttaccgttaggttaccggtttacggtacggggtacccgggtaacgggtaaccggtaaaccggttccgtaacggggtacccgtttaccggttacgggttacccggaccgttacccgggtaacggtaccggttaacccccgg

SEQ ID NO: 21947 - DNA, 192 bp, Homo sapiens
  misc_feature: GYAE6OF02JJXWP.49.53.E09.1.454.CMB.1.raw
  modified_base (174)..(192): a, c, t, g, unknown or other
  misc_feature (174)..(192): n is a, c, g, or t
tcagagtcgagagacacgaccggtgctcgatttagagagagtgtgttgggtttgggggaagaggaagactgacggtccccccaggagttcaggtgctgggcacagcggccctggctgcctggtcaaggactacttcctcgtagcactctgagcgggctggcaaggcgacatagnnnnnnnnnnnnnnnnnnn

SEQ ID NO: 21948 - DNA, 897 bp, Homo sapiens
  misc_feature: GYAE6OF02IQ0I8.49.53.E09.1.454.CMB.1.raw
  modified_base (252)..(252): a, c, t, g, unknown or other
  misc_feature (252)..(252): n is a, c, g, or t
tcagagtcgagagacacgaccggtgctcgatttagagagagtgtgttgggtttggggtgtgttgggtttgggttgagaacctatgaaaattctgcgagggggccactgtcttctccgacggtgctccttcatgcgtgacctgggctgctgtagcttcgtggtgggtaccttccactgctcgaggcgtcacggtctcgagatacgctcgtcgtcggccgtcgttactttggttgttgtcgttttaggttgggngggttgtgggtcgtacctcctaccgtccggtcgttggacgggtcctggtactagttcgtccgtaccgttacccgtaccggtcccgttgttaccgtgtacctttacgtaacttttaaacgtaagttaaccggttaggaacggtaccggttcccgtacggaaacccggtccccgtagggaacgtcgtacttttccgaccggtcgacccgttacctagcccgtacggtacggaccgaaacctacggtacgtaccgttacgttacccgaactaacgtcgggacggttacgggaccggttccgggaacgaaacgggacggtaacgggtacggttaccgtaacgggttaacttaacgttaccggttacgttaccgtaacggttaccgtaaccgtacgaaccggttaacgtagggttaccggtaaccggttcccgttaaacccggttttaccgggtttcgggttacccggttttacgggacccggggtaacgggtaacccgggtacccggttaacggttacccgggttaaacccggttcccggttaacccggtttaaacccgggaccggttaacccgggtaacccggtaacccggttaccccggttacccccgggtaacccccttttacggggtacccccctttaacccggg

SEQ ID NO: 21949 - DNA, 310 bp, Homo sapiens
  misc_feature: GYAE6OF02IQOZ9.49.53.E09.1.454.CMB.1.raw
  modified_base (192)..(193): a, c, t, g, unknown or other
  misc_feature (192)..(193): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (201)..(310): a, c, t, g, unknown or other
  misc_feature (201)..(310): n is a, c, g, or t
tcagagtcgagagacacgaccggtgctcgattttagagagagtgtgttggggtttggggggggaagaggaagaactgacggtcccccccaggagttcaggtgctggggcacagccggccctggggctgcctggtcaaaggactacttccttctctcgactctgagcggggctgggcaaagggcacataaggnngnagnatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21950 - DNA, 919 bp, Homo sapiens
  misc_feature: GYAE6OF02I4QUK.49.53.E09.1.454.CMB.1.raw
  modified_base (108)..(108): a, c, t, g, unknown or other
  misc_feature (108)..(108): n is a, c, g, or t
  modified_base (168)..(168): a, c, t, g, unknown or other
  misc_feature (168)..(168): n is a, c, g, or t
  modified_base (879)..(879): a, c, t, g, unknown or other
  misc_feature (879)..(879): n is a, c, g, or t
tcagagtcgagagacacgaccggtgctcgatttagagagagtgtgttgggtttgagggtgggtccaggaggcagaactctgggtgtctcaccatggcctggatccctntacttctccccctctcactctctgcacagactctgacggcctcctatgagctaggacacncgtccacccgtcggtgtcctgtacggtccctacgacggaactacggaccgggccctaaggttacttacccaaccttggtccctttacggtacggggaaacgtacgttcggtaccctaagttttccggaaccccgttaaaaaggccttaaaagtttaattccgggtaaccttttaaccggtaccgggttaacccgaggtacgaaaccggaaaccggaccccgaaccggggtcccctaaccggggtcccccctttaaggtttacccgtttacggtaacgtttaacctaaagtttttaaaacgtaaaaaccggttcgtttttaacggggaaacgggttaccccgggtacccgtttaaccgggaacccgggggggtacccctttaacgggaaacgggtacccggtttaacctttacccgggttttccgaccggggttaccctttaacccggaaccgggttcccttaccgggaacggtttaacccgaaaccgtaaccgttacggtttacccgttaaaccggttaccgtaaactaccggtacggtaaccggggtcgggtaaccgttcccgggggaccgtaaggggaacgggtaaccggtaacgtcggttaacgtaaacttacggttactcggttaacctggtaccacggtacgtagaccggtagtcggtaggcctcgttcgtagttccgtacgggtcggacggtaacgacggtaccncgtaggcccggtattccggacgtaccgaccgacggttccg

SEQ ID NO: 21951 - DNA, 190 bp, Homo sapiens
  misc_feature: GYAE6OF02GGZXF.49.53.E09.1.454.CMB.1.raw
  modified_base (167)..(167): a, c, t, g, unknown or other
  misc_feature (167)..(167): n is a, c, g, or t
  modified_base (173)..(190): a, c, t, g, unknown or other
  misc_feature (173)..(190): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcncatagnnnnnnnnnnnnnnnnnn

SEQ ID NO: 21952 - DNA, 179 bp, Homo sapiens
  misc_feature: GYAE6OF02GEIN7.49.53.E09.1.454.CMB.1.raw
  modified_base (175)..(179): a, c, t, g, unknown or other
  misc_feature (175)..(179): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatagnnnnn

SEQ ID NO: 21953 - DNA, 792 bp, Homo sapiens
  misc_feature: GYAE6OF02JMRK4.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgacggcctcctatgagctgacacacgcccacccgtcggtgtctggtcgtcctcgaggacacggaccggaccaagttactcctaccgtgaccttcgtagggaatagtcgcgtagttacgaacctaaagactaatagtcgtcctttaacgtcggtaaccagaccgaagggaccggaccgaccgggtacccgaccggtcccccttaggttcggtttaggttacgtttaagtttaaagttaaaccggttagttttacggaacggtacccgggtcccgtaccggaaccccgggtaccccgttggaccgtaccgttacgtttccgtcggtccgtcctaccgtacggacctacggtaacgggtaaccaacgttaccgtacccgtaacccgttccgaaccgtacgtaccggtacgggtccgggtaccggtcccggaaccggtaaggaccgggtacggacggttaccggattacccttaacgttacgtcgtaccgtaaccgtccgaacgagacgacggcgtaacgggtcgacgtttaagttagtacggttacgtaggtccgggtaggaccgggtaccttccgggacgttaccggtaacccggtcggtacggtaccgcccggtaaccggtacggtcccggttaccccgtccccgacgg

SEQ ID NO: 21954 - DNA, 690 bp, Homo sapiens
  misc_feature: GYAE6OF02IASED.49.53.E09.1.454.CMB.1.raw
  modified_base (138)..(138): a, c, t, g, unknown or other
  misc_feature (138)..(138): n is a, c, g, or t
  modified_base (207)..(207): a, c, t, g, unknown or other
  misc_feature (207)..(207): n is a, c, g, or t
  modified_base (437)..(437): a, c, t, g, unknown or other
  misc_feature (437)..(437): n is a, c, g, or t
  modified_base (574)..(574): a, c, t, g, unknown or other
  misc_feature (574)..(574): n is a, c, g, or t
  modified_base (587)..(587): a, c, t, g, unknown or other
  misc_feature (587)..(587): n is a, c, g, or t
  modified_base (595)..(595): a, c, t, g, unknown or other
  misc_feature (595)..(595): n is a, c, g, or t
tcagagtcgagagacacgaccggtgctcgatttagagagagtgtgttgggtttgggggtggtccaggaggcagaactcgtgggtgtctcaaccatggcctggactccctctacttcctccccctctcactctctgcanagactctggacgcctctagtgagctagacacacgtcccctacccgttgggtcgtcgtgttacgttcccncgaagggaccaacgggaccggttaccaagtacttacccgaccgtgtacctaggtagggaatggtcaccgttagttaaccgaaccgaaaagtctaaagtttacgtgttaccttaacggttaccggaaccagacgaaaggaaccgccgaacggccgttaccggtccctgttacgtacattactaagtttaactaacgttcttagggacgtacggccgtacgaccggtaccgngagtctaacttccgtgaccgctacacggtctcacgtccgtaaacaacgtgtaaccgtcgttacaacgtccgtacggagggtacggccgggacgtacggacggagacgggactgtaaccgtttatacgtttgacgcgntacgactagagtnagtcgtanccttaagcttaggcgtacgggtcggacgaaacgggtacctacgacgttccgacgtacggccggtagaaccccgggccttacggcccttaccccgg

SEQ ID NO: 21955 - DNA, 868 bp, Homo sapiens
  misc_feature: GYAE6OF02GG3A5.49.53.E09.1.454.CMB.1.raw
  modified_base (214)..(214): a, c, t, g, unknown or other
  misc_feature (214)..(214): n is a, c, g, or t
  modified_base (568)..(568): a, c, t, g, unknown or other
  misc_feature (568)..(568): n is a, c, g, or t
tcagagtcgagagacacgaccggtgctcgatttagagagagtgtgttggggtttgggggtgggtccaggaggcagaactctgggtgtctcaccatggcctggatccctctacttctcccctctcactctctgctacagactctgaggcctctatgagctagacacagtccaccctggtgtctggtgtcctcgaggacaggaccggccagttacncgacctgctcgtaggatattggactattacggaccaaagctaaattagtcgtacctttaaccgttggtaaccaggaccaaaggaaccgtccgaacgggacccctaccgggtcccccttggtttccgttaacggtattaccgtaaagttttaaacgtaaaaccggtttcgttttacgggaacggtaccgggtacccttacgggaaccgggttaccccagggtacgtaccgttatttacccgtcggtaccgggtcctacccgtacggttactacgaccgtaaccgaaccgtaaacgtcgtaaccgttaaccgtcgaacccgtaagttacggtagttacgggacccgggttacgggntaaacgggtaaccggggtaacggtaacgggtaccgtttaaacaacccggttttaaacgttaccggttacgttacccggttaaaggttacgaacgtttaccaaacgggtttaccttaaagggttaacgggtttccgaccctttaacggttttcttaaccgggggtttaacgtttaaccggttaccggggtaaccggggtaaccgggttaacccgtaagttccccgggttaacccgttacgtttacccggggttacttaacccggaccggttaaaccctacccgggtcgtttaccccccggg

SEQ ID NO: 21956 - DNA, 995 bp, Homo sapiens
  misc_feature: GYAE6OF02HC74Z.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctcctcactctctgcacagactctgacggcctcctatgagctgacacacgcccaccctcggtgtctgtcgtcctcgaggacaggaccggcctaagttactccaccgtggcttcgtgggagatgactagttacgaccaaaagcctaaattgtgtaccgtttaacgttcggttaacccagaccgaaaggaacgcccgaacgggcccgtaaccggtccccccgttggtttccgtttacggtaacctttaccgttaaaagtttttaaacgtaaaaacggtttaaccgtttttacgggaaaggggtaaccgggggtaccccgttaacccggtaaccgggggacccccccttagggtaaccggtacccggttaaattttcccgtcccgtttaacggggttccccgttacccgtaagggtcccctttacggtaaccggacccgttaaaacccgaaaccgtaacggttaacccgtttaaacccgggttttaccgggaaacccttaacccggttaccggtaaacggggttcggggttaaacccgggggttacccgggggtaccggtaaaacgggggaaaccgggggaacccgggtaaacggggtacccggtttaacggaacccgtttaaaccgttttaaaccgttccgggttaacgtacgggtttacctaaccgttaaaccggaacggaaaacccgtttaacgggtaacgggttcggtccgggttttaaaccgttttccggttacgggtttacccggttaccgggtttttcggggaaccggggaaaccccgggttaaccggtaccgttaccggtaccggtaccccggttaccggttacgggtaccgaacccggacccccggtaacgggtccccgttacccccgg

SEQ ID NO: 21957 - DNA, 829 bp, Homo sapiens
  misc_feature: GYAE6OF02FPQ5O.49.53.E09.1.454.CMB.1.raw
tcagagtcgagagacacgaccggtgctcgatttagagagagtgtgttgggtttgggggtgggtccaggaggcagaactctgggtgtctcaccatggcctggatcctctacttctccccctcctcactctctgcacagactctgaggcctctatgagctgacacacgcccacccgtggtgtctggtcgtcctcgaggacaggaccggccagttatccacctgacctcgtgggagagtgctaagttcggaaccaaaaaggcctaaattacgttcgtaccttttaaccggtacggttaacccgtaagacgaaggaaaccggacccgaacgggtacccgaaccggggtcccccgttggtttacccgttaggttaccttacgttaaacttttaaaacgttaaaaacggttacggttttaagggtaacgggtacggggtaccccgttaaccgggtaaccgggacccccgtagggaccggtaccggttaacgtttcccgttaacggtcggtaccgttaccgaccggtacccgttaccgaacggaaccgtaaacgaaaaccggtacggttaacccgtaccggtttaaccggtaaacccttaaggtaccgttaaaggggttacgggtaacccgggtacccggggaacgtaacgggaacggggtaccgaagggtaccgttacgtaaacgttactttacggtacgtacgtacgtcgaacgtacgacggtacgtaggttaggtcgtacgttatcggttatccggtagtcgggacggtacgaccggtaacgtcgttaccgcgttacggtacgtaccgacgtcccggacgtacccgtacccgg

SEQ ID NO: 21958 - DNA, 843 bp, Homo sapiens
  misc_feature: GYAE6OF02FTYZV.49.53.E09.1.454.CMB.1.raw
  modified_base (184)..(184): a, c, t, g, unknown or other
  misc_feature (184)..(184): n is a, c, g, or t
tcagagtcgagagacacgaccggtgctcgatttagagagagtgtgttggggtttgggggtgggtccaggaggcagaactctgggtgtctcaccatggcctggactccctctacttcctccccctctcactctctgcacagctctgacggcctctatgagctgacacagtcccacccgttgggtntctggtcgtccctcgaggacaggccggccagtactccacctggctacgtagggactatcgactattcgaaccaaaacgcgtaaatcgtacgttacttacgtacggttaaccaggaccgaaggaaccgccgacgggacccaccgggtccccttggttaccgttggaacttaccgttaaagttttaacggtaaactttaccggtttaggaacgggtaccgggtccttaaccgggaaccggggtacccctaggacgtacggttactttaccgtccggtacgtctaccgacgtacccgtacgaaacggcgaaccctaaccggtacggtacccgtaaccggtttacgaccctaaggtaccgaacggggttcgggtacggggtcccgggaggaacggggaccgggtaacgggtaccgggtaccgttacggttaactttaaccggttacgttagttaccgtaccggtctaacgtccggaaaggtaccggtaaaggttcccggtaggtaccctttaacggttcgttaccgggtttacttaccggggttaccgggggtaccggggtaaaccggaaccgtttaacggccccgggtttacggaacccggttaccggtacggggtaacccggttacccgtaaccggtaccggtaccccggttacccccggg

SEQ ID NO: 21959 - DNA, 850 bp, Homo sapiens
  misc_feature: GYAE6OF02HVI0S.49.53.E09.1.454.CMB.1.raw
  modified_base (113)..(113): a, c, t, g, unknown or other
  misc_feature (113)..(113): n is a, c, g, or t
  modified_base (674)..(674): a, c, t, g, unknown or other
  misc_feature (674)..(674): n is a, c, g, or t
tcagagtcgagagacacgaccggtgctcgatttagagagagtgtggttggggtttgggggtgggtccagggaggcagaactctggggtgtctcaccatggcctggactccctntacttcctccccctctcactctctgacacagactctggacggtccctacctagtggacgtcgtacgaaccacacgtcccccaacccccggttggggttatttccgtggttctacccgtaacgaaggggaaccaacgggtaaccgggtccaagggtttaactccaacccgttgccgttcgtaggggacattcggactattaccggaaccaaaaagtctaaaagttctcggtactttaacgtacggtaaccgagacaaggaacgcccggtaacggaccgacggtcccctaggtccttaagacttacttaagttaacgtaaacgtcgtttaggaggtacgggttacccaggtaaccgggccccttaggacgtacggtactttaccgtcggtcggtactcccggagtacctacgaacgtaccggaaacgaaacctggttaccgtaaccgttacgggacctaacgtccggtaggggtacgggttaacgtacccggggaataaggggaccgggttaacggaacgggccttacgtaaacgtttacttaccggtgtaacctaacggttnaacgttaaccgaggttaaaccctaagggttaccggggtctaccggttaacttggttacccgggttaggtacgggttacgggaacggggaacgggttaacccagggtacccgtcggtaaacccggttggttaaccgggacccaaccgggtaacccgttacggccccttaaccccggg

SEQ ID NO: 21960 - DNA, 735 bp, Homo sapiens
  misc_feature: GYAE6OF02HH28H.49.53.E09.1.454.CMB.1.raw
  modified_base (225)..(225): a, c, t, g, unknown or other
  misc_feature (225)..(225): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacaggacgccagtatccacctgctcgtgganatgcattcgaccaaaagctaatatcgactttacgtcggttaccacgacagaacgccgaggcccacggcccctgtccttaggatacctaatttaacgtaaagtacttttaggacggaacgggtccgtacgacgggtacccccgtaggacgacgtactttcgtcgtcgggcctccgaagtccttacgacgaccgaacgtaacgtaacgtactaccggttcgaacctaagtcctaagggtacggacgggttcccgggagtaacgggagggtaaccgggtacggtacggttaacgtaaccgttaacgttaaccgtcgttacgaacgtttaccaaggttaccaacggtacgtaacggttacggtacggtacgtaacctttccggtaggtttaccggtacggttacggggtaccgggtaacgggtacccgaagggtacccgttacgggtacccggttacccggttacgggtaccgtaacccgggtaacccgtaccgggtacccgttaccccccggg

SEQ ID NO: 21961 - DNA, 193 bp, Homo sapiens
  misc_feature: GYAE6OF02F8CWG.49.53.E09.1.454.CMB.1.raw
  modified_base (175)..(193): a, c, t, g, unknown or other
  misc_feature (175)..(193): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggacaaggcacatagnnnnnnnnnnnnnnnnnnn

SEQ ID NO: 21962 - DNA, 185 bp, Homo sapiens
  misc_feature: GYAE6OF02F531O.49.53.E09.1.454.CMB.1.raw
  modified_base (95)..(95): a, c, t, g, unknown or other
  misc_feature (95)..(95): n is a, c, g, or t
  modified_base (167)..(167): a, c, t, g, unknown or other
  misc_feature (167)..(167): n is a, c, g, or t
  modified_base (173)..(185): a, c, t, g, unknown or other
  misc_feature (173)..(185): n is a, c, g, or t
tcagagtcgagagacacgaccggtgctcgatttagagagagtgtgttgggtttgggggaagaggaagactgacggtccccccaggagttcaggtnctgggcacagcggccctgggctgcctggtcaaggctacttcctctctcgactctgagcgggctggcaaggcncatagnnnnnnnnnnnnn

SEQ ID NO: 21963 - DNA, 849 bp, Homo sapiens
  misc_feature: GYAE6OF02IL79Q.49.53.E09.1.454.CMB.1.raw
  modified_base (185)..(185): a, c, t, g, unknown or other
  misc_feature (185)..(185): n is a, c, g, or t
  modified_base (249)..(249): a, c, t, g, unknown or other
  misc_feature (249)..(249): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgacgctgaacacaagccctacccgtcggtntcctggtcgtcctacaagggacacggaccggcctaagtactaccgaccttgccttcgagggtanaacgttggacctaagtttcggaaacccaaaaaggtacctaaaatttaagtcggttaccgtttaaccggttaccgggttaaacccaacggtaccgaaacgggaaaccggacccgtaaccggggacccgtaacccgggtaccccccgtttcggttaccgttttacggaaccttaaccgtttaaagttttaaaacgttaaaacgttaccggttttacggaaaggggttaaccgggacccttaacccggaaccgggtacccccgttggaacggtaccgttagtttccgtccgtagggtccctaccgaagtcctaacgacgtaccgaaacaacgtacgtacctaaccggttacgaaccgtatacggtaacggtcgggacggtaccggtacgaacgggacggaccgggtggaccgttagtaaccgttacgttaacgtcgttaaccgtacgttacgaaccgttacggaaggtaacgtaacggttacggttcgtacccgttaccgtttacttcgttaacgttcgggttacgggaccgggtaacggtaccgaacgtccgtaacgtacccgtacggtacggtaccaccggtacgtaccggaccgtcccgg

SEQ ID NO: 21964 - DNA, 181 bp, Homo sapiens
  misc_feature: GYAE6OF02I8VJF.49.53.E09.1.454.CMB.1.raw
  modified_base (174)..(181): a, c, t, g, unknown or other
  misc_feature (174)..(181): n is a, c, g, or t
tcagagtcgagagacacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnnnnn

SEQ ID NO: 21965 - DNA, 670 bp, Homo sapiens
  misc_feature: GYAE6OF02H2MTS.49.53.E09.1.454.CMB.1.raw
  modified_base (163)..(163): a, c, t, g, unknown or other
  misc_feature (163)..(163): n is a, c, g, or t
  modified_base (177)..(177): a, c, t, g, unknown or other
  misc_feature (177)..(177): n is a, c, g, or t
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
  modified_base (334)..(334): a, c, t, g, unknown or other
  misc_feature (334)..(334): n is a, c, g, or t
  modified_base (479)..(479): a, c, t, g, unknown or other
  misc_feature (479)..(479): n is a, c, g, or t
  modified_base (496)..(496): a, c, t, g, unknown or other
  misc_feature (496)..(496): n is a, c, g, or t
  modified_base (559)..(559): a, c, t, g, unknown or other
  misc_feature (559)..(559): n is a, c, g, or t
tcagagtcgagagacacgaccggtgctcgatttagagagagtgtgttgggtttgggggtggtccaggaggcagaactctgggtgtctcaccatggcctggatccctctacttctcccctctcactctctgcacagactctgacgcctctagtgagctgacacncgccacccgtggtntctgtcgtccncgaggacagcggctagtanccacctgctcgtaggagtctggctatcggaaccaaagcaaagttcgtagtaccttacggtacggaaccaggaccagaacgcgtacgccgacgtaccctgtactgacttacgtaatttaactaacgtnttacggaaggtcgggtacctaccggtaaccgggaccccttagggactccgtactttcctcgtacggtcctccggaactcgtaccaggaccaaacaacgtacgtcgtaaacgttcgactacgtcgaggtacgggacggtacccggngaacgggtcggaacggngtacgtaagtacgtacgttacgtagtacgtgttacaccgttagaagtacgtaggttagccgtnttaaccgttggtaacgttcgtacggtcggtacgggaacggttacacggtaccgtacggtacccgttcggtaacccggtacgaacccggtaccggtagtccccgtacccggg

SEQ ID NO: 21966 - DNA, 182 bp, Homo sapiens
  misc_feature: GYAE6OF02G6K5H.49.53.E09.1.454.CMB.1.raw
  modified_base (174)..(182): a, c, t, g, unknown or other
  misc_feature (174)..(182): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgatctgagcgggctggcaaggcgcatagnnnnnnnnn

SEQ ID NO: 21967 - DNA, 175 bp, Homo sapiens; identical to SEQ ID NO: 21793
  misc_feature: GYAE6OF02GAUC8.49.53.E09.1.454.CMB.1.raw
  modified_base (175)..(175): a, c, t, g, unknown or other
  misc_feature (175)..(175): n is a, c, g, or t

SEQ ID NO: 21968 - DNA, 188 bp, Homo sapiens
  misc_feature: GYAE6OF02FVKOA.49.53.E09.1.454.CMB.1.raw
  modified_base (167)..(167): a, c, t, g, unknown or other
  misc_feature (167)..(167): n is a, c, g, or t
  modified_base (173)..(188): a, c, t, g, unknown or other
  misc_feature (173)..(188): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcncatagnnnnnnnnnnnnnnnn

SEQ ID NO: 21969 - DNA, 192 bp, Homo sapiens
  misc_feature: GYAE6OF02GWUU2.49.53.E09.1.454.CMB.1.raw
  modified_base (168)..(168): a, c, t, g, unknown or other
  misc_feature (168)..(168): n is a, c, g, or t
  modified_base (174)..(192): a, c, t, g, unknown or other
  misc_feature (174)..(192): n is a, c, g, or t
tcagagtcgagagacacgaccggtgctcgatttagagagagtgtgttgggtttggggggaagaggaagactgacggtccccccaggagttcaggtgctgggcacagcggccctgggctgcctggtcaaggactacttcctctctcgactctgagcggctggcaaggcncatagnnnnnnnnnnnnnnnnnnn

SEQ ID NO: 21970 - DNA, 185 bp, Homo sapiens
  misc_feature: GYAE6OF02FWRQI.49.53.E09.1.454.CMB.1.raw
  modified_base (174)..(185): a, c, t, g, unknown or other
  misc_feature (174)..(185): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggacaaggcgcatagnnnnnnnnnnnn

SEQ ID NO: 21971 - DNA, 758 bp, Homo sapiens
  misc_feature: GYAE6OF02FQIHK.49.53.E09.1.454.CMB.1.raw
tcagagtcgagagacacgaccggtgctcgatttagagagagtgtgttgggtttgggggtgggtccaggaggcagaactctgggtgtctcaccatggcctggatccctctacttcctccccctctcactctctgcacagactctggacggcctctagtgagctagacactacgcccaaccgtcggtgtcttggtcgtcctgaggacaggaccgacctagtacaccacctgctcgtaggaatgtcgactatacgaaccaaacgcaaatcgtcgttacttacgtagtaaccagacgaacggacgcccgtaaggacccgaccggtccccgttggttaccggttgggttaattaacgtttaaacgtaaacggtttactttacgggaacgggtacccggaccccgttaggaaccccgggtaccccgtaagggtaacgttaccgttaactttccgtaccggttacggttcccttaccggacgtttacccgacgggtaaacggaacctaacggtaccttacccgtaccttaccgaacgtcgtacgagggtacggaccggtacgaccggaggaacggacgtcggacctagaacgttacgtagttaccgcgtacgtccgaacacgtacgacgcggtaacgtcggtaattacggttaacgtcgttaacggttacggtcggggaacggttacggaaccggttcgacgttcggtaacccgttcggaacgtacggcccgtaaccgaccggccgttaccccgtaccgttccgg

SEQ ID NO: 21972 - DNA, 184 bp, Homo sapiens
  misc_feature: GYAE6OF02GP2CZ.49.53.E09.1.454.CMB.1.raw
  modified_base (168)..(168): a, c, t, g, unknown or other
  misc_feature (168)..(168): n is a, c, g, or t
  modified_base (172)..(184): a, c, t, g, unknown or other
  misc_feature (172)..(184): n is a, c, g, or t
tcagagtcgagagacacgaccggtgctcgatttagagagagtgtgttggggtttgggggaagaggaagactgaccggtcccccaggagttcaggtgctgggcacagcggccctgggctgcctggtcaaggactacttctcgtagcactctgagcgggctggacaggcnatgnnnnnnnnnnnnn

SEQ ID NO: 21973 - DNA, 859 bp, Homo sapiens
  misc_feature: GYAE6OF02FURYX.49.53.E09.1.454.CMB.1.raw
  modified_base (261)..(261): a, c, t, g, unknown or other
  misc_feature (261)..(261): n is a, c, g, or t
tcagagtcgagagacacgaccggtgctcgatttagagagagtgtgttgggtttgggggtgggtccagggagcagaactcgtgggtgtctcaccagtcggcctggactccctctacttcctccccctctcactctctgcacagtactcgtgacgtcctctagtcgagtcgtagacacgaccgccccacccgttggtgttcctggtcgtccctagaacggacacggaccggcctaagttctacccaccgtttggccttacggngggaattacgtccgtattaggttcccgaaccgaaaatacctaaagttcgtacgtacgttaacgtacggtaaccgacgtacgaacgaacggacccgaaccggacccgtaccggtaccccgttccgtttacgttagacttacttaacgttttaaactaaacggttacgtttaggaagggtaccggtaccgttaccggaaccgggtaccccgtagtacggtacctaacgttcccgttaccgtcgtacccgtacgtacgccttacgacgtacgtaacccgaacgtacgtaccggtacgttacaccgtacgtacgaacgggttacggtaaccgggtccgggaacgtaagggaaccgggtaacggcgtacgttaaccgttaaccgtttagttaaccgttacgtacgtaaccggtacgtaacgtaaccgtaggtaccgtaaacggttcgtaaccggaactttccgttttagtaccggtttacggttacgtttacggggaccgggtaaacggtaacccggtaacggtacccggtttaaccgttaacccggttacggttaaccggtaccggtaacccggaacccgttccggtacccgttacccccgg

SEQ ID NO: 21974 - DNA, 451 bp, Homo sapiens
  misc_feature: GYAE6OF02JI5FC.49.53.E09.1.454.CMB.1.raw
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (248)..(249): a, c, t, g, unknown or other
  misc_feature (248)..(249): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (349)..(350): a, c, t, g, unknown or other
  misc_feature (349)..(350): n is a, c, g, or t
  modified_base (352)..(352): a, c, t, g, unknown or other
  misc_feature (352)..(352): n is a, c, g, or t
  modified_base (354)..(355): a, c, t, g, unknown or other
  misc_feature (354)..(355): n is a, c, g, or t
  modified_base (361)..(365): a, c, t, g, unknown or other
  misc_feature (361)..(365): n is a, c, g, or t
  modified_base (367)..(367): a, c, t, g, unknown or other
  misc_feature (367)..(367): n is a, c, g, or t
  modified_base (378)..(379): a, c, t, g, unknown or other
  misc_feature (378)..(379): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (400)..(401): a, c, t, g, unknown or other
  misc_feature (400)..(401): n is a, c, g, or t
  modified_base (403)..(404): a, c, t, g, unknown or other
  misc_feature (403)..(404): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
tcagagtcgagagacacgaccggtgctcgatttagagagagtgtgttgggttgggggaagaggaagactgacggtcccccaggagttcaggtgctgggcacagcggcctgggctgacctggtcaagggactacttcctctcgtcgactcgtggaagcgggtctggaccaagggcgactagtagntanactancatgcagtntcgntaggcatggctgaccgngagtcnatcgtnacnacgtncnangnngcgacgactcgacgactcgcgacncgtacgcgtacacgtacacgtanacgtagagacgagacgacncacgtactagtacatcngagtactgngtangacnncncnntgtatnnnnntncgacagagtannacngngtacgntancngcagnngnngcgantctngantcnganacgctcnctctcgctntcgngngctgagn

SEQ ID NO: 21975 - DNA, 787 bp, Homo sapiens
  misc_feature: GYAE6OF02I18JH.49.53.E09.1.454.CMB.1.raw
  modified_base (227)..(227): a, c, t, g, unknown or other
  misc_feature (227)..(227): n is a, c, g, or t
tcagagtcgagagacacgaccggtgctcgatttagagagagtgtgttggggtttgggggtgggtccaggaggcagaactctgggtgtctcaccatggcctggatccctctacttctccccctctcactctctgcacagactctgaggcctcctatgagctgacacacgcccaccgtggtgtctgtcgtcctcgaggacaggacgccagtactccaccgtgccttcgngggactagtcgacgtacgttcgaaccaaagcaaattgtcgtcttacgtacggtaccagacaagaacgaccgaacggccgacgtcccgtagttctacgtactacgtaatttaacgtaaagtacgtttaggacggaccgggtccttaccggaaccgggtacccccgttaggacgtcgttaacgtttccgtacgtcgggtaccctacgacggtacctcgtacgaaccgactaaccgtcgtaccgtacgtacgacctacgtacggtaacggtgggtacccggtcgggaccgaacgggtacggtaaccgggacgttacggttaccggttaactttaccgtttaacggtcggtaccggtacgttaacgaccgtaacgtaacggttaacgtacgggtttacgtcggtaaccgtttccgtttacggtacgtttacgggttaccgggttacggggtacccgggaacggtaaccggtaccgtccgggttaaccccgttaccgggtttacccggtaacgggtaccccgtaaccgggttacccggtaaccgggttccccgttacccccgggg

SEQ ID NO: 21976 - DNA, 792 bp, Homo sapiens
  misc_feature: GYAE6OF02GM8RI.49.53.E09.1.454.CMB.1.raw
  modified_base (179)..(179): a, c, t, g, unknown or other
  misc_feature (179)..(179): n is a, c, g, or t
  modified_base (232)..(232): a, c, t, g, unknown or other
  misc_feature (232)..(232): n is a, c, g, or t
  modified_base (462)..(462): a, c, t, g, unknown or other
  misc_feature (462)..(462): n is a, c, g, or t
tcagagtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagcccaccctggtntctgtgtcctgaggacaggacgctaagtatccacctggcctcgtaggacgtancgtacctagtttcgaaacccgaaaagtctaaacgttagtcgtacctttaaccgtcggtaacctacgacgtaacggaacgcccgtaacggcccgtaccggtccccgttagttcgttacgtacttacgttaatttaaagtaaaacggtaccgtttaggaacggtacgggtccctaccggtaccgggacccctaggtacgtacgtaactttcgtaccgtcggtaccgtaccgngtaccgtacgtacgaaccgaccgtaaacgtacgttacccgtaacggtacaacccgtagtaccgtaggtacgggtaccggtcccgggagtaacgggaacggaccggaacgtcgttaacgtaccgtttaagtaccggttagacctaccggtactaccggttaccgaacggtaaccgtaagggtttaaacggtcgtaacccttacggtttaacgtcggtttaaccggtacggttaccgggggaacggtaaaggggaacccttaacggtactacccggtacccgttaccggtacggttaccggtaaccgacccgtacgggtccctaaccccggg

SEQ ID NO: 21977 - DNA, 729 bp, Homo sapiens
  misc_feature: GYAE6OF02JFPXN.49.53.E09.1.454.CMB.1.raw
  modified_base (143)..(143): a, c, t, g, unknown or other
  misc_feature (143)..(143): n is a, c, g, or t
  modified_base (190)..(190): a, c, t, g, unknown or other
  misc_feature (190)..(190): n is a, c, g, or t
tcagagtcgagagacacgaccggtgctcgatttagagagagtgtgttgggtttgggggtgggtccaggaggcagaactcgtgggtgtctcaccatcggcctggatccctctacttctcccctctcactctctgcacagactcngaggccttcgtatggacgctgacacagccacccgtcggtgtctggtntacctcgaggacaggacggcctaagtactcacctgctcgtaggacagtcgactagtttacgaccgaaaacgtctaaaaacgtgttacggtacctttaacggttacggtaaaccacggaaaccgaaggaaacgcccaaaggggaccccttaaacgggtccccttacgttgttaactacgttactaacttttaagaaaacggtttacgttaggaacggtacggtacccgtacgtaaccgggtacccgtaggtacggcttacggttctacgtcgtacgtacctagtcgacgaacgacgtaaacccgaagtcgttaaccgacggtttacaaccgacgtacgtacggacggtacggcccggagtaaggaacggtcgacggtacttagaacctttaggtaacctcgttaaccacgttacaacgttaccgaagaacgttccgtagtacggtacctaaccgttgaacgttacgtacggtcggacgggtaagaacgtagacgttacggtaaccgtcgtaacgtgtaacccgcgttaacgcccgtaccc

SEQ ID NO: 21978 - DNA, 200 bp, Homo sapiens
  misc_feature: GYAE6OF02I6WSV.49.53.E09.1.454.CMB.1.raw
  modified_base (169)..(169): a, c, t, g, unknown or other
  misc_feature (169)..(169): n is a, c, g, or t
  modified_base (175)..(200): a, c, t, g, unknown or other
  misc_feature (175)..(200): n is a, c, g, or t
tcagagtcgagagacacgaccggtgctcgatttagagagagtgtgttgggtttgggggaagaggaagactgacggtcccccaggagttcaggtgctgggcacagcggccctgggctgcctggtcaaggctacttcctctctcgactctgaggcgggctggacaagggcncatagnnnnnnnnnnnnnnnnnnnnnnnnnn

SEQ ID NO: 21979 - DNA, 806 bp, Homo sapiens
  misc_feature: GYAE6OF02FZUKV.49.53.E09.1.454.CMB.1.raw
  modified_base (177)..(177): a, c, t, g, unknown or other
  misc_feature (177)..(177): n is a, c, g, or t
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
tcagagtcgagagacacgaccggtgctcgatttagagagagtgtgttgggtttgggggtgggtccaggaggcagaactctgggtgtctcaccatggcctggatccctctacttctccccctctcactctctgcacagactctgaggcctcctatgagctgacacagccaccgtggtntcgtgtgtcctnaggacagacggccagtataccactgctgtagganatgcagttacgaaccaaagactaaatntacgtacttaacgtacggtaaccgagacaaggaacgaccgaacggaccgacccgggtacccttacgttacgttggtaacttaacgttaacgttttaaaacgtaaaacggttacgttttaagggaacgggtaacgggtacccggttaacggacccgggttaaccccgtacgggaacggtaccgttaacgtttccgtacggtaccgggtcctaacccggtacgtaccgtaacggaaccgggtaaccgaaaccgtaaaccggtacgtttaaaccgtaaccggttaccgtaacccgtaacgttaccggtaagggttacccggggtacgggtaaccgggaacgtaaacgggaacgggaccgggtaacggtaccggttaaggtaacctttaagttaccgacgtacaacgttcaacgtacgaacgtagtacggtaaggttaccgcttacgtttacgttacggtacgtacgggttacggaccggtaaggtaaacccgtagtaaccggtaccgtaccggttaccgtcgtaacggaccggtaccggtaaccgccgttaaccccggg

SEQ ID NO: 21980 - DNA, 853 bp, Homo sapiens
  misc_feature: GYAE6OF02H9NF5.49.53.E09.1.454.CMB.1.raw
  modified_base (175)..(175): a, c, t, g, unknown or other
  misc_feature (175)..(175): n is a, c, g, or t
tcagagtcgagagacacgaccggtgctcgatttagagagagtgtgttgggtttgggggtggtccaggaggcagaactctgggtgtctcacatggcctggactcctctacttcctccccctctcactctctgcacagtactcgtggacgcccttactagtgagctacgacacgacnccctacccgttggtgtctgtcgtcctagaaggaccaggtaccggctaagtcttaccaccgtgtccttaggaggatacgtgaacgttacgttacggaaaccaaagtacctaagttacgttacgtaaccgttacggtaaccggtaacgaacggtacgaacggacggaaccgaccggacccggttaaccggtccccgtttagtacgttacgtactttaaacgtttaaaacgttaaacggttaacgtttgttaacgggaccgggttaaccgggaccggtacgggaacccggtacgtacggtacggttacgttacctttacggtacggttccggtacaccggttacgtacctaacgacgtaaaccgaaccgtacggttacggtacctttaccggtactaacgtacgttaccgggtaacgggtacgggtaccgggtaacggacggtaacgggacggtacggtacgtacgttaacttacgttaacgtcgtttaggtacaacgttacgttaaccgaacgtaacggtagttacggttacggttcgtacctttacgggttagttacgggttaacggttaccgggtaacgggggtaccgggaacgttaccgacgggttaacccggtaccgtacggttacggtacgggacccgtaacgggtaacccgttaccgggcccgtttaccccggg

SEQ ID NO: 21981 - DNA, 831 bp, Homo sapiens
  misc_feature: GYAE6OF02GK8YK.49.53.E09.1.454.CMB.1.raw
  modified_base (435)..(435): a, c, t, g, unknown or other
  misc_feature (435)..(435): n is a, c, g, or t
tcagagtcgagagacacgaccggtgctcgatttagagagagtgtgttggggttgggggtggtccaggaggcagaactctgggtgtctcaccatggcctggactccctctacttcctccccctcctcactctctgcacagactcgtgacgtcctcctagtcgagctagaccacgacgccctacccgtggtctctgtctcctagacggacacggtaccggcctaaggtctccgaccgtgtaccgttagacgggtagtactggtacctagttaccgaaccgaaacgtactaacgttagtccgttacgttaaccggtcggtaaccacgtacaacggtaccgtaccgacggtaccctaaccggtcccttggtactagtactacgttaacttaacgtaacgtacgttacggaggtaccggtcccgtaggtaccggtaccgngtcgtaccgttacttcgtacgtacgcctaccgagtccgtaacgacgactaaaccgacgtacggtccgtaacgtccaacggtactcggtaagggttccgggaccgtcgggtaagaccgggaacggtacggtacgtaacggtaccgttaaacgtttacgggtcctaaacgtccggtaagggccctaaacgggttaacaaacgggttacggttaacggttaccggtaccgtaaccccgtttcgtttaagggtttaccgggtaacccgggtttccgggtaaacgggaaccggggttaccccaaccggttaacccgggttcgtaaccccgggttacccggttaaccggacggttaaccccgtacggtaacccccgggtacgtcccccgggttaacccccgg

SEQ ID NO: 21982 - DNA, 200 bp, Homo sapiens
  misc_feature: GYAE6OF01BEB63.18.10.A10.1.454.CMB.1.raw
  modified_base (199)..(200): a, c, t, g, unknown or other
  misc_feature (199)..(200): n is a, c, g, or t
tcagtacgagtatgcacgaccggtgctcgatttagcgtcgatctcagggtccgggagatcatgagggtgtccttgggtttggggaagaggaagactgacggtcccccaggagttcaggtgctgggcacagcggccctgggctgcctggtcaaggactacttcccatactcgtactgagcgggctggcaaggcgcatagnn

SEQ ID NO: 21983 - DNA, 224 bp, Homo sapiens
  misc_feature: GYAE6OF01BFTJQ.18.10.A10.1.454.CMB.1.raw
  modified_base (202)..(224): a, c, t, g, unknown or other
  misc_feature (202)..(224): n is a, c, g, or t
tcagtacgagtatgcacgaccggtgctcgatttagcgtcgatctcgaggggtccgggagatcatgagggtgtccttgggtttgggggaagaggaagactgacggtcccccaggagttcaggtgctgggcacagcggccctgggctgcctggtcaaggactacttcccatactcgtactgagcgggctggcaaggcgcatagnnnnnnnnnnnnnnnnnnnnnnn

SEQ ID NO: 21984 - DNA, 202 bp, Homo sapiens
  misc_feature: GYAE6OF01EYR0U.18.10.A10.1.454.CMB.1.raw
  modified_base (201)..(202): a, c, t, g, unknown or other
  misc_feature (201)..(202): n is a, c, g, or t
tcagtacgagtatgcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttcccatactcgtactgagcgggctggcaaggcgcatagnn

SEQ ID NO: 21985 - DNA, 202 bp, Homo sapiens
  misc_feature: GYAE6OF01B3W44.18.10.A10.1.454.CMB.1.raw
  modified_base (202)..(202): a, c, t, g, unknown or other
  misc_feature (202)..(202): n is a, c, g, or t
tcagtacgagtatgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttcccatactcgtactgagcgggctggcaaggcgcatagn

SEQ ID NO: 21986 - DNA, 226 bp, Homo sapiens
  misc_feature: GYAE6OF01EIAOQ.18.10.A10.1.454.CMB.1.raw
  modified_base (205)..(226): a, c, t, g, unknown or other
  misc_feature (205)..(226): n is a, c, g, or t
tcagtacgagtatgcacgaccggtgctcgatttagcgtcgatctcgaggggtccggagatcatgagggtgtccttgggttttgggggaagaggaagactgacggtccccccaggagttcaggtgcgtgggccacagcggccctgggctgcctggtcaaggactacttcccatactcgtactgagcgggctggcaaggcgcatagnnnnnnnnnnnnnnnnnnnnnn

SEQ ID NO: 21987 - DNA, 205 bp, Homo sapiens
  misc_feature: GYAE6OF01DQK51.18.10.A10.1.454.CMB.1.raw
  modified_base (202)..(205): a, c, t, g, unknown or other
  misc_feature (202)..(205): n is a, c, g, or t
tcagtacgagtatgcacgaccggtgctcgatttagcgtcgatctcaggggtccgggagatcatgagggtgtccttgggttttgggggaagaggaagactgacggtccccccaggagttcaggtgctggcacagcggccctgggctgcctggtcaaggactacttcccatactcgtactgagcgggctggcaaggcgcatagnnnn

SEQ ID NO: 21988 - DNA, 215 bp, Homo sapiens
  misc_feature: GYAE6OF01A59TK.18.10.A10.1.454.CMB.1.raw
  modified_base (203)..(215): a, c, t, g, unknown or other
  misc_feature (203)..(215): n is a, c, g, or t
tcagtacgagtatgcacgaccggtgctcgatttagcgtcgatctcaggggtccgggagatcatgagggtgtccgttgggttttgggggaagaggaagacctgacggtcccccaggagttcaggtgctgggcacagcggccctgggctgcctggtcaaggactacttcccatactcgtactgagcggctggcaaggcgcatagnnnnnnnnnnnnn

SEQ ID NO: 21989 - DNA, 204 bp, Homo sapiens
  misc_feature: GYAE6OF01D45H2.18.10.A10.1.454.CMB.1.raw
  modified_base (203)..(204): a, c, t, g, unknown or other
  misc_feature (203)..(204): n is a, c, g, or t
tcagtacgagtatgcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttcccatactcgtactgagcgggctggcaaggcgcatagnn

SEQ ID NO: 21990 - DNA, 208 bp, Homo sapiens
  misc_feature: GYAE6OF01EY3J1.18.10.A10.1.454.CMB.1.raw
  modified_base (201)..(208): a, c, t, g, unknown or other
  misc_feature (201)..(208): n is a, c, g, or t
tcagtacgagtatgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttcccatactcgtactgagcggctggcaaggcgcatagnnnnnnnn

SEQ ID NO: 21991 - DNA, 202 bp, Homo sapiens; identical to SEQ ID NO: 21985
  misc_feature: GYAE6OF02H7BEH.18.10.A10.1.454.CMB.1.raw
  modified_base (202)..(202): a, c, t, g, unknown or other
  misc_feature (202)..(202): n is a, c, g, or t

SEQ ID NO: 21992 - DNA, 209 bp, Homo sapiens
  misc_feature: GYAE6OF02JJBRR.18.10.A10.1.454.CMB.1.raw
  modified_base (202)..(209): a, c, t, g, unknown or other
  misc_feature (202)..(209): n is a, c, g, or t
tcagtacgagtatgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttcccatactcgtactgagcgggctggcaaggcgcatagnnnnnnnn

SEQ ID NO: 21993 - DNA, 210 bp, Homo sapiens
  misc_feature: GYAE6OF02I5APY.18.10.A10.1.454.CMB.1.raw
  modified_base (202)..(210): a, c, t, g, unknown or other
  misc_feature (202)..(210): n is a, c, g, or t
tcagtacgagtatgcacgaccggtgctcgatttagcgtcgatctcaggggtccgggagatcatgagggtgtccttgggttttggggggaagaggaagactgacggtcccccaggagttcaggtgctgggcacagcggccctgggctgcctggtcaaggctacttcccatactcgtactgagcgggctggcaaggcgcatagnnnnnnnnn

SEQ ID NO: 21994 - DNA, 729 bp, Homo sapiens
  misc_feature: GYAE6OF01CHW0P.24.83.H06.1.454.CMB.1.raw
  modified_base (424)..(424): a, c, t, g, unknown or other
  misc_feature (424)..(424): n is a, c, g, or t
  modified_base (626)..(626): a, c, t, g, unknown or other
  misc_feature (626)..(626): n is a, c, g, or t
tcagactactatgtcacgaccggtgctcgatttagatcacgtgcgtcgcgggaggacgctgaccacacggtacgtgctgtttgtactgctcctcccgcggtctttgtcttggcattatgccacctccacgccgtaccacgtaccagttcgaacttgacctcgtaggttcttcggtgcctcgaaccgtcccaccaccacgcatcgtcgacctcggacggggtccctagacgacctccgtccttagcgcacgccttgtacggtacttcctaccttacaaattaccgttgtagtatcgacgtacgtcggccgactacgccgtccggaagggacggtcgtagttagtttcggtacttacgtacgtaactaactagttaggtagagggtatacgtctaccgaactagtacgtacggccgtacgtacggnggaacggacctaacgtaccactacgtaccgtacgacgaaccgtaaaccgaccgtaccgaaacgaccctaagtacccgttataacgtacgttaacgaataacggtcgaaccgaaccgtacggacctaacgaaccgggacccgacgtaacggcgttacgttaggtacgtttaccgtacgttagacggtaacggacgggaaccgnggtaacctaccgttaacttaccgtaccccgttacgttaccgcgtttacgacgggtaccgtacgggttaccggaaccgggtaccggaacgggttccaacccggg

SEQ ID NO: 21995 - DNA, 581 bp, Homo sapiens
  misc_feature: GYAE6OF02FWE1E.24.83.H06.1.454.CMB.1.raw
  modified_base (269)..(269): a, c, t, g, unknown or other
  misc_feature (269)..(269): n is a, c, g, or t
  modified_base (362)..(362): a, c, t, g, unknown or other
  misc_feature (362)..(362): n is a, c, g, or t
tcagactactatgtcacgaccggtgctcgatttagatcacgtgcgtcgcgggaggacgctgaccacacggtacgtgctgttgtactgctcctcccgcggctttgtcttggcaatatgcacctccacgccgtccacgtaccagttgaacttgacctcagggtcttcgtggctcacgtccaccaccacgcatgtgacctcaggggtccctgacgactctcctgtgcagcctctggattcgccttcaatacttctggatgcacgtgggtccncaagctccgagggaagggctgagtttgggctcgacgtattaacattgatgggatagctcacactatgcggactcgtagaacggccattcacgntctccaagacgaccaacgaccaacgaaacacactatactctgacaaagtcgagcacgacctagaacgccgacgacgacggctaggtacgttacgttacgtgttacgacgaagggtacggggaccacggaccttacttaccgtaccttacctaccgttacccgtacgttacggtacgggtacgtccggtacgggacccgtaacggggacccgtaaccggg

SEQ ID NO: 21996 - DNA, 770 bp, Homo sapiens
  misc_feature: GYAE6OF02GB7E1.24.83.H06.1.454.CMB.1.raw
  modified_base (354)..(354): a, c, t, g, unknown or other
  misc_feature (354)..(354): n is a, c, g, or t
  modified_base (521)..(521): a, c, t, g, unknown or other
  misc_feature (521)..(521): n is a, c, g, or t
tcagactactatgtcacgaccggtgctcgatttagatcacgtgcgtcggcgggaggacgctgaccacacggtacgtgctgttgtactgctcctcccgcggctttgtcttggcattatgcacctccacgccgtccacgtaccagttgaacttgacctcaggtcttcgtggctcacgtccaccaccacgcatgtgacctcagggtccctgagactctcctgtgcagcctcgtggacttcgccttacaaacttaacctttcgtaggatgtcctacgttcggggtcccaccaagtcctacccggaaggggaacggggtcttggtagttttcggggacctcgaaccggtttattaaccngtttggagttggggaattacgcttcaactactgtacgccggtacttccggtaggaaccgggtccgtaacttccgaacctacttaccgtaacccggaagaaacccggtaaaccaaccggtacccgaaaacgtaaaacccgtaccttaaccgttaggttacttaccgtnaaaccgtaagtaacggacaccggaaaccgccgttaaacgaaacggaccccgtaacggtaaccgaccgggttacgtacggtttattaaccgtttaacgtggttaccgaaacggacggggtaccgggacctacggtaccgttaccgtttaacctccccgtaaccgttacccggtacccgttacgttaacggtaccgggttaccgttaccggggttaaccgggaccggtaaacccggggtccgtaacccggg

SEQ ID NO: 21997 - DNA, 670 bp, Homo sapiens
  misc_feature: GYAE6OF02IPDFG.24.83.H06.1.454.CMB.1.raw
  modified_base (343)..(343): a, c, t, g, unknown or other
  misc_feature (343)..(343): n is a, c, g, or t
tcagactactatgtcacgaccggtgctcgatttagatcacgtgcgtcgcgggaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtgacctcgaggggtccctgagactctctgtagcagcctctggattccgcctttcaattaacttctaggatgcacgtcgggtccgcaagcctaccgagggggaaggggctagtatttggggtcctcgacggttattaacatttgagtggggntagcttcaacactagtcgcggactccggtaggaacggggcctattccgacattacctccgaaggacgaaccgaaccgccgtaaacgaaacctacaccgtttgtaactcgttagaacaaagttggacgacaacgcccgttaaaggaaaccggccgaaacggtaccgaacggtcgtacgttaagttactttaccggtggtaacgcggaaacgggtcggggacctagggacctaacgttttacccctaccttaacccgtcgtacccgtacgttaggttccgggaacggttccggttaccgggggaaccgaacggggtacccgtacccggg

SEQ ID NO: 21998 - DNA, 152 bp, Homo sapiens
  misc_feature: GYAE6OF01AFCF4.30.60.F05.1.454.CMB.1.raw
  modified_base (152)..(152): a, c, t, g, unknown or other
  misc_feature (152)..(152): n is a, c, g, or t
tcagcacgctacgtcacgaccggtgctcgatttagtacgtcatcagggaaagggaccaaggtggaagtcaaaggaactgtggctgcaccatctgtcttcatcttcccgccctcctcacgtagcgtgctgagcgggctggcaaggcgcatagn

SEQ ID NO: 21999 - DNA, 153 bp, Homo sapiens
  misc_feature: GYAE6OF02G07LF.30.60.F05.1.454.CMB.1.raw
  modified_base (130)..(130): a, c, t, g, unknown or other
  misc_feature (130)..(130): n is a, c, g, or t
  modified_base (151)..(153): a, c, t, g, unknown or other
  misc_feature (151)..(153): n is a, c, g, or t
tcagcacgctacgtcacgaccggtgctcgatttagtacgtcatcagggaagggaccaaggtggaagtcaaaggaactgtggctgcaccatctgtcttcatcttcccgccctcctcacgtagcgtgctgancgggctggcaaggcgcatagnnn

SEQ ID NO: 22000 - DNA, 162 bp, Homo sapiens
  misc_feature: GYAE6OF02IDMP0.30.60.F05.1.454.CMB.1.raw
  modified_base (152)..(162): a, c, t, g, unknown or other
  misc_feature (152)..(162): n is a, c, g, or t
tcagcacgctacgtcacgaccggtgctcgatttagtacgtcatcagggaaagggaccaaggtggaagtcaaaggaactgtggctgcaccatctgtcttcatcttcccaccctcctcacgtagcgtgctgagcgggctggcaaggcgcatagnnnnnnnnnnn

SEQ ID NO: 22001 - DNA, 158 bp, Homo sapiens
  misc_feature: GYAE6OF02FQAZ6.30.60.F05.1.454.CMB.1.raw
  modified_base (151)..(158): a, c, t, g, unknown or other
  misc_feature (151)..(158): n is a, c, g, or t
tcagcacgctacgtcacgaccggtgctcgatttagtacgtcatcagggaagggaccaaggtggaagtcaaaggaactgtggctgcaccatctgtcttcatcttcccgccctcctcacgtagcgtgctgagcgggctggcaaggcgcatagnnnnnnnn

SEQ ID NO: 22002 - DNA, 152 bp, Homo sapiens
  misc_feature: GYAE6OF02HGDOX.30.60.F05.1.454.CMB.1.raw
  modified_base (152)..(152): a, c, t, g, unknown or other
  misc_feature (152)..(152): n is a, c, g, or t
tcagcacgctacgtcacgaccggtgctcgatttagtacgtcatcagggaaagggaccaaggtggaagtcaaaggaactgtggctgcaccatctgtcttcatcttcccaccctcctcacgtagcgtgctgagcgggctggcaaggcgcatagn

SEQ ID NO: 22003 - DNA, 153 bp, Homo sapiens
  misc_feature: GYAE6OF02HAZYT.30.60.F05.1.454.CMB.1.raw
  modified_base (152)..(153): a, c, t, g, unknown or other
  misc_feature (152)..(153): n is a, c, g, or t
tcagcacgctacgtcacgaccggtgctcgatttagtacgtcatcagggaaagggaccaaggtggaagtcaaaggaactgtggctgcaccatctgtcttcatcttcccaccctcctcacgtagcgtgctgagcgggctggcaaggcgcatagnn

SEQ ID NO: 22004 - DNA, 163 bp, Homo sapiens
  misc_feature: GYAE6OF02FPVEQ.30.60.F05.1.454.CMB.1.raw
  modified_base (151)..(163): a, c, t, g, unknown or other
  misc_feature (151)..(163): n is a, c, g, or t
tcagcacgctacgtcacgaccggtgctcgatttagtacgtcatcagggaaagggaccaaggtggaagtcaaaggaactgtggctgcaccatctgtcttcatcttcccacctcctcacgtagcgtgctgagcgggctggcaaggcgcatagnnnnnnnnnnnnn

SEQ ID NO: 22005 - DNA, 512 bp, Homo sapiens
  misc_feature: GYAE6OF01BKO2C.51.38.D05.1.454.CMB.1.raw
  modified_base (265)..(265): a, c, t, g, unknown or other
  misc_feature (265)..(265): n is a, c, g, or t
  modified_base (409)..(409): a, c, t, g, unknown or other
  misc_feature (409)..(409): n is a, c, g, or t
tcagcgatcgtatacacgaccggtgctcgatttagtatctgatagttgggtttggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaagccccaaatcatgatttangatgtcagtgatcggccctcaggggtttcaatcgcttctctggctccaagtccggcaacacggcctccctgaccatctctggcctccaggccgaggacgaggctgattatactgcagctcatatacaatcaatacaattgggtnttcggcggagggaccaaactgaccgtcctaggtcagcccaaggctcgcccctggtcactctcgtcccaccctcctctcgtagctactctgacgcgggctcggg

SEQ ID NO: 22006 - DNA, 523 bp, Homo sapiens
  misc_feature: GYAE6OF01BJRWF.51.38.D05.1.454.CMB.1.raw
  modified_base (346)..(346): a, c, t, g, unknown or other
  misc_feature (346)..(346): n is a, c, g, or t
  modified_base (503)..(503): a, c, t, g, unknown or other
  misc_feature (503)..(503): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgaaacatttggtgtttataactatgtctcctggtaccagccaccaccaggcaaagcccccaaaatcatgatttatgatgtcagtgatcggccctcaggggtttcaatcgcttctctggctccaagtccggcaacacgcctccctgaccntctctggcctcaggccgaggacgaggctgattattactgcagctcatatacaatcaaatacaagttgggtgttcggacgagggaccaactcgaccgtctaggcacgacccaagcctcgcccctggtccactcctcgttcccaccctctcctcgtacncctactctgacgcggctcgg

SEQ ID NO: 22007 - DNA, 531 bp, Homo sapiens
  misc_feature: GYAE6OF01BCTA1.51.38.D05.1.454.CMB.1.raw
  modified_base (268)..(268): a, c, t, g, unknown or other
  misc_feature (268)..(268): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttangatgtcagtgatcggcccctcgagggggtttcaatcgcttctctggctccaagtccggcaacacggcctccctgacccatctctcggcctccgaggccgaggacgaggctgatttattactgcagctcatatacaatacaataactaagttgggtgttcggcggaggaccaactgaccgtctaggtcagcccaaggcctcgcccctgtccactctcgtccccgcccttcctcctcgtagcctactctgacggcgggcgtcggg

SEQ ID NO: 22008 - DNA, 591 bp, Homo sapiens
  misc_feature: GYAE6OF01EEP2C.51.38.D05.1.454.CMB.1.raw
  modified_base (271)..(271): a, c, t, g, unknown or other
  misc_feature (271)..(271): n is a, c, g, or t
  modified_base (557)..(557): a, c, t, g, unknown or other
  misc_feature (557)..(557): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagccaccacccaggcaaaacgcccccaaatcatgatttangatgtcagtgatcggcccttcgaggggtttcaatcgcttctctggctccaagtccggcaacacggcctcctgaccatctctcggcctccgaggccggagacgaggctagatttattactgcagctcaatataacaatacaaataacaagtttgggtcgttacgggcgggaagggaacccaaacgtcgaacccgtcgtacggtcacggcccgaaaggtcctcgacccccgtcgggtacctaccgtccttaccggttccccctaccccgttcccttcctccggtaacncccgtactcgttcggaacggccgggtctaccggg

SEQ ID NO: 22009 - DNA, 690 bp, Homo sapiens
  misc_feature: GYAE6OF01C73BL.51.38.D05.1.454.CMB.1.raw
  modified_base (277)..(277): a, c, t, g, unknown or other
  misc_feature (277)..(277): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcacgtgggaccagcggtgactattggtatttaataactatgtctcctggtaccagccaaccaccaggaccaaacgcccccaaatcatagtatttangatgtacagtgacgtccggccttaggtaggggtttcaatccgtcttcgtcgtggacctaccgaagtcccggacaaccgtaccggtccctaccgtacgaaccctagttccgtacgtcggccctacggacgggacccggagggaacgagggtaccttagtaactttacgttacgcggactacgtcctactaaacttaactaactaaactaactaaaagttaacgttaaggtttcggggtacggttaccgggaaccgggtaacggaaacctaaacgtcggacccgttacgtacggtaccgaccgaccgaacgtcccgtacccggccccgttacgtctacccttccgttacccggtacccctacccgttcctacgtaccgtacgcctacgtacgtacggaccgtcgggcgtacgggg

SEQ ID NO: 22010 - DNA, 541 bp, Homo sapiens
  misc_feature: GYAE6OF01E2K87.51.38.D05.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (434)..(434): a, c, t, g, unknown or other
  misc_feature (434)..(434): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcgtgacattggtntttanaactntgtctcctggtaccagccaccaccaggaccaaacgcccccaaactcatgatttangatgtcagtgatccggcctcgtaggggtttcactcgtcttctctggcctacgaacgtccggacacgacggtccctccngacctactcgtcncgcctcgacggccgaggacgnggctgattagttacngcagctcatactacatacaataactagttggtgtacggacggacggaccaacgtcgtaccgtcgtaggccacgccgtacggcctccggcccctggcctctcgtcccg

SEQ ID NO: 22011 - DNA, 600 bp, Homo sapiens
  misc_feature: GYAE6OF01EQLWE.51.38.D05.1.454.CMB.1.raw
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
  modified_base (420)..(420): a, c, t, g, unknown or other
  misc_feature (420)..(420): n is a, c, g, or t
  modified_base (445)..(445): a, c, t, g, unknown or other
  misc_feature (445)..(445): n is a, c, g, or t
  modified_base (472)..(472): a, c, t, g, unknown or other
  misc_feature (472)..(472): n is a, c, g, or t
tcagcgatcgtatacacgaccggtgctcgatttagtatctgatagttgggtttggggggggtctcaggaggcagcgctctcgggacgtctccaccatggcctggctctgctattcctcaccctcctcactcagggcacgagggtcctggcccagtctgccctgactcagcctgcctccgtgtctggtctccgtggacagtcatcaccatctctgcacgtggaccaggcggtagactagtttggtattttaataaacttgttgtccttccgtaggtacccagaccacccaccaggacaaaccgcccccaaatcatgtatttagngtatgtctagtnacgtccggccctgtagggttcaagtcgtacttctcgtcgacctacgaacgtccggacaacgaccgtccctccctgacctatctcncgtccctcgacggaccgtaggacgngtctgtattacgtactgacagtactanatactactaatactaaataacgtagttgggtacgtacgggacggaaacgtaccaaacgtcgtaaccgttccgaggtccaccgtaccgacgtcccgtcccgcccgtagtctacccgtcgttacccccgg

SEQ ID NO: 22012 - DNA, 719 bp, Homo sapiens
  misc_feature: GYAE6OF01BWOEV.51.38.D05.1.454.CMB.1.raw
  modified_base (227)..(227): a, c, t, g, unknown or other
  misc_feature (227)..(227): n is a, c, g, or t
  modified_base (286)..(286): a, c, t, g, unknown or other
  misc_feature (286)..(286): n is a, c, g, or t
  modified_base (679)..(679): a, c, t, g, unknown or other
  misc_feature (679)..(679): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctcgtgtctggtctccgtggacagtcgatcacctatctcctgcacgtcgggaccaggcggtgactagtttgggttattttaataactnttgtcctccgtaggtaccagccaccaccgaggaccaaccgaccccaatcatctagttangtatgtctagtgacgtccggccttacggtaggggtttacagtccgtcttaccgtcgtcggtcctaccgtacgtcccgaactaacccgtcccggtacccttccgtaccgaactcgtccgtccgtccgaccgttccgaacggccggaagggtcgaggtccgtagttaacgtttactcgtacgccgtagtccttataactaactaacgtaactaaacctaaagtaacgttaagggtttggggttaccgtacgggacgggaaacgtaaccgtaacgttcccggaaccggtttaccgacgggtaccacccggacccgtacggtcccgttaccccgcccggttagtacccacccgtttccgtacccccgtccctaccccgttcgtccttccggttaacncccgtaacgtcggttaaggcccggttcgggcgtaaccggg

SEQ ID NO: 22013 - DNA, 609 bp, Homo sapiens
  misc_feature: GYAE6OF01A4D7W.51.38.D05.1.454.CMB.1.raw
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (389)..(389): a, c, t, g, unknown or other
  misc_feature (389)..(389): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgttttaataactatgtctccgtggtaccagccaccacccgaggaccaaaacgcccccaaactcatgatttatgatgtcagtgatcggccctcgaggggtttcaatcgcttctctggctccagtccgcacncggcctccngaccatctctgcctcgcggcgaggacgagctagtattattacgngcagctacataataactaactactaaactaactaagtttgggtcggttacgggacgggtaacggaaccaacgtcggtaccgtacgtaggtacgacgacccgaacggtcctccgtccccgtcggtacctaccgttccgttcccggttcccccgtaccccgttcccgttccgtaccggtacgtccctaaccgttcggtaggccggccggggtcgtaccgggg

SEQ ID NO: 22014 - DNA, 900 bp, Homo sapiens
  misc_feature: GYAE6OF01EVFN1.51.38.D05.1.454.CMB.1.raw
tcagcgatcgtatacacgaccggtgctcgatttagtatctgatagttggggtttgggggggggtctcaggaggcagcgctctcgggacgtctccaccatggcctgggctctgctattcctcaccctcctcactcagggcacagggtcctggcccagtctcgccctgactcgagcctgcctcgtgtcgtgggtcctcgtggactagtcgaatccaacctattcctcctgacctacgtcgggaaccaggcggttagactagtttgggttaattttaaactaacttagtcgttaccgttccgtacggtaaccagaccctaaccgaaccgaaggaacccaaaccgtacccccaaaacttcctaagttaggtaactttttaagacgtaacgtttacggtacgtaacggttacggtaaccgtcccgggtaccccgtttacgggttaacgggggttttaaccgtaacgtttcgttcccgtttacgtccggtcggtacccgttaaccggtaaacggtccccgggtaactaaacccgggaccccgtaccccttaccccgtaacgtaaccgttaaccgttccgtccggttaccgggtaaccccgttaccggaacggggaacccggtaaggggtaacctacggttccgggttaaacctaaggtttaactttaacggtaaccgttacggaccgtaaacgttcctaaacttaaaccggttaactaaaccggaaatttaaaccggtaaaacgttttaaacggtacgggtttaacggggtaccggtaacgggggaaacccggtaaaccggtaacgtaaaccgtcccgggttaacccggttaacggaccggtaacggaaccgtaacccggtacgtacccccggttcccgtaaccgtcccgtacgttccctaccccg

SEQ ID NO: 22015 - DNA, 777 bp, Homo sapiens
  misc_feature: GYAE6OF01CI5C0.51.38.D05.1.454.CMB.1.raw
  modified_base (326)..(326): a, c, t, g, unknown or other
  misc_feature (326)..(326): n is a, c, g, or t
  modified_base (514)..(514): a, c, t, g, unknown or other
  misc_feature (514)..(514): n is a, c, g, or t
  modified_base (541)..(541): a, c, t, g, unknown or other
  misc_feature (541)..(541): n is a, c, g, or t
  modified_base (571)..(571): a, c, t, g, unknown or other
  misc_feature (571)..(571): n is a, c, g, or t
  modified_base (669)..(669): a, c, t, g, unknown or other
  misc_feature (669)..(669): n is a, c, g, or t
  modified_base (702)..(702): a, c, t, g, unknown or other
  misc_feature (702)..(702): n is a, c, g, or t
  modified_base (753)..(753): a, c, t, g, unknown or other
  misc_feature (753)..(753): n is a, c, g, or t
  modified_base (764)..(764): a, c, t, g, unknown or other
  misc_feature (764)..(764): n is a, c, g, or t
tcagcgatcgtatacacgaccggtgctcgatttagtatctgatagttgggtttgggggctttgcctgggctctgctattcctcaccctcctcactcgagggcacgagggtcctgggcccagtctgccctgactcagtcctgccctccgtgtcgtcgggtctccgtggacaggtcactcacctatccgtcctgcgacggtacgggaccagggtccggtagtacttaggttgggttaacttttaactaacttcgtcgttacctccggtagaaccacgaccaacccgacgacgacctaaaccgaccccgtaatcagttagttattaggntagtcgtactaggtacgaccggtccgtaccgttacggggttaacggtttactaccgttcctacgtttccgacggttccgtaaccgttaacccgacggttaccgacccgtaaaccggtcccgtaccccgtacgtaccggaacctcgttaccggtccgaccgtacccgacgggacgggtacgaagggacncggttatacgttatacgtacgcgtacncgttacctaactaaagttacaaacgttaanacgttaaagtacgggtttcggttagggtacggtaaccggaacggtaaacccggtacgtaaccgtaccggttcccgttaacgaccggtaccggaaaccnccgggtcccggtaacccgcccgtaccggttacncccggtacccttccgtccccgttacccgcttacggcctacggtcaccgtcncggttaccggngtcccgtgaacgg

SEQ ID NO: 22016 - DNA, 141 bp, Homo sapiens
  misc_feature: GYAE6OF02G6H01.51.38.D05.1.454.CMB.1.raw
  modified_base (140)..(141): a, c, t, g, unknown or other
  misc_feature (140)..(141): n is a, c, g, or t
tcagcgatcgtatacacgaccggtgctcgatttagtatctgatagttgggtttgggaggtcagcccaaggctggcccctcggtcactctgttcccaccctcctctcgtagcactctgagcgggctggcaaggcgcatagnn

SEQ ID NO: 22017 - DNA, 544 bp, Homo sapiens
  misc_feature: GYAE6OF02HC7ZG.51.38.D05.1.454.CMB.1.raw
  modified_base (252)..(252): a, c, t, g, unknown or other
  misc_feature (252)..(252): n is a, c, g, or t
  modified_base (310)..(310): a, c, t, g, unknown or other
  misc_feature (310)..(310): n is a, c, g, or t
  modified_base (349)..(349): a, c, t, g, unknown or other
  misc_feature (349)..(349): n is a, c, g, or t
  modified_base (414)..(414): a, c, t, g, unknown or other
  misc_feature (414)..(414): n is a, c, g, or t
tcagcgatcgtatacacgaccggtgctcgatttagtatctgatagttgggtttgggggggtctcaggaggcagcgctctcgggacgtctccaccactggcctgggctctgctattcctcaccctcctcactcagggcacagggtcctgggcccagtctgccctgactcagcctgcctccgtgtcctgggtcttcctggacaggtcgatcaccatctcctgcactgggaccagcggtgacattggtgtttaanaactatgtctcctggtaccagcaccacccaggccaaagcccccaaactcatgatttangatgtcagtgatcggccctgaggggtttcaatcgcttcnctggctcgaagtccggacaacaccggcctcctgacctatctctggcctcgaggccgaggacgagntgattattactgcagctcatatacaatcaaagtactaagtttgggtacgttcggacggtaaggaccaagtcgaccgtacctaggtccaagcccaaggccctacgcccccgttggtcctacttccgtaccc

SEQ ID NO: 22018 - DNA, 519 bp, Homo sapiens
  misc_feature: GYAE6OF02HM0KU.51.38.D05.1.454.CMB.1.raw
  modified_base (268)..(268): a, c, t, g, unknown or other
  misc_feature (268)..(268): n is a, c, g, or t
  modified_base (486)..(486): a, c, t, g, unknown or other
  misc_feature (486)..(486): n is a, c, g, or t
  modified_base (515)..(515): a, c, t, g, unknown or other
  misc_feature (515)..(515): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttangatgtcagtgatcggccctcgaggggtttcgaatcgcttctctggctcaagtccggcaacacggcctcctgaccatctctggcctcgaggccgaggacgaggctagatttatactgcagctcatatacaatacaataacaagttgggtgttcggcggacggaccaaacgtcgaccgtccgtagtcagcccaagctcgcccctgtcactctcgttcccnccctcctctcgtacgcactctgacgcggntcgg

SEQ ID NO: 22019 - DNA, 547 bp, Homo sapiens
  misc_feature: GYAE6OF02H9NN1.51.38.D05.1.454.CMB.1.raw
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaagcccccaaactcatgatttatgatgtcagtgatcggccctgaggggtttcaatcgcttctctggctccaagtccggcaacncggcctcctgaccatctcnggcctcaggccgaggacgaggctgatttacttactgcagctacatatacaatacaataacaagttggtgttcggacggagggaccaaacgtcgtaccgtacgtagcgacgccgaagcctcgcccctcggtccactcctcgttccccgtcccttccctccgttccgtacgcctactcgtacggacggtccgggcgtacggg

SEQ ID NO: 22020 - DNA, 588 bp, Homo sapiens
  misc_feature: GYAE6OF02GJ9ME.51.38.D05.1.454.CMB.1.raw
  modified_base (249)..(249): a, c, t, g, unknown or other
  misc_feature (249)..(249): n is a, c, g, or t
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (437)..(437): a, c, t, g, unknown or other
  misc_feature (437)..(437): n is a, c, g, or t
  modified_base (528)..(528): a, c, t, g, unknown or other
  misc_feature (528)..(528): n is a, c, g, or t
tcagcgatcgtatacacgaccggtgctcgatttagtatctgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacatttggttttanaactatgtctctggtaccagcaccaccaggcaaaacgccccccaaaatcatgtatttangatgtcagtgatcggccctgaggggtttcgaatcgcttctctggcncctaagtccggacaacgcggtccctccctgaccctatctcgtcggccctccgaggcccgagggacgagctgaatttattacgngcagctacaattacaacaatacaaataaacctaagttgggtggttaccggcgggaagggaaccctaagtcgtaccccgtagtaaccgggtnaaccggaccccaaggtcccgtaccgcccccgttcggacctacgtccttccggttaccccc

SEQ ID NO: 22021 - DNA, 661 bp, Homo sapiens
  misc_feature: GYAE6OF02I39TI.51.38.D05.1.454.CMB.1.raw
  modified_base (275)..(275): a, c, t, g, unknown or other
  misc_feature (275)..(275): n is a, c, g, or t
  modified_base (393)..(393): a, c, t, g, unknown or other
  misc_feature (393)..(393): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtcctcctggacagtcgatcaccatctcctgcactgggaccagcggtgactagttggtgtttataactatgtctcctcggtaccagcaccacccaggacaaacgcccccaaatcaatgatttangatgtcagtgatcggccctcgaggggtttcaatcgcttctctgctacaagtccgacaacgacggcctcctagacctatctctcggcctcgaaggccgaagcgaggctagtattatacngtacagctactaagtacttaacaaacgttacaaagttaaacgtaaagtttcggggtacgtttaccgggaccgggtaaggggtaaaccctaaacgtcggtaacccgttaccgttaacgggtacccaaccggtaccccgaaagggtcccttacccggacccccgttagggtacctaaccgttccttaacccggttcccccctaacccttccggttacccgtaccggtacacccttaccgttcctcgggaaccggtccgggcttaccgggg

SEQ ID NO: 22022 - DNA, 572 bp, Homo sapiens
  misc_feature: GYAE6OF02IIG2B.51.38.D05.1.454.CMB.1.raw
  modified_base (309)..(309): a, c, t, g, unknown or other
  misc_feature (309)..(309): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccaggcggtgactattggtgtttataactatgtctcctggtaccagcaccacccaggcaaacgccccccaaatcatgatttangatgtcagtgatcggcctcgtaggggtttacaatcgtcttctctggcctccgaagtccggacacacggcctccctgaccatctctcggccctcgacggcgaggacgaggtctaggtattattactgcagctacatatacaatcaaataataagttgggtagttacgggacggtacgggaacctaagtccggaccgtctaggtaccacggtaccccgaagggcccttaccggccccccgttgggtaccctaccgttccttcccg

SEQ ID NO: 22023 - DNA, 644 bp, Homo sapiens
  misc_feature: GYAE6OF02GVSK6.51.38.D05.1.454.CMB.1.raw
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgcccccaaactcatgatttatgatgtcagtgatcggccctcgaggggtttcaatcgcttctcgtggctccaagtccggacaacgcggccctcctgacccatcctcgtcggcctcgacggccgaggacgaggctgtatttattacgtgcacgctacattatacaaagtccaaattaacgtaagtttgggttacggttccgggacggtaacgggaacccaaacgtcggtaacccgttccgtaggtcaacgcccgtaaggtccgtccgcccccgttcgggtacctaccgttccgttaccggttccccctaacccccgttcccgttccgttacccggttaaccgtcccgttaaccgtttcccggttacggtaaccggggtcccggggtacttaccgggg

SEQ ID NO: 22024 - DNA, 639 bp, Homo sapiens
  misc_feature: GYAE6OF02IDCPV.51.38.D05.1.454.CMB.1.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (320)..(320): a, c, t, g, unknown or other
  misc_feature (320)..(320): n is a, c, g, or t
  modified_base (379)..(379): a, c, t, g, unknown or other
  misc_feature (379)..(379): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgccctcgtgtctgggtctctggacagtcgatcaccatctcctgcacgtcgggaccaggcggtgactagtttgggtntttaanaactatgtctctggtaccngcaccaccgaggcaacgccccaaatcatgtatttatgatgtcagtnactcgcctacgtagggtttcaatcgtcttctctcggctcacgtcgacacgacgcctccngactactctacgtcggccctacgacggccgagggacgagtcgtagtactttaagttacgtgactacgtctacgattaacgtaacctaaattactaaactaacgttaaggtttcggggttgttaccgggacgggtaaacggtaacccctaacgtacggttacccgtccgttaacgggtaccaacccgggtacccttaacggggcccctttacccggtacccccggttaccgggttacccttacccgttcgttacccccggg

SEQ ID NO: 22025 - DNA, 609 bp, Homo sapiens
  misc_feature: GYAE6OF02GZ29V.51.38.D05.1.454.CMB.1.raw
  modified_base (401)..(401): a, c, t, g, unknown or other
  misc_feature (401)..(401): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccaggcggtgacattggtagtttataactatgtctccgtggtaccagccaccacccgaggaccaaacgcccccaaatcatgatttatgatgtcagtgatccggccctcgtaggggtttcgaattcggcttctcgtcgctacagtccgacaacacggccctcctcgacctatcctctcggcctccacggccgaggacgaggctgatttattcngcacgctcaatataacaactacaaactaaacgtaagtttgggttacgttcggggacggacgggaaacctaagaccggaccgttaccgtaggtacaccgacccgtaagtccgtccgtccccgtcgacctaccttcgttcccggttccccgacccttccgtacctaccggtacgtcctaccctcgtaccggtcggaccggtggtaaccgg

SEQ ID NO: 22026 - DNA, 720 bp, Homo sapiens
  misc_feature: GYAE6OF02I9Y7S.51.38.D05.1.454.CMB.1.raw
  modified_base (198)..(198): a, c, t, g, unknown or other
  misc_feature (198)..(198): n is a, c, g, or t
  modified_base (273)..(273): a, c, t, g, unknown or other
  misc_feature (273)..(273): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctctgcacgtggaccagcggtanactattggtatttataactatgtctcctggtaccagccaccaccaggaccaaaccgccccaaatcatagtattangatgtcagtgacgtccggccctaggtacggggtttcgaacgttcgtccttcgcgtcggcgtacccgtaacgtcccggacgaaacctccggcccttaccgtacggaacctactccgttacgtcggtcccgtacgacggggaccgtacggtaacgacggtctacgttacttacgttacgtcgacgtacgaccgtacgtaacttaactaacgtaactaaccgttaaaacgttaacggttaaacggttcggggtttacgggtaccgggttacgggaacggtaacctaaaccggtcggttaaaccccggtcggttaccggtaccgaccggaccggtaacggtccgtaccgtccccgtacgttcctacgttcccgttcccggttccctcccgttccgttacccgtcgttaccgaccgttaccgttccgacggtccgggtacgtccggtacggg

SEQ ID NO: 22027 - DNA, 681 bp, Homo sapiens
  misc_feature: GYAE6OF02FHLXH.51.38.D05.1.454.CMB.1.raw
  modified_base (217)..(217): a, c, t, g, unknown or other
  misc_feature (217)..(217): n is a, c, g, or t
  modified_base (276)..(276): a, c, t, g, unknown or other
  misc_feature (276)..(276): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactntgtctccgtggtaccagccaccacccgaggaccaaacgcccccaaactcatgtatttangattgtcagtgactccggccctcggtacggggtttcaatcgtcttctctcggtcctaccgaagtcccggaccaaccgaccggtccctcccgtacgacctacttccgtcgtcggccctccgacgggtcccggaagggaccgacgggtctaggttaacttacgttacgtggtacacgtctactaattactaactaataccaaaataaccgttaggtttcgggtcggttacgggaccggtaacgggaccctaaacgtcgtacccgtgtacggtacaacggtacccgaacggccttacccggccccgttacggtaccctcgttacccgttccggttaccccccgtcccttccccgttacgtaccgtacgcccttaccgtccggtaggtacccgggtccggcgtaccggg

SEQ ID NO: 22028 - DNA, 880 bp, Homo sapiens
  misc_feature: GYAE6OF02I1DIK.51.38.D05.1.454.CMB.1.raw
  modified_base (275)..(275): a, c, t, g, unknown or other
  misc_feature (275)..(275): n is a, c, g, or t
tcagcgatcgtatacacgaccggtgctcgatttagtatctgatagttgggtttgggggggggtctcaggaggcagcgctctcgggacgtctccaccatggcctgggctctgctattcctcaccctcctcactcagggcacgagggtcctgggcccaggtctcgccctgacctcagcctcgcctccgtgtcgtgggtctccgtggacagtcgatccactactctcctgcacgtcgggaccaggcggtgactagtttgggttatttaactaacgttntcgttccttccgtacggtaccacgaccaacccaacccgaacggaaccaaaaccgaccccctaaaactcctaagttacgttaacttttaagtacgtacttagtacgttacggtacggttaccgttcccgggtacccgtttacgggttaacggggttttaccgtaaaccgttcgttcccgtttccgttcgtccggtaccctacccggtaaaccggttacccggaaccgaacccggttcccggtaccccgttcccgtacggtaaccgtcgttcccgtacgtacccggtacccgtaccccgggtacgggaacccggtacgggaaccggtcggttaccgttaacggttactttaacgtacggtcctacgaccgttaccgttacacgtttaaacaaccgtaaacttaccgttaaaagttaaacgtacgggttttacgggttacgggttaccgggaaaccggggtaaaccgtaaccgttaaccggttaccggttaacccggttaaccgttaacgggtaacccgtaaccggaacccgttaaccgggtcccttaaccccgggtacccccggtttaccggtaacccgtttacccgttacccgtttaaccccccgg

SEQ ID NO: 22029 - DNA, 1126 bp, Homo sapiens
  misc_feature: GYAE6OF02I2QPX.51.38.D05.1.454.CMB.1.raw
tcagcgatcgtatacacgaccggtgctcgatttagtatctgatagtttggggtttgggggggggtctcaggaggcagcgctctcgggacgtctccaccatggcctgggctctgctattcctcaccctcctcactcagggcacgagggtcctgggcccagtctcgccctgactcagcctgcctcgtgtctgggtctccgtggactagtcgactccacctattcctcctgcacgttcgggaccaggccggtagactagtttgggttagtttaaactaacttagttcgttccttaccgttacggtaacccacggtacccaaacccgaacccccgaaggaaacccgaaaaacccgacccccccctaaaaacttccgaacgtttaggtttaaactttttaagtagggttaaccgtttacggttaaccgaacgggtttacggtaaccgttcccccggggtaccccggttttaccggggttaacggggggtttttaccctaaaccggttccccgtttaccgttttcccggtttaccggtttaccggggtacccctttaacccgggaaaccgggtttacccccggggaaacccttaaaaccccgggtcccccggttaccccccgttaccccccggttaaaccggtaacccctttaacccggtttcccgttccccgggtaaccccgggtccccccgttaaaccggggtaaaccccgggggtaaccccggggtaaaacgggggttaaccccgggtaaccgggggttacccggtttaacggtttaaacccttttttaacgggtttaacccgccgggttaacccgtaccggttacccttaaacggtaaccttttaaaaccgaaaccgttaaaacctttaaaccgtaaaaaaggtttttaacccggttaaagggggtttttcccgggggttaccgggtttaaacccgggggtaaacccgggggaacccgggttaaaacccccgttacggtttaaccccgggtaccggtttaacccgggtttaaccgggaccggtaaaccccgggttaacccggaacccggggttcccccttaaccccggggtttcccccccggtttaaccggtaccccgttacccggttttaccccccgttcccccggg

SEQ ID NO: 22030 - DNA, 798 bp, Homo sapiens
  misc_feature: GYAE6OF02FYTGH.51.38.D05.1.454.CMB.1.raw
  modified_base (199)..(199): a, c, t, g, unknown or other
  misc_feature (199)..(199): n is a, c, g, or t
  modified_base (320)..(320): a, c, t, g, unknown or other
  misc_feature (320)..(320): n is a, c, g, or t
  modified_base (377)..(377): a, c, t, g, unknown or other
  misc_feature (377)..(377): n is a, c, g, or t
tcagcgatcgtatacacgaccggtgctcgatttagtatctgatagttgggtttgggggctttgcctgggctctgctattcctcaccctctcactcagggcacagggtcctgggcccagtctgccctgactcagcctgcctccgtgtctgggtctcctggacagtcgatcaccatcgtcctgccactgggaccagcggtnactagtttcggtagttttaacaacttattcggtcctccgtggtaccagccaccaccgagacaacgcccctaatcaatcgtatttagtgatgtacagtgctacgcctgtacgggttcagtcncttctcgtcggctccgaggtccgacgtaaccgaccgtcctccgtagtacctattccncgttcgacccgttacgacgggtaccgaagggacggtacggtacgttagttaacttttaacgtaccgttacggaccgacgttacctaacgtaactttaaccgtaaacctaacgttaacccttaaacggtaaacggtttaacgggtttcgggggttacgggtttaacccggggacgggaaacccgggttaaccctttaaaccgggtaccggttaacccggttacgggttaaccggtaccgtaacccggttaccgggtaaaccgttccccgttacccggtaccccgtttaccgggtacccgtttaccgtacccggttacccccgttaacccccgttacccggtttacccgttccgttaacccgtaccggtacctttaacccggtccggttaggaaccccgggggttcggttacccggtaccggg

SEQ ID NO: 22031 - DNA, 750 bp, Homo sapiens
  misc_feature: GYAE6OF02FQQJC.51.38.D05.1.454.CMB.1.raw
  modified_base (193)..(193): a, c, t, g, unknown or other
  misc_feature (193)..(193): n is a, c, g, or t
  modified_base (306)..(306): a, c, t, g, unknown or other
  misc_feature (306)..(306): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcacctgggaccnggcggtgaccattgggttgtttaataacgtatcgttctccgtaggtaccagctacccaccgaggaccaaacgacccccctaaatccgtagtagtactttagtcgtatggtacnggttacgaacgttccccgggacccgttaggtaacggggggtttttcaaccgttcggtacctttaccgttccggttccggaccttacccgtaagggttccccgggaaccaaccggtacccggtccccttaccccgtaggaacccttagtccggtttaccaccgggtacccttccgaaaccgggggccgaaacggggtacggtaccggggttatttacggtaaacgttttccgttaaccggtcggtactacggtaccttacgtaaacttaaacgacttaaataaccgtaaatacgtaagttcggggttcgtaacgggcggaacggacctaacggcgtaccgtacggtaacgacctacgaccgagtccctcccgccgtccgtactacgtccttaccgtcccaaccttcctcgttacgcgactcggtacacggtcggtccgtgtacgg

SEQ ID NO: 22032 - DNA, 532 bp, Homo sapiens
  misc_feature: GYAE6OF01DGN8O.35.3.A03.1.454.CMB.1.raw
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctgggcccagtctgtggtgactcagccaccctcaacgtctgggacccccgggcagagggtcaccatctcttgttctggaagcagctccaacatcggaagtaatactgtaaactggtaccagcagctcccaggaaccgcccccaaactcctcatctataataataatcagccgccctcaggactccctgacccgattctcgtcggctaccgaagttctgggccgtccctcacgtccctcccgtggcccatcagtcgggctccgagtctgaggatggaggtctgtattatcacgtgtgcagcagtgggatgacagctggaagtggggtggttggttgggcggagggaccgaggcgtagacccgtcgtaggtcacgcccgaggtcccg

SEQ ID NO: 22033 - DNA, 545 bp, Homo sapiens
  misc_feature: GYAE6OF01EHMMH.35.3.A03.1.454.CMB.1.raw
  modified_base (424)..(424): a, c, t, g, unknown or other
  misc_feature (424)..(424): n is a, c, g, or t
  modified_base (538)..(538): a, c, t, g, unknown or other
  misc_feature (538)..(538): n is a, c, g, or t
  modified_base (545)..(545): a, c, t, g, unknown or other
  misc_feature (545)..(545): n is a, c, g, or t
tcagtacagatcgtcacgaccggtgctcgatttagagagcgtcacagaccctgtccctcacctgcactgtctctggtggctccatgagcagtggtggttactactggagttggatccgccagcacccagggaagggcctggagtggattgggtacatctattacagtgggaggacccactacaacccgtccctcaagagtcgacttaccatatcagtagacacgtctaagaaccagttctccctgaagctgagctctgtgactgccgcggacacggccgtgtattactgtgcgagagatccttactatggttcggggattattataattatcgcgtctttttgattagtttggggccaaaggggacaatggtcaccgtctcttcagcctccacgaagggcccatccggtccttccccctggccnccctgcctccgaggacgccacccgtccgacgacgcacagccggcccgtggggcctcgccttggtaccaaggcctacgtccacgactcgtcgtactggagcggctggcaaggccncgagtgn

SEQ ID NO: 22034 - DNA, 535 bp, Homo sapiens
  misc_feature: GYAE6OF01AOK6N.35.3.A03.1.454.CMB.1.raw
  modified_base (347)..(347): a, c, t, g, unknown or other
  misc_feature (347)..(347): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactactggagttggatccgccagcacccagggaagggcctggagtggattgggtacatctattacagtgggaggacccactacaacccgtccctcaagngtcgacttaccatatcagtagacacgtctaagaaccagttcctccctgaagctgagctctgtgactgccgcggaccacggccgtgtacttactgtcgcgagacgatccttactatgggttcgggtagttattagtaattatcggtcgtcttttgattagtttcggggacctaagggtactaagtcggg

SEQ ID NO: 22035 - DNA, 878 bp, Homo sapiens
  misc_feature: GYAE6OF01AX1EH.35.3.A03.1.454.CMB.1.raw
tcagtacagatcgtcacgaccggtgctcgatttagagagcgtcacagggggggtagagaagacaggactcaggacaatctccagcatggccagcttccctctcctcctcaccctcctcactcactgtgcagggtcctgggcccagtctgtggtgactcagccaccctcaacgtctgggacccccgggcagagggtcaccatctcttgttctggaagcagctccaacatcggaagtaatactgtaaactggtaccagcagctcccaggaaccgcccccaaatcctcatctataataataatcagccggccctcagggacgtccctagaccgtatttcctcgtcggcctaccgaacggttctagggcctccctcgaccggtcccctccccgttgggacccctaagtcccgaacgggttcggggtccctacccgtaacggttccgttagggaacgggtagttcgggaacgggtcctttacgggtaattttaacgtaccgtaaccgttgggttacggaccgtaaggtacccgtaagggttacgggggtaacttaccggggtaaccgtacgggttaccccgttaaggggttaaacggggtttcggggggggttttagggggttttacggggttttacgggggacccggggggttaaaccgggggggtaaaccccgtaaacggggttcccggttaaacccgggggttaaaccccccgggtttacccgggtttaaaccgggggttaccccggttaaaaccccggggtaccccccgggtaaaaacggggttcccccggtttaaacccccggggtcccccccccgggtttacccggggtttaacccccgttaacccggtttccccgggttttaaacccccccccggg

SEQ ID NO: 22036 - DNA, 537 bp, Homo sapiens
  misc_feature: GYAE6OF01BHM2P.35.3.A03.1.454.CMB.1.raw
  modified_base (378)..(378): a, c, t, g, unknown or other
  misc_feature (378)..(378): n is a, c, g, or t
  modified_base (449)..(449): a, c, t, g, unknown or other
  misc_feature (449)..(449): n is a, c, g, or t
  modified_base (493)..(493): a, c, t, g, unknown or other
  misc_feature (493)..(493): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactactggagttggatccgccagcaccccgagggaagggcctggagtggatttggggtacatctattacagtgggaggacccactaccgaacccgtccctacgaagagtcgaacttaccatactcagtanacacgtctaagacctagttctccctagaacgctgagctctgtgactgccgcgacgcggccgtgtacttacngtgcgagatctccttatagtgggttacgggtattagtataattntcggcgttcttttgagtttagttcgggacagggtactaagtcgg

SEQ ID NO: 22037 - DNA, 663 bp, Homo sapiens
  misc_feature: GYAE6OF01D4W1A.35.3.A03.1.454.CMB.1.raw
  modified_base (354)..(354): a, c, t, g, unknown or other
  misc_feature (354)..(354): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctctggtgctccatgagcaggtggtggttactacgtggagttggactccgcagccgaccgaggggaacggcctagggagtggagttgggtacatctattacgaggtgggacgacccactaccaacccgtcctanaagtagtccgaacttacatactcaagtacgactacgtactaaacgacctacgttcctaccctagaacgtcttagaacgtcttcgtggtacgaccgtcggcccggacggaccgaccggtccgttagttaacgttaccgtggtacgacgtaacgtacgtacttacccgttaacgttaggttacggggtttacgggtaaagttttaacgtttaagttaaacgttttagtcccggttacgtttacgtttttaggaacgttttacgggttttaccgggggaaccttaaagggggtacctaaagggtttcccggg

SEQ ID NO: 22038 - DNA, 520 bp, Homo sapiens
  misc_feature: GYAE6OF01A37IU.35.3.A03.1.454.CMB.1.raw
  modified_base (453)..(453): a, c, t, g, unknown or other
  misc_feature (453)..(453): n is a, c, g, or t
  modified_base (478)..(478): a, c, t, g, unknown or other
  misc_feature (478)..(478): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggacaggtgaagccttcacagaccctgtccctcacctgcactgtctctggtggctccatgagcagtggtggttactactggagttggatccgccagcacccagggaagggcctggagtggattgggtacatctattacagtgggagacccactacaacccgtccctcaagagtcgacttaccatatcagtagacacgtctaagaaccagttctccctgaacgctgagctctgtgactgccgcggacacggccgtgtattctgtgcgagagatccttanagtgggttcgggattattataattntcgcgtctttgattagtttggggacctaagggactaagtcgg

SEQ ID NO: 22039 - DNA, 641 bp, Homo sapiens
  misc_feature: GYAE6OF01EHYTR.35.3.A03.1.454.CMB.1.raw
  modified_base (190)..(190): a, c, t, g, unknown or other
  misc_feature (190)..(190): n is a, c, g, or t
tcagtacagatcgtcacgaccggtgctcgatttagagagcgtcacagggggggtagacgaagacaggactcaggacaatctccagcatggccagcttccctctcctcctcacccctcctcactcactgtgcagggtcctgggcccagtctgtggtgactcagccaccctcaacgtctcgggacccccggnagagggtcaccatctcttgttctggaacgcagcctaccaaacagtacggaaagtaatacctagtaaactggtaccagcagcctacccgaggaacccggcccccaaactcctacatcctaataaataataatcaaggccggccctagaggactccctggaccgtattctcgtggtcctaccgaagtctggccgtcctcgacgtccctcccgtggccatcgaggtcggcctccgagtctggaggtatggaggtctaggtattatctacgttgtcgcagcgagtgggtatacgacgacgtaccgtaggaaggttgggggttgggttgggtttcggggacgggtacgggaaccgtaacggtcgtacgggtacccgtccggttagggtaccgaccggacccgaacggcccgttcccggaccccccgttacggtaccctaccgttccgttacccccg

SEQ ID NO: 22040 - DNA, 582 bp, Homo sapiens
  misc_feature: GYAE6OF01EQD7K.35.3.A03.1.454.CMB.1.raw
  modified_base (435)..(435): a, c, t, g, unknown or other
  misc_feature (435)..(435): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctcatgagcagtggtggttactacgtggagttggatccgcagcacccgagggaagggcctgggagtggattgggtacatctattacaggtgggacgacccactacaacccgtccctacaagagtcgacttaccatatcagtagacacgtactaacgaacctagtttacctccctagaacgctagacgcttctgtgactcgccgcgacncggcgtgtattactgtgcgtagagtacttccttacgtagtgggtttacggggtaagtttaagttaagttaacgttagttcggtccgttcgtttttaggaacgtttaggttttacgggggaaccctaaggggtaactaagttaccggg

SEQ ID NO: 22041 - DNA, 634 bp, Homo sapiens
  misc_feature: GYAE6OF01CMIFP.35.3.A03.1.454.CMB.1.raw
  modified_base (344)..(344): a, c, t, g, unknown or other
  misc_feature (344)..(344): n is a, c, g, or t
  modified_base (408)..(408): a, c, t, g, unknown or other
  misc_feature (408)..(408): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctcatgagcagtggtggttactagtggagttggatccgcagccaccgaggggaaggccgtggagtggattggtacatctattacgaggtgggacgacccactaccaacccgtcctanaagacgtcgacttacaatatcgagtacgactacgtactaaacgacctagttcctaccgtagaanccgttagacgtccttcgtagtcgactcggacccgcggaaccgaccggtcttagttattacgtgtggacgagtacgtactttcccgttaattacggttacggggtttacggggtaaattttaggttaaaagtttaacgtttacgttaccggtcggttttcgtttttaaaggacgttttaggggttttacgggggaaccctaaaggggtaaccttaaggttcccgggg

SEQ ID NO: 22042 - DNA, 607 bp, Homo sapiens
  misc_feature: GYAE6OF01D1G1B.35.3.A03.1.454.CMB.1.raw
  modified_base (218)..(218): a, c, t, g, unknown or other
  misc_feature (218)..(218): n is a, c, g, or t
  modified_base (342)..(342): a, c, t, g, unknown or other
  misc_feature (342)..(342): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactntcgggtctggtgctccatgagcagtggtggttactactggagttggatccgccagcacccagggaagggcctggagtggattgggtacatctattacgagtgggacgaccactacacccgtccncaagagtcgactaccatactacagtagactacgtactaaacgaacctagttcctaccctagaacgtcgtagaacgtccttacgttggtacgtacgtcggacccggcggaaccgaccgggccgttagttactttaacgtgtacggcgagtagtacttccttagtagtggggtttacgggtagtttaagttaagttaacgtttatccggtcgttacctttttgaactttaggtttacggggacctaaaggggtactaggttacccgg

SEQ ID NO: 22043 - DNA, 578 bp, Homo sapiens
  misc_feature: GYAE6OF01EN0DK.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgagcagtggtggttactactggagttggatccgccagccacccgaggggaacggcctgggagtggagttgggtacatctattacgaggtgggacgacccactaccaacccgtcctcaaagcgtcgacttaccatactcagtacgacacgtactaaagaacctagttacctccctagaacgtctagacgtctcgtgtcgactcggcccgcggaccgacggtccgttagtacttacgtgtcgcgtagacgtacttccttatagttcgggttacgggtatttaatttaagtaattagtcgtcgttcgttttagagtttaggttcggggacctaagggtacctagtcgg

SEQ ID NO: 22044 - DNA, 581 bp, Homo sapiens
  misc_feature: GYAE6OF01D82M3.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgagcagtggtgttactacgtggagttggatccgccagcacccgaggggaacggcctgggagtgggattgggtacatctattacgagtgggacgacccactaccgaacccgtcctacaagacgtcgacttacatatcagtagacacgtactaagaacctagttcctaccctagaacgtctagacgtctcgtgtgtacgtcgcccggacggaccacggccgttagtacttacgtgtcgacgtagtagtacttccttagtacgttgggttacgggtagtttaattacgtaatttagtcggtcgttcttttagatttaggtttcggggaacctaaggggtactaaggttcgg

SEQ ID NO: 22045 - DNA, 536 bp, Homo sapiens
  misc_feature: GYAE6OF01BL4N0.35.3.A03.1.454.CMB.1.raw
  modified_base (371)..(371): a, c, t, g, unknown or other
  misc_feature (371)..(371): n is a, c, g, or t
  modified_base (454)..(454): a, c, t, g, unknown or other
  misc_feature (454)..(454): n is a, c, g, or t
  modified_base (496)..(496): a, c, t, g, unknown or other
  misc_feature (496)..(496): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgagcagtggtggttactactggagttggatccgccagcaccccgagggaacgggcctggagtggattgggtacatctattacagtgggacggaccactacaacccgtccctacaagacgtcgacttacatatcagtanacacgtactaagaacctgttcctccctgaacgctagacgtctactgcgactgcccgcggaccacgggctagtattacgtgcgngagagattccttactagtcgggttcgggtattattataattntcgtgttctttgattagtttagggactaagggatagtcgg

SEQ ID NO: 22046 - DNA, 631 bp, Homo sapiens
  misc_feature: GYAE6OF01CHMFW.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctcatgagcagtggtgttactacgtggagttggatccgcagcacccgaggggaacggccgtgggaggtggagttggggtacagttctaattacgaggtgggacggaccccacgtaaccaaccccgtcctacgaacggtacgtacgacctttaaccattaactacgagtacgaactacgtactaaacgacctagttcctacccgtagaacgctagacgtctcgtgtcgactcggcccgcggacacggtccgtgtacttacgtggtacgacgagacgtacttacctttacgtaggttgggttacgggtaatttaagtttaagttaactttagtacggttcgtttacgtttttagtaagtttacggtttagggggaaccctaaaggggtaccttaaaggttaccggg

SEQ ID NO: 22047 - DNA, 728 bp, Homo sapiens
  misc_feature: GYAE6OF01E13X8.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctcgtggtcgctccatgagcagtggtgttactacgtggagttgactccgccagccaccgaggggacggcctgggagtggagttgggtacattctattacgaggtgggaacgaccccactaccaaccccgtcctacgaaagcgtaccgactttaaccatactacgaagtagaactacgtactaaagaaccctagttcctacccgtagaacgtccgttagacgtcttacgttggacgtacgtcggaccccgggtccgggaaccgtacccgggtaccggttagttaacgtttaccgtgggtacggaccggtaaggtaacgttacctttacccgttttaaacggttaggtttccggggggtttaaccggggtttaaagttttaaacgttttaaacgtttaaacgtttaccgtttaccgggtccggtttttaccgtttttagggtaacgttttaacggggttttacgggggaaacccgttaaagggggttaaccctaaagggtttacccgggg

SEQ ID NO: 22048 - DNA, 602 bp, Homo sapiens
  misc_feature: GYAE6OF01D6YBV.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgagcagtggtggttactacgtggagttggatccgcagcacccgaggggaacggcctggagtggattgggtacatctattacgaggtgggacggacccacgtaccaacccgtcctacaagacgtcgacttaccatatcagtacgacacgtactaagaacctagttcctacccgtagaagtcttagacgtctctgtcgacgtcggcccggacggaccgacggtccgttgttacttacgtgtacggacgtaagacgtacttccgttacgttaggttcgggttacggggtatttaagttaagttaactttagtccggtcgttctttttagaacgtttaggtttacggggacctaaaggggtctaaagttcggg

SEQ ID NO: 22049 - DNA, 594 bp, Homo sapiens
  misc_feature: GYAE6OF01EM111.35.3.A03.1.454.CMB.1.raw
  modified_base (342)..(342): a, c, t, g, unknown or other
  misc_feature (342)..(342): n is a, c, g, or t
  modified_base (366)..(366): a, c, t, g, unknown or other
  misc_feature (366)..(366): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactactggagttggatccgcagcacccgagggaaggcctggagtggattgggtacatctattacgagtgggacgacccactaccaaccgtcccnaagagtcgacttacatatcagtanacacgtctaagaacctagttctccctgaacgcttgacgcttctgtagacgttcgcccggcggaaccgtaccgggtcccgttagttaactttacgtggtcgacgagtagtacttacccgttaattacggttggggttccggggtaagtttaagtttaattaagtttattcggtcgttacttttaggaatttaggtttacggggaccctaaaggggtactaagttacggg

SEQ ID NO: 22050 - DNA, 685 bp, Homo sapiens
  misc_feature: GYAE6OF01DS9KK.35.3.A03.1.454.CMB.1.raw
  modified_base (304)..(304): a, c, t, g, unknown or other
  misc_feature (304)..(304): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcgaggagtccgggcccaggactggtgaacgtccttcacacgaccctcgtcccctcacctgcactgtctcgtggtcgcctcatgagcgtagtggttagttactacgtggtagttggactccgcagccaccggaagggacggtccngggaggtggtagttagggactagttctaagttacgaggtagggaaccaaccctacctaaccgaccccgtcctaagaacgacgtaccaacttaccaatactagacgtacgacctaacgtacgtaaacgaacctacgttccaccgtagaactctagacgttctcgttgacgtaccgtcggccggtaaccgtccgtaaccgggtcgtttagtaacgttcgtaggtcgaccggtaagtaccttacgttacccgtttaagtacgggtttcgggggttaacggtaattttaacgtttaagtttaacgttcggttcgttggttttaccttttgggaagttttaacggggttacggggaaaccgaagggttaacctagggtttacccgg

SEQ ID NO: 22051 - DNA, 674 bp, Homo sapiens
  misc_feature: GYAE6OF01CYBGM.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagttggtggttactacgtggagttggatccgcagcacccgagggaacgggcctggagtggtagttgggacatctattacgaggtgggacggacccacgtaaccaacccgtccctacgaagtacgtccgtaactttacaatatacgagtaacgaccacgttactaacgaacctagttcctaccccgtagaacgtcctaggtacgtcgttaccgtggtcgtaccgtcggcccggaccgggtaaccgtaccgggtccgttagttaactttacgtggtacggacgaggtacgtacgtttacccgttaacgttacggtttcggggttaccggggtaagttttaagtttaacgttaaagtttacgtaccggttcgtttacgttttagttaacgtttaacggttttacgggggaccgtaaaacggggactaaggttacccggg

SEQ ID NO: 22052 - DNA, 547 bp, Homo sapiens
  misc_feature: GYAE6OF01DMFW2.35.3.A03.1.454.CMB.1.raw
  modified_base (237)..(237): a, c, t, g, unknown or other
  misc_feature (237)..(237): n is a, c, g, or t
  modified_base (334)..(334): a, c, t, g, unknown or other
  misc_feature (334)..(334): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactgggtgaagccttcacagaccctgtccctcacctgcactgtctctggtgctccatgancagtggtgttactactggagttgatccgcagcaccgagggaggctggagtggattggacatctattacgagtgggagacccactacaaccgtcctanaagagtcgacttacatatcagtagactacgtactaacgacctagttcctacccgtagacgctagacgtctcgtgtcgacgtcgcccggcgaccgacggcgttgtacttacgtgtgcgtagatacttaccttagtagttcgggttacgggatttagttagtaattagtcgtcgttactttgacgtttaggttacgggactaagggactagtcgg

SEQ ID NO: 22053 - DNA, 671 bp, Homo sapiens
  misc_feature: GYAE6OF01CD16O.35.3.A03.1.454.CMB.1.raw
  modified_base (348)..(348): a, c, t, g, unknown or other
  misc_feature (348)..(348): n is a, c, g, or t
  modified_base (447)..(447): a, c, t, g, unknown or other
  misc_feature (447)..(447): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctctgctggtggcagctccagatgggtcctgtcccaggtgcagctgcaggagtcgggcccaggactggtgaagccttcacagaccctgtccctcacctgcactgtctctggtgctccatgagctaggtggttgttactacgtggagttggactccgcagccaccggtaggggacggccgtggagtgagttggacatctatacgaggtgggacgacccacgtaaccacccgtcctanaagacgtccgaacttacgaatactcgaagtacgactaacgtataaacgtaaccgtaggttccctacgtagaacgtccgtaagacgtccttcgtggtacncgtcggcccggtaccggtaacgaccgggttcgtaagttccgtttacggtggttacggaccggtaaggttaccgtaactttacccgtttaagttcgggttacggggttttacggggaatttttaattaaacggtttaagtttacggccggttacgtttttcgttttaaggaacgttttacgggttaccgggggaaccttaaaggggacttaaacgggtttcccgg

SEQ ID NO: 22054 - DNA, 726 bp, Homo sapiens
  misc_feature: GYAE6OF01CMXCS.35.3.A03.1.454.CMB.1.raw
tcagtacagatcgtcacgaccggtgctcgatttagagagcgtcacaggggagcttcagctgtgggtagagaagacaggactcaggacaatctccagcatggccagcttccctctcctcctccaccctcctcactcactgtgcagggtcctgggcccagtctgtggtgactcagcccaccctcaacgtcgtcgggacccccggcaggacgggtcaccatctcttgttctggaagcagctaccaacagtacgggaaataatactagtaaaactggaaccagcagcctccgaaggaacccgccccaaatcctacatactataaataataactcaacgccggccctagaggactccctagaccgtacttctcgtcgggcctaccgaagtccgtcgggcctcctaccgacgtccccttccgcggaccctatcgacggttcgggcctacctacgtcgtacggaggtaacgttcggacgggtacttaggtaactttaacgtacctaaccgttggtaacgtaccgtaacggaccgtagggttaacggggattaacggaaccgtaacggtccgtaagggtaaggttcggggggtttgggggttagggttttacgggggaaccggggttaagggggaaccccgtaaacggggttcccgttaacccgggtaacccggtttaccccggtaaagggttaccccggaaaccggacccccgggtaaacgggttccccccgg

SEQ ID NO: 22055 - DNA, 627 bp, Homo sapiens
  misc_feature: GYAE6OF01AQG5K.35.3.A03.1.454.CMB.1.raw
  modified_base (507)..(507): a, c, t, g, unknown or other
  misc_feature (507)..(507): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctcgtggtgcctccatgagctaggtggtgttactacgtggtagttggactccgcagccaccgagggacggccgtggagtggtagttcgggactacgtacttagttacgaggtcgggaacgaccccaacgtacccgaaccccgtccctaagaaacggtacgtaccgaacctttacgattacactaacgtacgacctacgtactaaacgaaccctagttcctaccgtagacgtctagacgtctcgtagcgtacgtcggacccgacggacctcggtccttagtacttcgnggtacgacgtagtacgtacttccgtagttggtgggttcgggtaatttacgttagtaacgttcgtcggtcgtttacgtttagtacgttcggttacggggaactaagggtactaggttccgg

SEQ ID NO: 22056 - DNA, 564 bp, Homo sapiens
  misc_feature: GYAE6OF01ENXBU.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcagggagtcgggcccaggactggtgaagccttcacagaccctgtcccctcacctgcactgtctctggtggctccatgagcagtggtggttactactggagttggatccgcagcaccagggaaggcctggagtggattgggtacatctatacagtgggagacccactacaacccgtcccacaagacgtcgacttacatatcagtagacacgtactaagacctagttcctaccctagacgtctgagtcctcgtgtcgactcgcccgacggaccacggtccgtgttactcgtggtcgacgagagtactccgttaacgttaggttcggggtagttagttaatttaagttacttacgtcggtccgtttgttagtagttttcgggtacggaaccggaagtagtaggtccg

SEQ ID NO: 22057 - DNA, 579 bp, Homo sapiens
  misc_feature: GYAE6OF01CZ6JZ.35.3.A03.1.454.CMB.1.raw
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (455)..(455): a, c, t, g, unknown or other
  misc_feature (455)..(455): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagcctcccagatgggtcctgtcccaggtgcagctgcaggagtcgggcccaggactggtgaacgccttcaacacgaccctgtccctcacctgcactgtctcgtggtcgctccatgagcagtggtaggttactagtggtagttggactccgcagccaccgagggtaggcctggagtgagtggtacatctaatacgaggtgggacgaccactacacccgtccanaagngcacttacatatcaagtacgaacacgtactaaagacctagttcctacccgagtaacgcgtagagtcctctgagactcgccgacgacgacggtcgtgtattacgngtgacgtagagtcttaccttagtaggttggttacgggtaagtttaataacgttaaattaggtcgtccgttacgttttaggaattacgggtttacgggaacctaaggggtaactaaagttccggg

SEQ ID NO: 22058 - DNA, 721 bp, Homo sapiens
  misc_feature: GYAE6OF01DSC6P.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaacgtccttcacacgaccctgtccctcacctgcactgtctcgtggtgctccatgagcagttggtaggttactacgtgggtagttggactccgacacgccaacccggaggggaacggccgtaggaggtggtagtttgggtaacagttactaagttaacgtagggtacggggaaccggacccctaaccgtaaccgaaccccgttacccgtaacgaaacggtacgtaccgtaacctttaaccgaatactacgtaagtacgaactaccgtaacgtaaacgaaacccttggttaccctaccgtaggaactcgttagaacgtccttagtacggtacgaaccgttccggacccgggacgggaacctacccgggtaccgttagttaacttaccggtggtcggacgtaagacggttacttacccgtttagagggtttcggggttaacgggtattttaaagttaacgttaagtttaccgtcggttacgttgttttaagacgtttagggttaccggggaaacctaaggggtaacctaggtttaccggg

SEQ ID NO: 22059 - DNA, 687 bp, Homo sapiens
  misc_feature: GYAE6OF01CAWNW.35.3.A03.1.454.CMB.1.raw
  modified_base (324)..(324): a, c, t, g, unknown or other
  misc_feature (324)..(324): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaacgccttcacacgaccctcgtccctcacctgctactgtctcgtggtcgctccatgagcgagtggtgttactacgtggtagtgactccgcagccaaccggagggacggctggagtggtagttggactagtactagtacgnggtacgggacgacctacgtacaacccgtctacgaagtcgtacgtaacttaccattactcgaacgtacgaactacgtaactaacggtaacctcgttacctccgtaagaacgtctagtacgcttacgtgtacgacgttcggacccggacggtaccgtacgggtcttaggttaacttcggtcggtacggtaccggtaaggtacgttaccttacccgtttaggttaacggttcgggggtttaaccgggttaattttaaagtttaacgtttaaacgtttcgtacggttccggttttacgtttttagggtaaccgttttggggtttaccgggggaaaccttaaaggggttaacgaacggtttacccggg

SEQ ID NO: 22060 - DNA, 791 bp, Homo sapiens
  misc_feature: GYAE6OF01DKDYT.35.3.A03.1.454.CMB.1.raw
  modified_base (165)..(165): a, c, t, g, unknown or other
  misc_feature (165)..(165): n is a, c, g, or t
tcagtacagatcgtcacgaccggtgctcgatttagagagcgtcacagggtctgtgaaggcttccaccagtcctggacctcctgtgcaagaacatgaaacacctgtggttcttcctcctgctggtggcagctccagatgggtcctgtcccaggtgcagctgcaggngtcggccaggactggtgaagccttcacgagaccctgtccctcacctgccactgtctcgtggtgcctccagtcgagcgtaggtcggtcgttaactcgtaggtagtttggactccgcgacgccaacccgaggggaacggccgtaggagtcgggtaagttacgggactagttctaagttacgagggttacgggaaccggtaaccctaaccgttaaccgaaaccccgttacccgtaacgaaacggtacgtaccgtaacttaaccaagttactacgaacgtacgaacgtaacgtaacgtaaacggtaacctacgtttacccacccgttaagaacgtccgtaggtaactcgtacgttacgacgtaaccgttcgggacccggtaaccggaacccggtaccgggttaccggtttacgttaaacgtttccgggtacgggtacggtaacccggaaaggttaaccgtaaccgtttacccgtttaaccggttaaagggttttcgggggttaaccgggttaaattttaaacgtttaaacgttaaacggtttacggtaccggttacggttttacgtttaagggtaacgtttacgggtttacgggaaacgtaaacggggtaaacctagggtttaacccggg

SEQ ID NO: 22061 - DNA, 587 bp, Homo sapiens
  misc_feature: GYAE6OF01EULQJ.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctcatgagcagtggtgttactactggagttggatccgccagcacccagggaacggcctggagtggagttgggtacatctattacgaggttgggacggaccctacgtaaccgaaccccgtccctacgaaacggacgtccgtaacttaccagtactcagtagactacgtactaaacgaacctagttcctaccctagaacgtcgtagacgtctctgtacgtacgtcgcccggcggaccgacgggtccgtgtacttcgtgtgcgtagacgtacttccttagtagtcgggttacgggtatttagttaagtaacttagtcgtcgttactttgattaggttcgggacctaagggtactagttccgg

SEQ ID NO: 22062 - DNA, 714 bp, Homo sapiens
  misc_feature: GYAE6OF01A92J4.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctcatgagcagtggtggttactacgtggagttggatccgtcagccacccgagggaacggcctggagtgggattcggggtacacgttacttacgtacgagggtacgggaccgaacctacgtaacccgtacccgtcaacgaacgtcgtaccgtactactaatactacgtaagtacacgtacgtaagtaaaccgaaccgttcgttacccgtaccgtagtaaccgtcgtacggtacttccgtgtacgtacgttacgaccggtcccggacgtaaccggtccggtacgttacgtttaaccgttgtacggttacgacggtaacgtacttacccgtttaaccgttagtttacggggttacggggtttagggttttaaactttaagtttaaacgttaacgttttacgtaccggttaccgtttttacgttagtttaaacgggttttacgggttaaccgggtaaacgggttaaacggaacgtttcgggttaaccccgg

SEQ ID NO: 22063 - DNA, 724 bp, Homo sapiens
  misc_feature: GYAE6OF01DPG6E.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctccagatgggtcctgtcccaggtgcagctgcaggagtcgggccaggactggtgaagccttcacacgaccctgtcccctcgacctgcactcgtctcgtggtgcctccatgagctaggtggtgttactacgtggtagtggactccgcacgccacccggaggggacgggccgtagggacggtggtagttacgggtactagttctaagttacgaggttgggaaccgaccctaactaaccgaaccccgtcctacgaaacgtacgtaccgtaaccttacatactacgtaacgtacgaactacggttaactaacggaacctacgttaccctacccgtagaacgtcgttagaacgtccttacgtcggtacgtaccgttcggcccggaccgggtaaccgaccgggttcgttagttaacgttacgttcggtacgtacgggtaagtacgttacgtttacccgtttaaggtcgggtttaccggggttacgggttaaacttttaacgtttaagtttaaacgtttacgtccgggtttacgttttcgttttagtaacggttttaacgggttaccgggaacggtaaacggggttactaagggtttcccggg

SEQ ID NO: 22064 - DNA, 698 bp, Homo sapiens
  misc_feature: GYAE6OF01BOL23.35.3.A03.1.454.CMB.1.raw
  modified_base (643)..(643): a, c, t, g, unknown or other
  misc_feature (643)..(643): n is a, c, g, or t
tcagtacagatcgtcacgaccggtgctcgatttagagagcgtcacagggtctgtgaaggcttcaccagtcccggacctcctgtgcaagaacatgaaacacctgtggttcttcctcctgctggtggcagctcccagatgggtcctgtcccaggtgcagctgcaggagtccgggcccaggactgggtagaacgtccttacacacgtaccctcgtcccctcacctgcctacttgtctcgtggtcggcctccatgagcgaggttggtgttactacgtggtagttggactccgacagccaccgagggacggctggagtggtagttggtactagttactagtacgaggtacgggacgtaccctaccgtaaccgaccccgtaccgtagaacgtacgtaccgtaacttaaccattaactccgaagtaacgaccgtaacgttactaaaacgtacctacgtttccctaccgtagaacgtctacggacgtcctcgtagtacgtaccgtcgggacccggaccggtaacctccgggtccgttagttaacgttacggtcgtacggaccgtaaggtaccttactttacccggtttaaggtagggtttcggggttaagggtaatttattaaacgttaagtttccgtacgttacggtttntttaagaggtttagggttaccggggaactaaagggtacttagggttcggttaccg

SEQ ID NO: 22065 - DNA, 668 bp, Homo sapiens
  misc_feature: GYAE6OF01C7LUT.35.3.A03.1.454.CMB.1.raw
  modified_base (189)..(189): a, c, t, g, unknown or other
  misc_feature (189)..(189): n is a, c, g, or t
  modified_base (316)..(316): a, c, t, g, unknown or other
  misc_feature (316)..(316): n is a, c, g, or t
tcagtacagatcgtcacgaccggtgctcgatttagagagcgtcacagggggggtagagaagacaggactcaggacaatctccagcatggccagcttccctctcctcctcaccctcctcactcactgtgcagggtcctgggcccagtctgtggtgactcagccaccctcaacgtctcggggaccccgggnaggagggtcaccatctcttgttctggaagcagcctccaacatcggaataatactgtaaactggtaccagcagctcccaggaacggcccccaaactcctacatctataataataatcagccggccctnacggacgtccctagaccgattctctggcctaccaagtctggcgtcctcacgccctcctcggcctaatcgtaaggtcgggccttccgagttcctgaaggtatacgggtaggcttaggtatttactctaacgttgtcgccaggactaggttgggactgaacgacgtaccgtaggtaacgggttgggggtgggtttggtttacggggacgggtacggggaacccgtaaggtccggttacgggaaccccggtttacccggttaagggttacccgaaccgggaccccggtaaagggtccccgttaccccgggtaccccccgttggggttaccccaccgtttccccgtttacccccgg

SEQ ID NO: 22066 - DNA, 599 bp, Homo sapiens
  misc_feature: GYAE6OF01C38FH.35.3.A03.1.454.CMB.1.raw
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggccaggactggtgaagccttcacagaccctgtccctcacctgcactgtctcgtggtcgctaccatgagcgtagtggtacggtttactacgtggtagttggactccgcagccaccgaggaacggcctggagtggagttggtacatctaagttacaggtggacgaccacgtacacccgtctagaagngtacgacttaccatancagtacactacgtactaacgacctagttcctacctagaagtctgaactctactgtcactgcccgacgacgtccggcgttagttacttacgtgtacggacgtagtagactttccttacgtagttgggttacgggtaatttaagttaagtttaagttacgttcggtcgtttacgtttttagaacgtttacgggttacggggaacctaacggggtactaaggtttaccggg

SEQ ID NO: 22067 - DNA, 705 bp, Homo sapiens
  misc_feature: GYAE6OF01AFF8Y.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtccgggcccaggactgggtgaacgccttcacacgaccctgtccctcacctgcactgtctcgtggtgctccatgacgcgtagtggttacggttactacgtggtagttggactccgaccaagccgaacccggagggaacgggccgtagggacggtggtagttcgggtaactagttacgttaagttaacgagggtacggggaaccgtaaccccgtaacctaacccgtaacccccgtcccgtaacgaaacggtacggttaccgtaacctttaacccgaataactacgaacgtacgaactacgtactaaacgaacctagttccctacctagacgtcgtacgacgtctgtacgacgtcgtcggacccgacggaccgacggtcgttagttacgttacgtgtacggacgtaagtaacgtaccgttaccgttaacgttacggttacggggttacgggttaagtttaagttaaacgttaacgtttagtcggttcgttcttttaaggagtttacgggttacgggaaccgtaagggtactaaggttaccgg

SEQ ID NO: 22068 - DNA, 568 bp, Homo sapiens
  misc_feature: GYAE6OF01EUF3E.35.3.A03.1.454.CMB.1.raw
  modified_base (192)..(192): a, c, t, g, unknown or other
  misc_feature (192)..(192): n is a, c, g, or t
  modified_base (341)..(341): a, c, t, g, unknown or other
  misc_feature (341)..(341): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
  modified_base (442)..(443): a, c, t, g, unknown or other
  misc_feature (442)..(443): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
tcagtacagatcgtcacgaccggtgctcgatttagagagcgtcacagggggggtagagaagacaggactcaggacaatctccagcatggccagcttccctctcctcctcaccctcctcactcactgtgcagggtcctgggcccagtctgtggtgactcacgcccaccctcaacgtcgtcgggacccccgggnaggagggtcaccatctcttgttctaggaagcagctaccaacatacggaaagtaatactagtaaactcggtaccagcagcctcccgaacggaacccggacccccaaacctcctacatactaataactaaataactacacgccggaccctnaaggagtcccctgacccgattctctggctccaaagtctggcgcctcagcctcccctggccatcagtgggctccagtctgagangagctgatnacacngtgnngngnagngngagagacgcgtagtaggtgggtgggttgggttgggtcgggacgggacgacgacgtcgtaccggtaccgtacggtacgacggacccgaccgaccgcccgtccccgtcccgtccgtcc

SEQ ID NO: 22069 - DNA, 540 bp, Homo sapiens
  misc_feature: GYAE6OF01EH8SE.35.3.A03.1.454.CMB.1.raw
  modified_base (333)..(333): a, c, t, g, unknown or other
  misc_feature (333)..(333): n is a, c, g, or t
  modified_base (445)..(445): a, c, t, g, unknown or other
  misc_feature (445)..(445): n is a, c, g, or t
tcagtacagatcgtcacgaccggtgctcgatttagagagcgtcacagaccctgtccctcacctgcactgtctctggtggctccatgagcagtggtggttactactggagttggatccgccagcacccagggaagggcctggagtggattgggtacatctattacagtgggaggacccactacaacccgtccctcaagagtcgacttaccatatcagtagacacgtctaagaaccagttctccctgaagctgagctctgtgactgccgcggacacggccgtgtattactgtgcgagagatccttactatggttcgggattattataattatcgngtcttttgattagtttggggccagggacaagtgtcaccgtctctcagcctccaccgaacgggcccatcggtccttccccctgggccgccctgctccgagcgccacctcgagngcacagccggccctgggctcgcctggcaaggctacgtccacgactcgtcgtaactggacgccggggactcgggacctaagggccgcgagtaaggc

SEQ ID NO: 22070 - DNA, 738 bp, Homo sapiens
  misc_feature: GYAE6OF01B2YOJ.35.3.A03.1.454.CMB.1.raw
tcagtacagatcgtcacgaccggtgctcgatttagagagcgtcacagggggggtagagaagacaggactcaggacaatctccagcatggccagcttccctctcctcctcaccctcctcactcactgtgcagggtcctgggcccagtctgtggtgactcagccacctcaacgtctgggacccccgggcagagggtcaccatctcttgttctggaagcagctaccaacatcggaagtaatactagtaaactggtaccagcagctccaggaaccgccccaaactcctcatctataataataatcagcgccctcgaggacgtccctgaccacttctcgtcgcctaccaagtccgtggccgacctcgacgtccctccccgtcggcccatccgtaggtcgggtcctccgacggttctaggacggacgtcggacggtcgtaggtactttacgtacctacggtttggtacgtaccgagtaccgtaaggttacggggaatacggtacgacggtacccgttagggtaaacgggttgggggttacgggggtttggttttacgggggaccggggtaaccgggggtaacccgtaaaggttcccggtaaccggggttaaccccgttacccggttaaccgggggtacccgtacccgggtaacccccggtaacgggttaccccggttaccccgggaccccccccggtttacccggggttacccgttaccccggtttccccgtttacccccgggg

SEQ ID NO: 22071 - DNA, 734 bp, Homo sapiens
  misc_feature: GYAE6OF01EJEU4.35.3.A03.1.454.CMB.1.raw
  modified_base (539)..(539): a, c, t, g, unknown or other
  misc_feature (539)..(539): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaagagtcggcccaggactggtgaacgccttcacacgaccctcgtccctcacctgctactgtctcgtggtcgcctccagtgagcgtaggttggtacgttactacgtggtagttgactccgcagccaccggaggggacggcgtaggagtggtagttggtacattctagtacgaggtggacgtaccacgtacccaccgtccagaacgtcgtacgtaccttacatacacgaagtacgaaccgtacgtactaaacgaaccttacgttaccctacccgtaaggaaccgtcgtaggaaccgttccgttacgtacgggtacctaaccggtcccggacccggtaccgggtaacccggtacccggtccggtttaagtacgtttaccgnggttacggacggtaaggtacttaccttacccggtttaagttacgggtttacgggggtttaacgggttaaattttaacgtttaaaggttaaacgtttccggttccggttacggttttacgtttttaagggaacggtttttacggggttacccgggggaaacttaaacggggttaaacttaacggggtttaccccgg

SEQ ID NO: 22072 - DNA, 693 bp, Homo sapiens
  misc_feature: GYAE6OF01CH3T5.35.3.A03.1.454.CMB.1.raw
  modified_base (213)..(213): a, c, t, g, unknown or other
  misc_feature (213)..(213): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcggcccaggactggtgaacgccttcacacgaccctgtccctcaccngctactgtctcgtggtcgctcatgagcgagttggtgttactacgtggagttggactccgcacgaccgaccgagggaacggtctggaacgtggattagggtacctattcttaagttacgaggtgggtaaccgacccctaactaccgaaccccggttccctaagaacgtacgtaccgtaaacttaacccgtataacgtccgtaagtaaccgactaccgtaactaaacgtacctagttaccctacctagaacgtctaggacgtcttacgtggtacaccgtcggcccggtaacggaccggtacccggtcggtttaacgtaacgtttaaccggtcggtacggaacggtaataccggttactttaaccgttacggtaagggtttcggttacgggtaattttaacgttagtaaacgtttcgtacggttccgttgttttaggtagttttacggttacgggggaccaaagggttacttaggtacccggg

SEQ ID NO: 22073 - DNA, 615 bp, Homo sapiens
  misc_feature: GYAE6OF01DZV1H.35.3.A03.1.454.CMB.1.raw
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtcgctccatgagcagtggtgttactactggagttggatccgccagcacccgagggaggcctggagtggnttggacntctattacgagtggacgacccataccaacccgtcctacaaagngtccgacttaccaatactcagtagacacgttactaacgaacctagttacctcccgtagaacgctagacgtacctgtcgtcgacgtcgcccgcgaccgcggcccgttgtattaacctgtcgagagtagacttccgttagtacgttgggtttacggggtaagttttaacgttaagttaaacgtttaagtccggtttccgttacgttttttacggtaagttttaacgggttttacggggaacccgtaaaggggtaaccgtaaggtttacccggg

SEQ ID NO: 22074 - DNA, 722 bp, Homo sapiens
  misc_feature: GYAE6OF01BAGXZ.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggaggtccgggcccaggactggtgaacgccttcacacgaccctgtccctcacctgcactgtctcgtggtcgctcatgagcgagtggttgttactacgtggagttgactccgcagccaccggagggacggccgtggagtggagttcggactatactagttacgaggtagggaaccgaccctaacgtaacccgaacccgtccgtacgaaagtcgtaccgtaacctttaaccaattaacgtactaacggtaacgaaccgtaaaccgttaccgtaaaacgtaacccttacgtttaccctaccccgtaaggaacgtacttacgacgttcttacgtagtacgtaccgtcggacccggacggtaaccgaccgggttacgttacgttaacgttacgtggtacggacggtaacgtactaccttacccgttagttacgggtttcgggtttacggggttaattttaaacgttaagtttaaacgtttagtaccggtttcgtttaacgttttagtaacgttttacgggtttacggggaacccgtaaaggggttaaccgttaaggttacccggg

SEQ ID NO: 22075 - DNA, 827 bp, Homo sapiens
  misc_feature: GYAE6OF01EJAAZ.35.3.A03.1.454.CMB.1.raw
  modified_base (192)..(192): a, c, t, g, unknown or other
  misc_feature (192)..(192): n is a, c, g, or t
  modified_base (232)..(232): a, c, t, g, unknown or other
  misc_feature (232)..(232): n is a, c, g, or t
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
tcagtacagatcgtcacgaccggtgctcgatttagagagcgtcacagggggggtagagaagacaggactcaggacaatctccagcatggccagcttccctctcctcctcaccctcctcactcactgtgcagggtcctgggcccagtctgtggtgactcagcccaccctcaacgtcgtcggggacccccgggnaggagggtcaccatctcttgttctggaagcagctaccaanatcggaagtaatactagtaaactggtaccagcagcctacccagggaacccgcccccaaactcctacatactaataataataancacggcgccctcgaggtactcccngaccgtatttccgtctcggtcctaccgaaggtctcgggccgacccttcgaccgtccccttacccgtcgggaccctattccggaagggttcggggacccttacccggaggtttccggtagggtaacgggtagttaacggggacggttacgttacgggttaaactttaacgtaccgtaacggtttagggtcggtaacccggaagtacccgttaaggggttacggggtactaagggtaacccgaacggttaacccgggttaagggtaagggggtttcgggggggtttagggggttttagggtttaccggggggaaccgggggtaacgggggtaaaccctaacgggttaccgggttaaccggtaaccccggggtttaccgttaacgggggtaccccgaaaccgggtaacccccgtaacgggtccccggttaccccggtacccccccggttacgggtaccccgttacccgttccccggtttacccccccgggg

SEQ ID NO: 22076 - DNA, 773 bp, Homo sapiens
  misc_feature: GYAE6OF01EQC1B.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcgaggagtccgggccaggactggtgaacgccttcacacgaccctcgtccctcacctgcactgtctcgtggtcgctcatgagctaggttggtacgttactagtggtagtggactccgcacgccgaccggaggggacggcgtgggagtaggtagttgggtactagttcgtaagttacgaggtacgggaaccgtaaccctaaccgtaacccgaaccccgttccctaacgaacggtacgtaacccgtaacctttaaccgaattaccgtacgtaaacggtaaccgaacgtaaccgttaactaaaccggtaacccttacgtttaccctacccgtaaggtaaccgtccgttacggtaacgtccgttcgttacggtacgtaccggtccggcccgggtaaccggaccgttacccgggtaccgttagtttaacgttaccggtaggtccggtaacgtagtaacgttaccctttaccggtttaacggtttacgggtttgggggtttaaaccggtttaattttaaacgtttaaggtttaaactttacggttacgtttcgtttacgttttaggtaacgtttacggggttaccgggaaacgttacgggtaaacgttgggttaacccgg

SEQ ID NO: 22077 - DNA, 708 bp, Homo sapiens
  misc_feature: GYAE6OF01BLEF7.35.3.A03.1.454.CMB.1.raw
  modified_base (610)..(610): a, c, t, g, unknown or other
  misc_feature (610)..(610): n is a, c, g, or t
tcagtacagatcgtcacgaccggtgctcgatttagagagcgtcacagggtctgtgaaggcttcaccagtcctggacctcctgtgcaagaacatgaaacacctgtggttcttccctcctgctggtggcagctcccagatgggtcctgtcccaggtgcagctgcaggacgtcgggcccagggactggtagaacgtccttcacgacgaccctcgtcccctcacctgcacttgtctcgtgggtcgctccagtgacgcaggtggttacgttactacgtggtagttggactccgaccagccgacccggaggggaacggtccgtagggaggtggtacggttacgggtaacaacgtttccgttaaagtaccggtagggttccggggaaacccggtaaccccctaacgtaacccccgtaaccccggtttaccacgaaacggtccgtaacccgtaactttaacccgaattacgtacgtaacggtacgtaaccaacgggttaaccaaaggtaaacccgttcgttcctaacccgtggaacgtcgttaggactcttcgtacgtctaccggtcgacccggtcggaaccgtccggtcgttagttacgtacgtgtacgcgtaaggnttaccttacgttagtaggttcgggttaggttattaacttagttactagtcgttattgtttaagtgttacgggttcggaacggtaagtagtgtacccgg

SEQ ID NO: 22078 - DNA, 719 bp, Homo sapiens
  misc_feature: GYAE6OF01DX6G9.35.3.A03.1.454.CMB.1.raw
  modified_base (580)..(580): a, c, t, g, unknown or other
  misc_feature (580)..(580): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctccagatgggtcctgtcccaggtgcagctgcgaggagtccggcccaggactgggtagaacgtccttcacgacgaccctcgtcccctcacctgacactgtcctcgtgggtcgcctcatgagcgtaggtggtcgttactacgtgggtagttggactccgaccgacgccgaacccggaggggacggcgtagggacggttggtagttagggtactattcgttaagttaacgagggttacgggaaccgtaaccccaaccgtaacccgaaccccgttcctaacgaaacgtacgtaccgtaactttaaccgatacgtacgaacgtacgaaccgtacgtaaccgtaaacgaacccttacgttaccctacccgtagtaaacgtcctaggactccgttacgtcgtcgaccgttacgggcccggacggtaccgtaccgggttcgtttaagttacgtttacgnggtcggacggtaagtacgttaccttaaccgtttacggtaggtttggggttaggtagttttaattaggttaatttacggtcgttgtttacgtttaaggacgttttacgggtacggaacggttaaacggtataggttccgg

SEQ ID NO: 22079 - DNA, 700 bp, Homo sapiens
  misc_feature: GYAE6OF01BRY8A.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtggctcatgagcagtggtgtactacgtggagttgactccgccgagccaccgagggaacgggcctggaggtggagttgggtacagttctaattacgaggtcgggaacgacccctacgtaaccaacccgtccctacgaaacgacgttaccgtaacctttaaccaattaactaccgaacgtaacgacaacgttactaaacgtaacctacgttccttacccgtagaacgtcgtagacgtctacgttcgtacgacgttcggcccggaccggaccgtaccggtccgtttaacgttaacgttacgtaggtcggtaccggaagaacgttaccttacccgtttaaccgttaggttacgggggtttacgggttaagtttaaacgtttaagtttaacgtttacgtcggttcggtttaccgtttttaggtaacgttttagggtttaccggggtaaccgtaaaggggtaaccttaaggtttaccggg

SEQ ID NO: 22080 - DNA, 713 bp, Homo sapiens
  misc_feature: GYAE6OF01DHV0Y.35.3.A03.1.454.CMB.1.raw
  modified_base (355)..(355): a, c, t, g, unknown or other
  misc_feature (355)..(355): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgtagctgcaggagtcggcccaggactggtgaagccttcacacgaccctgtccctcacctgcactgtctctggtgctcatgagcagtggtggttactacgtggagttggactccggcagccaccgaggggacggctggagtggagttgggtacattctagttacgaggtcgggaacgaccccaacttaccgaacccgtcctanaaacggacgttaccgaactttaaccattaacgtctaacggtacgtaactaaccgttaacgttaaaacggaaacccttcggtttaacccttacccctagggtaaacgtccttaggacgtcttacgtgtacgtacgtcgggccccggtacggaaccgtaccgggtccggttatttaacgtttaccgtgggtacggaccgtaaggtacttactttacccgtttaagttacgggtttcggggtttaacgggggttaattttaaatttaagttaaacgtttacggttccgttacgtttcgttttaaggtatttacgggtttacggggaaccctaaaggggtactaacggtttcggtaaccccg

SEQ ID NO: 22081 - DNA, 618 bp, Homo sapiens
  misc_feature: GYAE6OF01B9Z2L.35.3.A03.1.454.CMB.1.raw
  modified_base (257)..(257): a, c, t, g, unknown or other
  misc_feature (257)..(257): n is a, c, g, or t
  modified_base (482)..(482): a, c, t, g, unknown or other
  misc_feature (482)..(482): n is a, c, g, or t
tcagtacagatcgtcacgaccggtgctcgatttagagagcgtcacagaccctgtccctcacctgcactgtctctggtggctccatgagcagtggtggttactactggagttggatccgccagcacccagggaagggcctggagtggattgggtacatctattacagtgggaggacccactacaacccgtccctcaagagtcgacttaccatatcagtagacacgtactaagaaccagttctccctgaagctgagctntgtgactcgccgcggacacggccgtgtattacgtgtgcgagagacttccttactagttcgggttacggggtatttattattaattagtcgtcgttacttttgattagtttcggggactaagggactagtcggtaccaccgttctcttcacgtccctaccaccgaacgggccctacgtccggttccccttccccgtgggccctcccgtacgcctaccgacggtacncctaacccgtcgacgacgcctacgcgggccgtcccgtcgggacctcgtccggttaggtaccgtaacggtacccttacccgttccgaacgtacttccgtgtacgtggacgggcggtcgtggaacgacgcgtcagtgc

SEQ ID NO: 22082 - DNA, 772 bp, Homo sapiens
  misc_feature: GYAE6OF01BPBMD.35.3.A03.1.454.CMB.1.raw
  modified_base (242)..(242): a, c, t, g, unknown or other
  misc_feature (242)..(242): n is a, c, g, or t
tcagtacagatcgtcacgaccggtgctcgatttagagagcgtcacaggggcagcttcagctgtgggtagagaagacaggactcaggacaatctccagcatggccagcttccctctcctcctcaccctcctcactcactgtgcgacggtccgtcgggcccagtctgtggtgactcacgcccaccctcaacgtcgtccgggccccggcaggacgggtccacctatcttcgttgttcgtaggaancacgtcctaccaaactagtacggaaattaactaactagtaaacgtcggtaaccagacacgcctaccgaacggaacccgacccccaaactcctactactactaataaactaataactcgacgccggccctacgacggtactcccgtacggacctacttccgtcgtacggtacctaccgtaagtccgtcggacccgcctacgaccgtcccctcccgtacggacctacgtacgacgggtcggtaccctaccgtacgtacgtgggaaggttacgtaggtacgtccgtacgtttaacttacgtacctacggttgtacggtcgaacggttcgtaagggttcgggtaattacggacgtacgggttacccgttaaggggtacgggttagggggggtttacggggttagggtttaccggggggaaccggggtaaccgggtaaacccggtaaaccggtccggttaacccggggttaaccccggttaacccggggttaaccgggttaacccgaaacccggggtaccccggtaaacccgggg

SEQ ID NO: 22083 - DNA, 739 bp, Homo sapiens
  misc_feature: GYAE6OF01DKOML.35.3.A03.1.454.CMB.1.raw
  modified_base (320)..(320): a, c, t, g, unknown or other
  misc_feature (320)..(320): n is a, c, g, or t
tcagtacagatcgtcacgaccggtgctcgatttagagagcgtcacagggtctgtgaaggcttcaccagtcctggacctcctgtgcaaagaacatgaaacacctgtggttcttcctcctgctggtggcagcctcccagatgggtcctgtcccaggtgcagctgcagggagtccggggcccagggactgggtgaagccttcacagacccctgtcccctcacctgcctactgtcctcgtggtcgcctccatgagcagtggtgttactacgtggtagttgatccgcagcacccgagggaagggcctggagtggtattgggtacntactattacgaggtagggacgaccccacgtaaccaacccgtccctacgaagtacgtacgaacctttacaattactacgagtaacaactaccgtactaaacgaacctacgtttcctacccgtagaacgtcgtagacgtccttacgtcgttacgaccgttacggccccgggtacggtaaccgtacccgggtacccggtttagtttaacgttaaccggttggtacggaccggtaaggacgttaccttaacccgtttaacgttacgggttacggggttttaccgggggttaagttttaacgttttaacttaaaggttttaccgtacccggtttacgttttaccgttttaggttaacgttttaaccggggtttttacgggggaacccggttaaaacggggtaccgttaaaggtttaccccgggg

SEQ ID NO: 22084 - DNA, 534 bp, Homo sapiens
  misc_feature: GYAE6OF01BZ84K.35.3.A03.1.454.CMB.1.raw
  modified_base (347)..(347): a, c, t, g, unknown or other
  misc_feature (347)..(347): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactactggagttggatccgccagccacccgagggaagggcctggagtggattgggtacatctattacagtgggagacccactacaacccgtcctcaagngtcgacttaccatatcagtagacacgtactaagaacccagttcctaccctgaacgctgagctctgtgactgccgcggacacggccgtgtattacgtgtgcgtagagattcctactagtgggttacgggtattattagtattatcgtcgtacttttgattagtttggggacctaagggactagtcggg

SEQ ID NO: 22085 - DNA, 729 bp, Homo sapiens
  misc_feature: GYAE6OF01EOTNX.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtccgggcccaggactggtagaacgccttcacacgaccctgtccctcacctgccactgtctcgtggtcgcctccatgacgcgtagtggtgttactacgtggtagttgactccgcagccgaccgaggggaacggccgtagggacgtagggtagttacggggtaactagttcgttaacgttacgagggttacgggacgtaaccccgtaacgttaacccgtaaccccgttacccgtacgtaaacggtacgttaccgtaacctttaaccgaattacgtactaacgtacgtaaccgaacgttacgtaaacgtaaccgttacgttccctacccgtagaacgtcgtagacgtctcgtacgtacgtacctcggacccgtacggaacccgtccgggttacccgtaggttacgttaacgtggtacggacgtaagtacgtacgttacctttacgtacggttacggggttacgggttatttaacgttaacgttaaacgtttagtaccggttcgttacgttttagtaacggtttacgggtttaccgggaaccgttaagggttaactaggttacccgg

SEQ ID NO: 22086 - DNA, 754 bp, Homo sapiens
  misc_feature: GYAE6OF01AKKEH.35.3.A03.1.454.CMB.1.raw
  modified_base (191)..(191): a, c, t, g, unknown or other
  misc_feature (191)..(191): n is a, c, g, or t
  modified_base (238)..(238): a, c, t, g, unknown or other
  misc_feature (238)..(238): n is a, c, g, or t
  modified_base (308)..(308): a, c, t, g, unknown or other
  misc_feature (308)..(308): n is a, c, g, or t
  modified_base (539)..(539): a, c, t, g, unknown or other
  misc_feature (539)..(539): n is a, c, g, or t
tcagtacagatcgtcacgaccggtgctcgatttagagagcgtcacaggtctgtgaggcttcaccagtcctggacctcctgtgcaagaacatgaaacacctgtgttcttcctctgctggtggcagctcccagacgtgggtcctgtcccgaggtgacagctagcaggagtcggcccaggtctggtgagccttnacagaccctgtccctgacctgcactgtctcctggtcgcttaccatgncgtagtgtgttactacgtgagttggactccgacagcaccgagggtaggcctaggacgtggagttggacgntcgtattagcgtaggacgtaccactaccgtaaccgcccgtagaacgacgtcctaacgtttaaccgaacttcgtaacgttaacgacgtacgtaaccgggttactaaacgtaaccgttaagtttaccctaccccgttaagggaaaccgtccttaaagggtaccgtcctttaacgtttcgacggttaccgttacgggacccggtaccgggttaaaccgcccggtaaccgggttntttaaacgggttccttacggaacggttccgaagttaacgtcgtttaccccgttaagttaccggttggggttaaccgggtttagtttaaattttaccgtttaaaaagtttcccgggacgtttaccggttaccgtttttttaaacggaggtttttaacccgggttttaacgggggaaaccctttaaacggggaagtttaaacccggttttccggggg

SEQ ID NO: 22087 - DNA, 712 bp, Homo sapiens
  misc_feature: GYAE6OF01CBQQ3.35.3.A03.1.454.CMB.1.raw
  modified_base (192)..(192): a, c, t, g, unknown or other
  misc_feature (192)..(192): n is a, c, g, or t
  modified_base (344)..(344): a, c, t, g, unknown or other
  misc_feature (344)..(344): n is a, c, g, or t
tcagtacagatcgtcacgaccggtgctcgatttagagagcgtcacgagggggggtagagaagacaggactcaggacaatctccagcatggccagcttccctctcctcctcaccctcctcactcactgtgcagggtcctgggcccagtctgtggtgactcagcccaccctcaacgtcgtcgggacccccgggnaggagggtcaccatctcttgttctaggaagcagctaccaacatcggaataactactagtaaactggtacagcagctaccgaggaaccgaccccaaactcctacatctaactaataataatacagccggccctgaggactcccagacgattcnctggctaccgtaagtcgtacggcgaccttcgacggtccctacccgtcggacctatccgtaggtcggaccttaccgagttacgtaggtaacggtacgtaggtacggtcgttaggtacttacgttaccgtacgtacgtcgtacgacgtacgtacgtaggtaacgtacgtaacgacggtaccgttaacgggtaaggggtttgggggttacggggtttacggtttagggggtaccggggaaccggggtaaccgaacgggtaccgtaccgggttacccgggtaccgttaagggtaccgtacccggtaacccgtaacggtcccggtacccggtaccccccgttacggtaccgttaccgttcccggttcccccgg

SEQ ID NO: 22088 - DNA, 755 bp, Homo sapiens
  misc_feature: GYAE6OF01A0G9B.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctccagatgggtcctgtcccaggtgcagctgcaggagtcgggccaggactggtagaacgccttcacgacgaccctcgtccctcacctgcctacttcgtctcgtgggtcggcctaccatggagcgtacggttggttaggttacctagtgggtagttcggactccgcgaggccgaccggaaggggacggccgtagggagtcgggtagttacgggtaactagttacgttaagttacgaggtacgggacgaaccctaacgtaacccgaacccgtcctacgaaacggtacgtacgtaaccttaaccaatactacgtaacgtacgaaccgtacgtaacgtaaacgaacctacgtttcctacccgtagtaacgcgttacggactaccgttcgtacggttacgacccggttcgacccggacgggtaacccgcgggtccgtttaggttactttacggtgggtacgaccgggtagttaaccggtacttttaccccggttaagttacggggtttacggggtttaccggggttaaatttttaagtttaaaccgttaagtttaccggtcggttaacttttacgtttaagggtagttttacgggtacggggaaacctaaggggttactaggtttacccggg

SEQ ID NO: 22089 - DNA, 684 bp, Homo sapiens
  misc_feature: GYAE6OF01DS6WX.35.3.A03.1.454.CMB.1.raw
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctcgggcccagtctggtggtgactcacgccaccctacaacgtcgtccggggaccccgggcaggacgggtcaccatctctttgttctggaacgcagcctaccaaacagtacggaaagttaactacgtaacgttaaacgtcggtaaccagcgaacgcctacccgaacgggaaccccggaccccctaaacgttccctactacttactaaactaaactaaactaactcaacggccggtaccctacgacggtacgtcccgtacgaccgtattccgtcgtcggtccctaccgaaggttccgtcggacccgtccctaccgaccgtcccctcccgtcggacctacgtcgtaacggtcgggtacctccgtacggttcgtacgggaggtacgtacggacggtctacggttaactttacgtctacgttcggtacgactagacgtagtagggacgtacgacgtacgcgtaggtaggttggggtgggttggttcgggacgggtaaggacgcggcgtcgtaccggtcgtacgcgaccggccgtacggtccg

SEQ ID NO: 22090 - DNA, 859 bp, Homo sapiens
  misc_feature: GYAE6OF01A03OI.35.3.A03.1.454.CMB.1.raw
  modified_base (552)..(552): a, c, t, g, unknown or other
  misc_feature (552)..(552): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccgaggtgcagctgcgaggaggtccgggcccgaggacgtgggtagaacgtccttcacacgaccctcgtccctccacctgcctactgtctcgtgggtcgcctccagtgacgcgtaggtggttcggttactacggtggtagttcggactccgccgacgaccgaccggaggggacgggtcgtgggaggtggaggttggtactacttacttaacgttacgagggtacggggaaccggtacccctaacgtaaccccgtaaccccgtaccctacgtaaacgggtaccgttacccgtaaccgtttaaccaacgttaacgtacgtaacggtaacgtaaccgtaaaccgttaccgtaaaccggtacccttaacgtttcccgtaccccgtaaggaaccgtcgttaagaccggttnttccggttacggacggtaccgttcccggggaccgtacccgggaaccggtcccgggttacgttagttttaacggttcgtacgggttaccggaaccgggttaacgtaagggttttaaccccttaccggtttacgggtttaacgggtttccgggggggttttaaagggtaaacttttttaaagtttaaacgttttaccggttaccggttccgggttttaccgttttcgggtttttaagtaaaccgggttttcgggggttaccggggtaaaacgggtttaccggtaaaccggttaaggtttacccccgggg

SEQ ID NO: 22091 - DNA, 753 bp, Homo sapiens
  misc_feature: GYAE6OF01AJCS8.35.3.A03.1.454.CMB.1.raw
  modified_base (179)..(179): a, c, t, g, unknown or other
  misc_feature (179)..(179): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggaaaacccnggactggtgaagccttcacacgaccctgtccctcacctgctactgtctcgtggtcgacctccagtcgagcgtaggtggttcggtactacgtggtagttggactccgccagccgtaccggagggacggtccgtggagtcggtagttcgggtacagttcgtaagttacggagggtacgggaaccgtacccctaaccgtaacccgtaaccccgtcccgtaagaaacggtcgtaaccgtaccttaacgacgttactacgtacgtaacgtaccgtaacgtaacctaaaccgtacctacgttccctaccgtagtacgtcgtagactacgtcgtacgtacgacgtcggaccgtacggaccgtaaccggtcgttaacgttacgttacgtaggtacgacgggtaacgtacgttacccttaccgttacggttacgggttacggggtttacgggttaaacgttttaaacgttaacggtttaaaccgttcgttacccgggttacgtttacggttttaacggtaacggtttaccgggtttaccggggtaaaccggtaaaccgggttaagttaacgggttaccccggg

SEQ ID NO: 22092 - DNA, 683 bp, Homo sapiens
  misc_feature: GYAE6OF01AD4SQ.35.3.A03.1.454.CMB.1.raw
  modified_base (192)..(192): a, c, t, g, unknown or other
  misc_feature (192)..(192): n is a, c, g, or t
  modified_base (230)..(230): a, c, t, g, unknown or other
  misc_feature (230)..(230): n is a, c, g, or t
  modified_base (437)..(437): a, c, t, g, unknown or other
  misc_feature (437)..(437): n is a, c, g, or t
tcagtacagatcgtcacgaccggtgctcgatttagagagcgtcacagggggggtagagaagacaggactcaggacaatctccagcatggccagcttccctctcctcctcaccctcctcactcactgtgcagggtcctgggcccagtctgtggtgactcacgcccaccctcaacgtcgtcgggacccccgggnaggaggtcaccatctcttgtctggaagcagctaccaanagtacggaagtaatactagtaaactcggtaccagcacgcctacccgaggacccgaccccaactcctactatactataaataataatcgagccgccctcgaggacgtcctgaccgtattctcgtcgcctacgtaacgtcgtacgccgtcctcgacgccccttccgtacggcctacgtcgaggtcggccttacgagttcgtagacggtntcggaggtcgtagtaacttactcgtacttgacggtacgagaccgtaggtacgggacttacggacgtacggtaccgtagggtagggttcgggggttagggtttcgggttaggggtaccgggaacggggtacctacgggtacccgtaccgggtaccccgttcggtagggtacgaccccgggttacgaaccggttcccggtaccccggtccccgttacggttacccgtcccgttcccgtttacccccgg

SEQ ID NO: 22093 - DNA, 639 bp, Homo sapiens
  misc_feature: GYAE6OF01EWLY2.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctcgtggtcggcctcagtgacgctaggtggtggttactacgtggtagttggactccgcagccaccgaggggacggcctggagtggattgggtacatctattacgaggtgggacgaccactaccaccgtccagaagacgtcgtactacatatacagtacgacagtactaacgacctagttacccttacctagaactcgtagtacgccttcgttacggcgtaaccgtcgacccggacggtacccgacgggtcccgttagtactttcgtggttcgacggtaagtacgtactttaccgttacgttaggttcgggttacggggttaatttacgtttaaattaacgtttacgtcggttcgttttacgtttagttacgtttaagggtttacggggaaccttaaacgggggtaataggtttaccggg

SEQ ID NO: 22094 - DNA, 805 bp, Homo sapiens
  misc_feature: GYAE6OF01E1ZNR.35.3.A03.1.454.CMB.1.raw
  modified_base (227)..(227): a, c, t, g, unknown or other
  misc_feature (227)..(227): n is a, c, g, or t
  modified_base (311)..(311): a, c, t, g, unknown or other
  misc_feature (311)..(311): n is a, c, g, or t
tcagtacagatcgtcacgaccggtgctcgatttagagagcgtcacagggtcgtgtgaaggcttcaccagtcctggacctcctgtgcaagaacatgaaacacctgtggttcttcctcctgctggtggcagcctcccagatgggtcctgtccccaggttgcagctgtcaggagtccgggcccaggacctgggtgaacgtccttcgacacgccctggtccctcacctgcnctgtctcgtggtgctccatgagccgagttggtggttactacgtggtagttgatccgcagcacccgaggacgggcctggagtggntggtacagtcgtaattacgagtggggacgaccctactaccgaaccccgttcccacgaaaggtacgtaccgtaactttaacccattaaactccgaagttaacgaacccgtaaccggtacttaaaaccggaaacctacggttaccctacccctaagaacgtcccttaggtaacgtccgttacgttacgttaccggaacctcgggtaccccgtaccgggtaacccgaacccgggtacccgttaagttaacgtttaccggtacggtacggtaacccgtaaggtaaccgtaccgtttaccccgtttaaacgtaacgggtttccgggggttacccgggggttaatttaaacgttttaaacggtttaaacctttaacggttcccgggtttaaacccggttttccggttttttaacggaaacggtttttaaccggggttttaaccggggggaaccccggttaaaacggggggttaaacccttaaaggtttcccccccggggg

SEQ ID NO: 22095 - DNA, 724 bp, Homo sapiens
  misc_feature: GYAE6OF01BJX34.35.3.A03.1.454.CMB.1.raw
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
  modified_base (538)..(538): a, c, t, g, unknown or other
  misc_feature (538)..(538): n is a, c, g, or t
tcagtacagatcgtcacgaccggtgctcgatttagagagcgtcacgaggggggggtaggagaagacaggactcacggacaatctccagcatggccagcttccctctcctcctcaccctcctcactcactgtgcgagggtcctgggccctaggtctggtggtgactcagccaccctcaacgtcgtcggggacccccggnaggtagggtcaccatcctcttgttcgaggaagctagctccaanagtcggaaataatactgtaaactggaccagcagcaccaggaaccgaccccaactccctacactataacgtaataaataacgtcaacgccggtacctccgaaggtactacccgtacgacccgtatttcctaccgtcggtacctacgtaaggtcctagggccctaccgtacgacgtccctcccgtcggactacttcggacggtcggtacctccgtaacgttcggaggtaaggtacgttacggacgggtctagtacgttaacgtcaaccggttgtacgaccgagacgtaggtgggttaanacggtaccgtacggtcccgttaagggtaacggttggggggtttagggttacgggttcggggaacggggtaccggaaccgtacggccgggttaaccgtacccgggtacgttacgggaccgttaaccgggcccgttaaggccccggttaccggccccttacgggaccctcccggttcgttaccccccg

SEQ ID NO: 22096 - DNA, 820 bp, Homo sapiens
  misc_feature: GYAE6OF01C1PXW.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagcctcccagatcgggtcctgtcccaggtgcagctgcaggagtccgggcccaggactggtagaacgtccctacgacaacggccccttcggtcccctacacctgacctacgttcgtctccgtgggtcggtcctccaagtcgagtccgtaaggttcgggttacgttaactacggtgggtaagtttcggaaccgtcccgtaccgacgtacccgaaccccggtaagggggtaacgggtcccgttagggaaggtcgggtacgttacgggtactacgttcgtaacgttaacgagggttcgggaaccgtacccgtaaccgtaacccgtaacccgtccctaacgtaaacgtacggtaccttaaccgttaacgaattaccgttacgaggtaacaccgttaacgtacgtaaacgtacccttacgttaccctacccgtaagtaaccgcgttacgaccgttccttacggttcggtacgtaacccggtccggaacccggtccggtaaccggtacccggttccgttaagttaccgttaacggttcggtaccggtaccggaagttaccggttacccgtttaaccgttacggtttaagggttccgggttaaacggggttaactttaagtaaactttacggttacgttccggtagtttcgttagttacggttagggttaacccggaaggttaacggtacttaggttaccgg

SEQ ID NO: 22097 - DNA, 768 bp, Homo sapiens
  misc_feature: GYAE6OF01DFSB5.35.3.A03.1.454.CMB.1.raw
tcagtacagatcgtcacgaccggtgctcgatttagagagcgtcacagggtctgtgaaggcttcaccagtcctggacctcctgtgcaaagaacatgaaacacctgtggttcttcctcctgctggtggcagctcccagatgggtcctgtcccaggtgcagctgcgaggacgtccgggcccagggactggtagaacgtcccttcaacgacgtacccctgtcccctcgaacctgcctactgtctcgtggtcgctccagtgagctaggttggtacgttaactacgtggtagttcggactccgacataccgaccggaaggggacggtcgtagggagtaggtagttcggtactagttacgttagtaacgtaggtacgggacgtaacccgaactacccgtaaacccgtccctaacgaagtacgtaccgtaacttaaccatactacgtaggtaacacgtaaccgtacgtaaacgtaccgtacttacccgtacccgtaagtacgcgtagtcgtacttcgtcgcgtacgtcggcccggacggaccgtacggtcgttacgttacgttaacgtcggtacggtacgtaagtacgttaacgttaccgtttaacgttacgggttacgggttaaccgggggttaattttaacgtttaaacgtttaaacggtttaccggttacccggttaacggttttaaccgtttttaacggtaacgggtttttaacgggtttaacgggggtaaccggttaaaaccggggttaacggttaacgggttaacccggg

SEQ ID NO: 22098 - DNA, 811 bp, Homo sapiens
  misc_feature: GYAE6OF01E29GK.35.3.A03.1.454.CMB.1.raw
tcagtacagatcgtcacgaccggtgctcgatttagagagcgtcacagggtctgtgaaggcttcaccagtcctggacctcctgtgcaaagaacatagaaaacacctgtggttcttcctcctgctggtggcagcctcccagagttgggtcctgtcccaggtgcagctgcgagggacggtccgggcccgagggacgtgggtagaacgtccttacacacgaccctcgtccctcacctgctacttgtctcgtggtcgcctcagtgacgcgtaggttcggtacgtttactacggtggtagttacggactccgaccgacgaccgaaccgggaaggggacggtcggtagggtaggtacgggtaacgtttcggggtaactacgtttacgttaacgttacggaggggtacgggaacccgtaaccctaacctaacccgtaacccccgttaccgtaacgtaaacgtacgttaaccgtaacttaaccgtaataccgtacgtaacggtaacgtaaccgtaacccggttaactaaaccggtaacccgttacgttcccgttacccgtaagaacggtccgtaagtaccgtccttacgtaggtacgtaccgtccggtacccggaccggtaaccgtccgggttaccgttagttaacgtcgttacggggacgtaccgggtaagtaacgttacgtttaccgttaagttacgggtttacgggttaacgggttaaattttaacgttaaacgttaacgtttacggttccgttacgtttaggtttacgttacgtttacgggggttacggaaaccgggtaagtacgtaggttaccgg

SEQ ID NO: 22099 - DNA, 665 bp, Homo sapiens
  misc_feature: GYAE6OF01D65V0.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgagcagtggtggttactacgtggagttggactccgccagcacccgagggacggctggagtggagttgggtacatctattacgagtgggacgaccactaccacccgtcctacgaagcgtacgacttaaccattactcaagtacgactacgtactaaacgacctagttcctacccgtagaacgtctacggacgtcttacgttcggtacgtaccgttcggacccggaccgggtaaccgtacccgggttcccggttagttaactttacgtggtacggacgtaagtacgtacctttaccgtttacgttacggttcggggtttaccggggtaagttttaatttaagttaaacgttttacgtccggttcgtttaccgtttttaggaacgtttacgggtttaacggggaacccggtaaacgggtacgtagttacccgggg

SEQ ID NO: 22100 - DNA, 616 bp, Homo sapiens
  misc_feature: GYAE6OF01BXIX9.35.3.A03.1.454.CMB.1.raw
  modified_base (252)..(252): a, c, t, g, unknown or other
  misc_feature (252)..(252): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
  modified_base (447)..(447): a, c, t, g, unknown or other
  misc_feature (447)..(447): n is a, c, g, or t
  modified_base (498)..(498): a, c, t, g, unknown or other
  misc_feature (498)..(498): n is a, c, g, or t
tcagtacagatcgtcacgaccggtgctcgatttagagagcgtcacagggtctgtgaaggcttcaccagtcctggacctcctgtgcgaagaacatgaaacacctgtggttcttcctcctgctggtggcagctcccagatgggtacctgtcccaggtcgcagcttagcaggagtccgggacccaggactggtcgaagcctttcacgagacccctgtccctacaccgtgccacgtgtctctgggtgctccatgancagtggtgttactacgtggattggactccgacagtccacccgagggtacggctggagtggatcgggactagtntactagnggtgggacgaccccataccgacccgtcagaacggactccgaactttacgatacncagtacgactacgtactaagaccttagtcctaccgtanaacgtcgagagtcctgtcgtacngtcgccgacggaactccgggtacgttagtacttacgtcgtagacgtagtanaccgttacttacgtaaggttcgggttaacgggtatttaaagttacttaagttagtcgtaccgtttcgttaagttacggtttacggttagggaaccccttaagggcctaaggttcccgg

SEQ ID NO: 22101 - DNA, 876 bp, Homo sapiens
  misc_feature: GYAE6OF01B9LED.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctccagatcgggtcctgtcccagggtcgcagctgcgagggacggtccgggcccaggactgggtagaacgtccttcacgacgtaccctcgtccctcacctgcctacgtcgtctcgtcggtcgcctccagtgacgcgtaggttggttacgttacgtacgtggtagttcggactccggaccacgtaccgaaccggaagggggaacgggtccgtagggtaggttacggggtaagtttacggggtaactacgttaccgttaagttaacgggtacgggtaacggggaacccgaaaccccgtaaccgtaaaccccggtaaacccccggtttacccgtaacgtaaaacggggtacccggttaaccgtaaacccgtttaaaccctaaacgttaacgttaaccggtaaacggttaaacgaaccgttaaaccggttaaaccgtaaaaccgtaacccggttacgtttaccctaaccggtaaggtaaacgtccgttaaggtacgtccgtttaacgtcgtaacggtaccgtcgggaccccggtacggaccgtaccgggttacgttagttaaccttcggttacggtacggacgtaacggtacttactttaacccggtttagtacgggtttacggggtttaaccggtaaagttttaaacttaacgtttaacgttacggttacggttccgttttacggttttacgtaaacggttttcggggttaacggggtaaaccggtaacggtaaacgttagggttaccccgg

SEQ ID NO: 22102 - DNA, 641 bp, Homo sapiens
  misc_feature: GYAE6OF01EE759.35.3.A03.1.454.CMB.1.raw
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtgttactactgggagttgactccgcacgccacccgaggggacggcctggagtggattgggtacntctattagagtgggacgaccataccaaccgtccacgaagacgtcgactttaccagtacncgagtacgacaacgttctaaacgaacctacgttcctacccgttagaacgcgttacgacgacttccgtacgtcgctacggccgtacggaccgacgggtcccgttgttaaccgttacttacggtcggtacgtacgtaacgtacgttaccctttagtacgtttagggttacggggtaagtttacgtttaacgttaaggtttaagttccggttacgttacgtttttgaacgttttacgggttagggtacccggtaaacgggtacgtaaaggttaccggg

SEQ ID NO: 22103 - DNA, 600 bp, Homo sapiens
  misc_feature: GYAE6OF01A70IU.35.3.A03.1.454.CMB.1.raw
  modified_base (364)..(364): a, c, t, g, unknown or other
  misc_feature (364)..(364): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcggcccaggactggtgaagccttcacagaccctgtccctcacctgcactgtctctggtgctcatgagcagtggtgttactacgtggagttggatccgcagcaccgagggacggcctggagtggagttgggtacatctattacgagtgggacgaccactaccgaacccgtcctagaagacgtcgaactttacattacncagtagacgtacgtactaacgaacctagttacctaccctagaacgtctagacgtctcttgacgacgtcgccgtacgacaccgggtcgttagtacttaccgtgtcgaccgtaagactcttaccgttacgtagttcgggttacgggtatttaacgttaagttaacgtttagtccggttcgttcgttttaggaactttacgggtttacgggaaccggtaagggtactaagggttcccgg

SEQ ID NO: 22104 - DNA, 810 bp, Homo sapiens
  misc_feature: GYAE6OF01C8RJ8.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagcctcccagatcgggtcctgtcccaggtgcagctgcagggacggtccgggcccaggactggtacgaacgtcccttacaacacgaccctcgtcccctacacctgccactgtctcgtggtcgcctaccagtgacgcgtaggttggttacgttaactacgtgggtagtcggactccgacacgaccgaccggaggggtacgggccgtaggtagtggtagttacggtaactacgttactagttaacgtagggtacgggaccgaacccctaacctaaccctaaccccgtcctaacgaacgtacgtcctaaccttaacatactacgagtaacgactaccgtaactaaacgtacctacgtttaccctacccggtagaacgtcgtaacgacgtcttacgtcggtacgtacggtcccggacccggaccggaacccgtacccgggtaccggttttaacgttaacgtttacggtacgggtacggaaccgggttaacgtaaccgtttaaccgttttaaccccgtttaggttaacggggtttccgggggtttaaacgggttaaacttttaaacttttaaacggtttaaacgtttacgggttacccgtttcggtttttaacggttttaagtaacggtttttaacggggggttaccgggaaaccggtaaacggggttaaccgttaacggtttacccggg

SEQ ID NO: 22105 - DNA, 813 bp, Homo sapiens
  misc_feature: GYAE6OF01AFMBK.35.3.A03.1.454.CMB.1.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
tcagtacagatcgtcacgaccggtgctcgatttagagagcgtcacaggggagcttcagctgtgggtagagaagacaggactcaggacaatctccagcatggccagtcttcccctctcctcctccaccctcctcactcactgtgcgacgggtccgtcgggacccagtctggtggtgactcacgccctaccctcaacgtcgtccggggacccccggngaggacggtccacattcttcttgttcgaggancacgcctaccaacgagtacggtaaattaaatacgtaacgtaaacgtcggtaaccaggtacacgaccctaccggaaccggaaccccggaacccccctaaactccctaacgtacttactaaataaacttaaactacgtacgaacggcccggtaccctcggaaacggttcctacccgtaccgaccgttacttttccgcggtacgtacccttaccgacgttcgccggacctcctaccgtcccgtcccctccgtcggaccttacgtcggttaggtcggtacccctacggttcgtacgtagggtacggtacggttacgggtaccggttagttaaccgttaagtttaccgtaaccggttacggttcggtaccgtacgaacggtttaccgggtagggtacggttaacgccggtaacgtacccgggttaggtacgggtttacggggtacggggtttggggttccgggggttacggggtaaccggggaacggttaaccggaccgggttaccggtaccgggtaccggttcccggtaacggtacccggtacccggtacccggtccggttaccccccgg

SEQ ID NO: 22106 - DNA, 705 bp, Homo sapiens
  misc_feature: GYAE6OF01DEJPB.35.3.A03.1.454.CMB.1.raw
tcagtacagatcgtcacgaccggtgctcgatttagagagcgtcacaggggagcttcagctgtgggtagagaagacaggactcaggacaatctccagcatcggccagtccttccctctccctcctccaccctcctcacctcactgtgcgacgggtccgtcgggcccagtcgtgtggtgactcacgcccaccctcaaccgtcgtccggggacccccgggaggacggtccaccatcctcttgttctaggaagcagcctaccaactagtacggaagtaattaacgtacgttaaaacgtcggtaaccacgcgtaacgccctacccggaacgggaaccccggacccccaacctccactatactataaataataactcgacgccgtccctacaaggccctccgtacgaccgttacttccgtctcgggtacctaccgtaacgtcgtcggcctccctacgcctccccgttcgtccggacctgtaaccggtggtccgggccttccgtacggttccgtaggtaacggtacgtagacggttccggttagtacttacgttaccgtaacggttgtccggactacggtagtacggtagggtactacggctacggtaccgtaggtacgggttgggggtcgggtttggtagggggccgggtaaggacggtagtccgtaccgggtacccgttaggtaccggccaacggccccgtggtcccccg

SEQ ID NO: 22107 - DNA, 669 bp, Homo sapiens
  misc_feature: GYAE6OF01B2SEX.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagcctcccagatgggtcctgtcccaggtgcagctgcaggagtcggcccaggactggtagaagtccttcacacgaccctgtccctcacctgcactgtctcgtggtcgcctccagtgagctaggtggttagttactacgtggtagttggactccgccagccaccggagggacggccgtggagtggagttgggtacagtctagtacgaggtacgggacgaccccactaaccgaccccgtcctacgaagtcgtaccgtaaccttaccatactctaacgtacgacgtacgtactaacgaaccgtagttccgtcctagacgtcgtgacgtctcgtgtacgtaccgtcggcccggacggaccgtaccggtaccgttcgttaacgttacgtggtacggacggtagtacgttacttacccgtttagtacggttcggggtttacgggttagttttaagttaacgttacgtttaagtcccggttagttttccgttttagtacgtttacgggtttacggggtaccggtaaacgggttaccgtaggtttacccggg

SEQ ID NO: 22108 - DNA, 915 bp, Homo sapiens
  misc_feature: GYAE6OF01DIV48.35.3.A03.1.454.CMB.1.raw
  modified_base (914)..(914): a, c, t, g, unknown or other
  misc_feature (914)..(914): n is a, c, g, or t
tcagtacagatcgtcacgaccggtgctcgatttagagagcgtcacagaccctgtccctcacctgcactgtctctggtgctccatgagcagtggtggttactagtgggagttggatcccgccgagaccacccgaaggggaacgggtccgtagggagtggtagttgggtaacattcttaattacgaggtgggaacgacccctaactaacccgtaaccccgtcccgtacgaaagtacggttaccgtaactttaaccaattacttaccaaggttaacgacgaacgttacctaaaacgaacctaacggttttccacccgttaggaacgtcttagacgtcttcgtggtacagtccggaccgacggacgtacgggtctagttaacgttacgtgtgacggtaggaattaccgtttacgttaaccgttaggtttacggggttacggggtttaaattttaatttaaagttttaaaacgttacggtccgttacgttttacgttttaaggttaacgtttaaggttttccgggggaaaaccgtaacggggtaaaccttaaggtttaacccggttacccgtaaccggtttaccgtttacgtttaccgaacccgttaccccgttacccggaaacccgggttaaacccggggtccccttaaccgggttcccggttttaaccccccgttacccccgggttcgggtccccccgtaccccgttacggtacccgttaaccggacggttaccgaacccgtacccccggtaacgacgtaaccggaaccctaccggaaccggccccgggtacgggttccggtaacgttccggaaccggttcgtaaacccggtacgtaacctttcccgtaaccgacggttaacttcgtaacgtaccgtggacggtcggaccgtaggaccggaccgagaccgtagtagng

SEQ ID NO: 22109 - DNA, 1064 bp, Homo sapiens
  misc_feature: GYAE6OF01CBG88.35.3.A03.1.454.CMB.1.raw
  modified_base (222)..(222): a, c, t, g, unknown or other
  misc_feature (222)..(222): n is a, c, g, or t
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcgtagggttccgtcgggaccccagtcgtggttggtcgtacctcacgcccaccctacaacgtccgtccggggacccccgggtnaggtacgggtccaccgattccttcgtttcggttcgttaggaaagtccgacgtcctacccgaaacgacgttaaccggtaaaagttaaactttaaccgttaacggttaaaaaccgttacgggtaaaccccgaaggtacccgtaaccggtaccccgttaaccccggaaaaccggggtaaacccccccggtaaaccccccccttaaaccctaccccgttacgtaaccgtttaaccctttaaacgtttaaaacttaaaacgttaaccgtaccgggtacccggtacccccgggtaccccgtttaaccggaaccggtaaccggtttccccccgtaagggttaacccccgtacgttttaacccgttccgggttaccggttaccccgttaacccggtaacgggtttcccgttaccgggtaccccggtaccccttaaccccgggcccgtttacccccggttacccccggtaacggggttacccctttaaccggtacccggtaacgggggttacccgggtcccctacccgggtttaaccggttaccggttacgggacgttaaccggtacgggtaccggtttaacgttaccgttaaggtttacccgtccgttaacgggtttcgacccgtagtcgggttacggaacggtttacggggtacttaaccggtaaccggttaccgggttaccgggttaaaacggtttcgggggttaggggttttaaacccggggtttgggggttaccgggtaaacgggggtaccggaacccgggtacgttacccgggtaacccgggttacccgttaccgggttaccggaacccggtacgggtaaccccggtaaccgggttccccccggg

SEQ ID NO: 22110 - DNA, 668 bp, Homo sapiens
  misc_feature: GYAE6OF01CE843.35.3.A03.1.454.CMB.1.raw
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
  modified_base (550)..(550): a, c, t, g, unknown or other
  misc_feature (550)..(550): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctctgctggtggcagctccagatgggtcctgtcccaggtgcagctgcaggagtccgggcccagggactggtagaagtccttacacgacgaccctgtccctnaccgtgctactgtctcgtggtcgcctcagtagngcgtaggttggttacggttactacggtgggtaacgttggactcccgctacgaccgaaccccggagggggaacggtccgtagggtaggtggtacgtttacgggtactagttctaagttacgagggtacgggacgacccctacgtaaccaacccggtcctaacgaagtcgtaccgtactacgtaactgtacgagtaacacgtactaacgtaagaccttcgttacctacccgtagtaacgtctaggtactcgtcgtacggtacgtccgtcggacccggtcggaccgtaccggtcgtagttactacgnggttacgaccgtaagtacgtctttactagttacgggtgggttacggtattagtaacgttacttagtcgtcgtttactttaggcgtttaggttacgggaactaagggtcaaggttcccg

SEQ ID NO: 22111 - DNA, 754 bp, Homo sapiens
  misc_feature: GYAE6OF01CGRLQ.35.3.A03.1.454.CMB.1.raw
  modified_base (155)..(155): a, c, t, g, unknown or other
  misc_feature (155)..(155): n is a, c, g, or t
tcagtacagatcgtcacgaccggtgctcgatttagagagcgtcacagggtctgtgaaggcttcaccagtcctggacctcctgtgcaaagaacatgaaacacctgtggttcttcctcctgctggtggcagctcccagatgggtcctgtcccaggtncagctgcaggagtcgggcccaggactgggtgaacgtccttcacgacgtaccctcgtccctacaccgtgcctacgtgtctcgtggtcgcctaccatgagctaggtggtacgttactacgtggtagttcggactccggacgacgtaccgaacccggaaggggaacggggtccggtagggagttacggggtacgtttacggggtaactagttacgttaagttacggtaggtcggggtaaaccgacccctaaccgtaacccgaaccccgttccctaacgaaacggttacgtaccgtaacttaaacccgattaacgtacgaacgtaagaaccctacgttaaccgtaaacggtaaccgtacgtttaccctacccggtagggtaacgtcgtaaggacgttacctcgttacggtcgaaccgtccgggacccggaccgggtacgtacccgggttccgttaagtttacgttacgtcggtacggacggtagtaaccgtactttaccgtagttacggttcgggtacgggttaagtttaattaagttacttagtcgtcgttacgttttagacggtttaggttacggggaccgtaaagggtctaggttaccgg

SEQ ID NO: 22112 - DNA, 740 bp, Homo sapiens
  misc_feature: GYAE6OF01CAXVY.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggaggtccgggcccaggtactgggtagaagtcccttcacacgacccttcgtacccctcaccctgacctaccgttgtccttcgtgggtcggtcctccatggagcgaggttggttacggttacttacgtggtaggttggactccgccgagtccgaacccggaggggacggtccgtgggaggtggtacgttacgggtactacgtacttaagttacgagggtacgggaccggaacccctaaccttacccgaaccccgttccgtacgaaagtacggtaccctacgttaccatacgttacgaagtacgaactacgtaactaacgacctacgttcctaccgtgtaacgcgtagacgtcttcgtggtacacgtcggtacccggacgtaacccgtacggtaccggttagtacgttacgtgggtacgtacgggtaagtacgttacctacctttacggtacggttcgggggttaacggttaagtttaatttaaccgttaacgtttacgttaccggttacgttttccgtttaaggttacgttttacggttacgggggtaacgttaaacggggtaactaagggttacccgg

SEQ ID NO: 22113 - DNA, 696 bp, Homo sapiens
  misc_feature: GYAE6OF01ETZRQ.35.3.A03.1.454.CMB.1.raw
  modified_base (228)..(228): a, c, t, g, unknown or other
  misc_feature (228)..(228): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagagtcgggtcctgtcccaggtgcagctgcaggaggtccgggcccaggactgggtgaacgtccttcactacgaccctcgtccctcacctgcactntctctggtcgctcatgagcgaggttggtcggttactacgtggaaggttgactccggacagccacccggaaggggaacggctagggacgtggtaggttggactatctagttacgagggttcgggaacgacccctaacgtaacccgtaccccgttccctacgaacggtacgtaccgtaacctttaccgaattacgtcgaaaggtacgaaccgtaacggtaccttaaaacggacccttacgtttacccgtacccgtaggtaacgtcctaggaacgtcttcgtgttaccggacttccgggccgccggtaaccaccggggttcccttagttaacgttcgtggtccgtaccggtagtacgtactttaccgttagtacgttggggttaccggtaatttacttaagttaagtagttcgtcgtttagtttagtaaggtttcggttacgggtaaccgtaagtaccgtaggttacccgg

SEQ ID NO: 22114 - DNA, 1014 bp, Homo sapiens
  misc_feature: GYAE6OF01BVK4L.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtccaggtgcagctgcaggagtccgggcccaggactggtgaacgtcccttacacgacgtacccgtcgtaccctcacgtgcctacgttcgtcctcgtcggtcggtcctaccgaagtcggacgtcggtaaggtttcggttacggtttaacgttaccggttaggggtaacggttttacgggaaccgtttcccggacccgtaacgggtacccccgtaaaaccccggggaacggggggtaaaaccgggggtccccggtttaaggggggaaccggtttaggggggtaacctttttacggggggtaaaccttaacggtttacccgtttaaacgtttaaacgggtaccggggtaaccgggggtaaccggtaaacccccctaaacccgttaaccccggtaaaccccccggtttaccgtaaaccccggtaaaagtacccggtaacccggttaaaacctttaaccccgtaaagtttaaccgtaaccgtaaacgggttaaaccgggtaaacccttaaccgggttaaactaaaacccgggtttaaacccgtaacgggtttcccgttaaccccgttaaacgggtaaaccgttacggttaaggtaaccgttccgtttaaccgttacgggttacccgtaaccgttaccgggtccccggtaacccgggtaaccggtaacccgggttaccgtaggttttaacgtaacgttaggtaccgggtacggtaacggacgttaacgttacccttaggttaaaccgggtttcggggttaagggttacgttttaaacgttaacgttaaagttttaggaccgttccggttagtttttaacggacgtttttacggggttaacgggtaaccggtacgggtaaacgtaacggttaccggg

SEQ ID NO: 22115 - DNA, 799 bp, Homo sapiens
  misc_feature: GYAE6OF01BY2TW.35.3.A03.1.454.CMB.1.raw
  modified_base (356)..(356): a, c, t, g, unknown or other
  misc_feature (356)..(356): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagagtgggtcctgtcccgaggtgcagctgcgagggacgtccgggccaggacgtggtgaacgtccttacgacacgacccgtcgtccctcacctcgacctacgttcgtctcgtcggtcgtcctacgagtgacgtcgtaggttcggttacgttactcgtagggtaggttcgacgtccgcacgccgaaccggaggggacggtcgtgggagttggacgtttcgggaanacgttcgtaacgttacgagggtcgggaaccggtacccctaacgtacccgtaacccgtcccgtaacgaagtaccggtaccgtaactttaacccgagttaccaacgtacggtaacaccgtaacggtttaaccaaccggtaacctttacgtttcccgtaaccgttcggtaaccgtaccgtaggtacgttccttacgttacggtcgtaaccgtccggtacccggacggaacccggtaccggttacccgttaggtttaacgtttacggttacgggtacggacgggttaagtaaccggtttaacgtttacccggtttaacggtaggtttccggggttagggtttaactttaaaggttaacgttacggttacggtaccggttgtttttaccgtttaggttaacgtttcgggttacgggtaaaccggtaaggttaacgtaaccgggttccg

SEQ ID NO: 22116 - DNA, 603 bp, Homo sapiens
  misc_feature: GYAE6OF01D92X6.35.3.A03.1.454.CMB.1.raw
  modified_base (361)..(361): a, c, t, g, unknown or other
  misc_feature (361)..(361): n is a, c, g, or t
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtagaagccttcacagaccctgtccctcacctgcactgtctcgtggtgctcatgagctaggtggtggttactacgtggagttggatccgcagccaaccgagggtaacggctgggagtggattgggtacagtacctattacgaggtacgggacgtcccccaataccaaccccggtccctanaacgagttcgacctttaccgatactcagtagaccacgtactaaagacctagttcctacccgtagaacgtcctagaacnctcgtgtacgacgtcgcccgnggaaccncggtccgtagtaacttacgtggtacgcgtaagactacttccgttactagttgggttacggggtatttattagttaacttagtccggcgttctttagagttacggtttacggggaacctaagggtactaaggttcgg

SEQ ID NO: 22117 - DNA, 919 bp, Homo sapiens
  misc_feature: GYAE6OF01BHO5O.35.3.A03.1.454.CMB.1.raw
tcagtacagatcgtcacgaccggtgctcgatttagagagcgtcacagggtctgtgaaggcttcaccagtcctggacctcctgtgcaaagaacatagaaacacctgtggttcttcctcctgctggtggcagtcctcccagtagtcgggtcctgtacccgaggtgcagctgcgaggtacggtccgggcccaagggacgtgggtacgaacgtccttacacgacggtaccccttcgtcccctactaccctgcctacgttcgtcctcgtggtcgcctccgagtggacgtcgtaggttcggttacggttaacgtacggttaggtaggttcggacctcccggaccgtaacgacccggtaaaccggaagggggtaccgggtcccggtaaggggtaggttacgggtaacggttacgggtaactacgtttaccgttaacggttacggtaaggggtaccggggaacccgtaacccccgtaacgtaaacccccggttaacccccggtccgtaaacgaaaccggttacggttaccctaaacctttaaccgtaacttacgtaaccgtaaacggtaaaccgtaacgtaacccgttaacgtaaaaccgtaaccctttacgtttaccccgtaaccgtaaggtacgttacgtagtaccgtaccgttcgtaacgggtaccgtaccgcccggggacccggtaacccgaaccggttcggttaccgtttaacggttacgttccggtacggtagggaaacccggtagttacccgttacttaaccccggttaggttaggggtttaaccggggttagtttaaaccgtttaaatttaaccggttaacgttacggtccggtttaacggttttacgtttaaggtaacccgggttttaggggttaccccggggaaacggtaacggttaaacgttgggttacccccggg

SEQ ID NO: 22118 - DNA, 921 bp, Homo sapiens
  misc_feature: GYAE6OF01D22D6.35.3.A03.1.454.CMB.1.raw
tcagtacagatcgtcacgaccggtgctcgatttagagagcgtcacagggtctgtgaaggcttcaccagtcctggacctcctgtgacaaagaacatagaaacacctggttggttcttcctcctgcgtggtggcacgcctccagtagtcggtcctcgtccgaggtcgcagctgacgaggacggtccgggaccgaggacgtaggtagaacgtttttttttttccacaccgaccgtaccctccgtccctccacctcgcctacgttcgttccgttcggtcgggtccggtccgtaccgtagtacggacgtacggttagggttcggttacggttaacccgtaggttagggttacggttacggtacgtacccggaccgtaccggaccccggaacccggaacggggggtaaccggggtacccggttaggggtacgggttagggtacggtttacgggtaaccttacggttacctttaaacgttacggttacgggaacgggtaacccggaaaccccgtaacccgtaaacccggtaacccccgtacccgttaaccggaaagtacccgggttaaccgtaaccctttaaaccgtaataacttacggtaaacgtaaccgtaacctaaccggtaaacgttaaaccgtaacccggttactttacccgtaccgttaaggtaaacggtcgtaacggtactaccgtttacgagtacccggacgtcccggtacccggaacggtaaccggtacccgggttaacgttggtaaacgtttcggacggtacggaacgttaacggaacgtttacccgttaccggtttaacgtaggggtttacgggtaacgggtttaacttaagttaaacgtttacgttagtaccggttcgtttacgttttagtacgtttacggggttacggaaccgaaacggttagaacggtttaccg

SEQ ID NO: 22119 - DNA, 724 bp, Homo sapiens
  misc_feature: GYAE6OF01B0OMV.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtgttcttcctcctgctggtggcagctcccagatgggtcctgtcccaggtgcagctgcaggagtccgggacccaggtaccgtggttagaagccctttcaacgacgtaccctcgtccctcaccttgctactgtctcgtaggtcgcctccagttggacgcgtaggttcggttacgtaacgtacgtggtaacggtttcggacttccgaccgaggaccctaaccggagggacggtccgtagggacgtgggtaagtttcgggtaactcgtttactaacgttacgagggtcgggtaaccggacctaaccggtaccaaccccgtccgttagaacggtacgtccgtaactaccgaacttagtacacgtagactaccggtaactaacgaccgtacgttacctccgtacgaagtaccgtcgtaacgtcgttaaccggtcgttacgtaccgtcggaccgaccgggtaccgtaccggtcccggttagttaacgtttacggtagtaccggtaggtacgtaacgttaccttacccgttagttacggttcggttaacggggtatttaagttaacgttaagtttcgttcgtaccgttatttagtcgttacggttacgacgtaacggtacgtgttacgg

SEQ ID NO: 22120 - DNA, 866 bp, Homo sapiens
  misc_feature: GYAE6OF01AJDLG.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctgggtggcagcctcccagatgggtcctcgtcccaggtgcagctgcagggacgtccgggcccaggactgggtacgaacgtccttcacgtaccgtaccctcgtcccctacacctgacctcgtcttacctcggttcgggccgtcctacctaagtcggacgacgtacgggttcgggttacggtttaaccgtacggtagggtacggttcgggtacctcccgcctaacggcccgaaccccgggtaaggggaccgggtccgtaggggtacggttacgggtaggtttacggggaacttacgttacgttaacgttaacggagggttacggggaacccgtacccctaaaccgttacccgaaccccgttccctaaggaacggtaccggttaccgtaaccttaccgaacttacgtacgtaacgtaaccgaacgttaccgtaaaccgtaaaccggtaaccgttcgttaccctaccggtagtaaaccgttcgtacgtaaccgttcttacggttacgtccggtacccggtccgggacccgggtacccgaaccggtccgggttaccgtttagttaccgttacgtcgggaacggtaccgggtaaaggttccttaaccgtttacccgtttaagggttacggggtttcggggttaaacgggttttaaatttaacgttacgtttaaccgttacggttacgttaccggttttctttagggtaccggtttaggggtaccggaacggtaacggttacgtacggttcccgg

SEQ ID NO: 22121 - DNA, 779 bp, Homo sapiens
  misc_feature: GYAE6OF01A1N5K.35.3.A03.1.454.CMB.1.raw
  modified_base (141)..(141): a, c, t, g, unknown or other
  misc_feature (141)..(141): n is a, c, g, or t
  modified_base (368)..(368): a, c, t, g, unknown or other
  misc_feature (368)..(368): n is a, c, g, or t
  modified_base (401)..(401): a, c, t, g, unknown or other
  misc_feature (401)..(401): n is a, c, g, or t
tcagtacagatcgtcacgaccggtgctcgatttagagagcgtcacaggggcagcttcagctgtgggtagagaagacaggactcaggacaatctccagcatggccagccttccctctcctcctcaccctctcactcactgtncaggtcctgggcccagtctgtggtgactcacgcccacctcaacgtcgtcggggacccccgggcagacgggtcaccgtatcgtcttgttctggaacgccacgcctaccaacgcgtacgggaaagttaactaactagttaaaaccttcgggtaaccacgtacacgtccgtacccgacggaaccccggaaccccctaaacgtccttacgactactaaataaactataacncgaacgccgcccagacgactcccagccgattcncgtgcctacgacgtcgtcggccctcgtacgaccgtccctacccggtggacccttacgtcgtacggtccggggacccttaccgtaacggttccgacggtacggtacgtacgggtaacggtcttacggtactttaaccgccgttaacgttggttaaccggccttaagggtccgttaaacgggtcgggtaacgtacggtaacccgtacgggtaacccttagggggttaaacggggttacgggggtttggggttttaccgggggtttccggggggaaccggggtttacggaaaccccggggttaccgttacgggttacccggttaaacccgggttccgggttaaacggtaaccccggtacgggtaaccccggtaaaccgggg

SEQ ID NO: 22122 - DNA, 789 bp, Homo sapiens
  misc_feature: GYAE6OF01CLKPC.35.3.A03.1.454.CMB.1.raw
  modified_base (135)..(135): a, c, t, g, unknown or other
  misc_feature (135)..(135): n is a, c, g, or t
  modified_base (142)..(142): a, c, t, g, unknown or other
  misc_feature (142)..(142): n is a, c, g, or t
  modified_base (200)..(200): a, c, t, g, unknown or other
  misc_feature (200)..(200): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
tcagtacagatcgtcacgaccggtgctcgatttagagagcgtcacgaggggggggtagagaagacaggactcaggacaatctccagcatggccagccttccctctcctcctccaccctcctcactcactgtgcgngggtccnggcccagtcgtggtggtgactcgcgcccacctacaacggtccgtacggggcccccggnaggacgggtccacctactctcgttgttctaggaacgcagcctacgaaacacgtacggtaaataataactaaggtaaccgtacggtaaccaggcacgtacctacccgaaccggggtaaccccgaccccctaaacttcctacacttactaaataattaactatacgacggtccggaccctacgacggtaccgttcccgnggtacctacgtttacnccggttaggtacctaccgtaacgttccggtacggtcctacccgttccgacccggttcccctacggccgacctaacggtccggtacggttccggaccttcggagttaccgggaggtacggagttcggggattcgtaagtacgttacgtacgtacggtccgtagacgttacgagttacgggtacggtagtaaccgtaacggcgttacggtacggttagggggtcggggtttacggggtttacgggtacgggggaacgggaccggtaccggtaccgtcggggtacccgtacggttaccggtaaccgggtccaacccgggtacggttaaccggcccgttaccccgggcccttaggtacccgtcctttccccgtaccccgg

SEQ ID NO: 22123 - DNA, 537 bp, Homo sapiens
  misc_feature: GYAE6OF02GR3AG.35.3.A03.1.454.CMB.1.raw
  modified_base (537)..(537): a, c, t, g, unknown or other
  misc_feature (537)..(537): n is a, c, g, or t
tcagtacagatcgtcacgaccggtgctcgatttagagagcgtcacagaccctgtccctcacctgcactgtctctggtggctccatgagcagtggtggttactactggagttggatccgccagcacccagggaagggcctggagtggattgggtacatctattacagtgggaggacccactacaacccgtccctcaagagtcgacttaccatatcagtagacacgtctaagaaccagttctccctgaagctgagctctgtgactgccgcggacacggccgtgtattactgtgcgagagatccttactatggttcggggattattataattatcgcgtcttttgattagtttggggcctaaaggggacaagtggtcaccgtctcttcagcctccaccaacgggcccagtccggtccttcccccgtggccgccctcgcctccaggacgccacctccgagacgcacgagccggcccgtgggcctcgccgtgtcaggactactccacgtatcgtgtactgacgcggctggcaggcgcatagn

SEQ ID NO: 22124 - DNA, 505 bp, Homo sapiens
  misc_feature: GYAE6OF02GHE42.35.3.A03.1.454.CMB.1.raw
  modified_base (425)..(425): a, c, t, g, unknown or other
  misc_feature (425)..(425): n is a, c, g, or t
tcagtacagatcgtcacgaccggtgctcgatttagagagcgtcacaggggggtagagaagacaggactcaggacaatctccagcatggccagcttccctctcctcctcaccctcctcactcactgtgcagggtcctgggcccagtctgtggtgactcagccaccctcaacgtctgggacccccgggcagagggtcaccatctcttgttctggaagcagctccaacatcggaagtaatactgtaaactggtaccagcagctcccaggaacggcccccaaactcctcatctataataataatcagcggccctcaggagtccctgacccgattctctggctccaagtctggcgcctcagcctccctggccatcagtgggctccagtctgaggatgaggctgattatcactgtgcagcatgggatgacngcctgaatgggtggtgttggcggagggaccaagctggaccgtctaggtcagcccaaggctcgcccctggtccactctccg

SEQ ID NO: 22125 - DNA, 514 bp, Homo sapiens
  misc_feature: GYAE6OF02IGMJH.35.3.A03.1.454.CMB.1.raw
  modified_base (188)..(188): a, c, t, g, unknown or other
  misc_feature (188)..(188): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
tcagtacagatcgtcacgaccggtgctcgatttagagagcgtcacagggggggtagagaagacaggactcaggacaatctccagcatggccagcttccctctcctcctcaccctcctcactcactgtgcagggtcctgggcccagtctgtggtgactcagccaccctcaacgtctgggacccccgggnagagggtcaccatctcttgttctggaagcagctccaacatcggaagtaatactgtaaactggtaccagcagctcccaggaacgcccccaaatcctcatctataataataatcagcggccctnaggagtccctgaccgattcnctggctccaagtctggccgcctcagcctccctggccatcagtggctccagtctgagntgagctgattatcactgngcagcagtgggatgacngcctgaacgtgggtggtgtttggcggtaggaccagcgtgaccgtccgtaggtcacgcccaaggctccgcccccgtggtcctaccgtctcccg

SEQ ID NO: 22126 - DNA, 527 bp, Homo sapiens
  misc_feature: GYAE6OF02HBSKH.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgagcagtggtggttactactggagttggatccgccagcacccagggaagggcctggagtggattgggtacatctattacagtgggaggacccactacaacccgtcctcaagagtcgacttaccatatcagtagacacgtctaagaaccagttctcctgaagctgagctctgtgacttgccgcggacacggccgtgtattactgtgcgagagattccttactatgggttcgggagtttattagtaattatcgtcgtcttttagattagtttggggacctaagggtacaagttcgg

SEQ ID NO: 22127 - DNA, 538 bp, Homo sapiens
  misc_feature: GYAE6OF02GRK9T.35.3.A03.1.454.CMB.1.raw
  modified_base (369)..(369): a, c, t, g, unknown or other
  misc_feature (369)..(369): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactactggagttggatccgcagcacccagggaagggcctgggagtggattgggtacatctaattacaggtgggaggacccactacaacccgtccctcaagagtcgacttacatatcagtanacacgtctaaagaaccagttcctcctagaacgctgacgctctgtgactcgccgcggaccacgggccgtgtacttacgtgtgcgagagacttccttactagttgggttcgggtatttattagtaatttatcgtcgttcttttgattgttgggacctaagggactagtcgg

SEQ ID NO: 22128 - DNA, 499 bp, Homo sapiens
  misc_feature: GYAE6OF02ITYB9.35.3.A03.1.454.CMB.1.raw
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctgggcccagtctgtggtgactcagccaccctcaacgtctgggacccccggcagagggtcaccatctcttgttctggaagcagctccaacatcggaagtaatactgtaaactggtaccagcagctcccaggacgccccaaactcctcatctataataataatcagcgcctcagntccngaccattcntgctccaagtctggccnctcagccctccctggccatcagtgggctccagtctgagatgagctgattatcactgtgcagctagtgggatgacagcctagagtgggtggttgtttgggcgggtacggacgaagcgtacgaccgtcgtacggtcacgacccgaggccg

SEQ ID NO: 22129 - DNA, 540 bp, Homo sapiens
  misc_feature: GYAE6OF02H0HL5.35.3.A03.1.454.CMB.1.raw
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (407)..(407): a, c, t, g, unknown or other
  misc_feature (407)..(407): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactacgtggagttggatccgcagcacccgagggaaggcctggagtggattgggtacatctattacagtgggagacccactacaacccgtccncaagngtcgacttaccatatcagtagacacgtactaaacgaaccagttcctccctgaagctgagctntgtagactcgccgcggacacggcgtgtattactgtgcgagagtattccttagtagttgggttacgggtagtttattaagtaatttatcgtcgttcttttagattagtttgggaccgtaagggacctaagtcgg

SEQ ID NO: 22130 - DNA, 537 bp, Homo sapiens
  misc_feature: GYAE6OF02I44VU.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactactggagttggatccgccagcacccagggaacgggcctggagtggattgggacatctattacagtgggacgaccccactacaacccgtcctcaagagtcgactttaccatactcagtagacacgtctaagaccagttcctccctgaacgctgaagctctgtgactgccgcggacacggcgtgtattctgtgcgagagactccttacgtattgggttacggggtagttagttataagttatacgcgttattttgattcgtttaggggcctaaggggtactagtcggg

SEQ ID NO: 22131 - DNA, 641 bp, Homo sapiens
  misc_feature: GYAE6OF02HTZLW.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtgttactacgtggagttggatccgcagcaccgagggaagggcctggagtggattgggtacagtctattacgaggtgggacgacccactaccaacccgtccctacgaacgacgtcgacgtacaccatactacacgtacgactcgtaccaacgtaacccagttcctcccgtaggaacgtctagacgtcctcgtcgtcgaccggtccgacggaacaccgggtctggttacgttaattaccgtcggttagaccggaaggtaccgtccggtttaccgttacggaccgtagggtcccggtaccgttacccgggccccggtacctacccgtaaacggtttaacccgttaccgttttaccggaccttcccgggttcggggaacccgttacgggaccccgttacggg

SEQ ID NO: 22132 - DNA, 598 bp, Homo sapiens
  misc_feature: GYAE6OF02GD2GZ.35.3.A03.1.454.CMB.1.raw
  modified_base (598)..(598): a, c, t, g, unknown or other
  misc_feature (598)..(598): n is a, c, g, or t
tcagtacagatcgtcacgaccggtgctcgatttagagagcgtcacagaccctgtccctcacctgcactgtctctggtggctccatgagcagtggtggttactactggagttggatccgccagcacccagggaagggcctggagtggattgggtacatctattacagtgggaggacccactacaacccgtccctcaagagtcgacttaccatatcagtagacacgtctaagaaccagttcctcctgaagctgagctctgtgactgccgcggacacggccgtgtattactgtgcgagagatccttactatgggttcggggagttattataattatcgcgtcttttgattagtttgggggaccaaaggggacaagttggtacaccggtcttcttcacgtccctccaaccgaacgggcccagtccggtccttcccccgtggccgtccctcgcctccgaggacgcacccgtccgagacgcaccgacgccggcccgtgggcctcggtccgttcgggtacaaacgggtactaccgttccgacgtactccgtaggtacctcggacggtccggggcgttcgggaccgtaacgggccgacgagtaggn

SEQ ID NO: 22133 - DNA, 539 bp, Homo sapiens
  misc_feature: GYAE6OF02GXAVB.35.3.A03.1.454.CMB.1.raw
  modified_base (201)..(201): a, c, t, g, unknown or other
  misc_feature (201)..(201): n is a, c, g, or t
  modified_base (324)..(324): a, c, t, g, unknown or other
  misc_feature (324)..(324): n is a, c, g, or t
  modified_base (363)..(363): a, c, t, g, unknown or other
  misc_feature (363)..(363): n is a, c, g, or t
  modified_base (448)..(448): a, c, t, g, unknown or other
  misc_feature (448)..(448): n is a, c, g, or t
tcagtacagatcgtcacgaccggtgctcgatttagagagcgtcacaggggcagcttcagctgtgggtagagaagacaggactcaggacaatctccggcatggccagcttccctctcctcctcaccctcctcactcactgtgcagggtcctgggcccagtctgtggtgactcagccaccctcaacgtctgggacccccgggnagagggtcaccatctcttgttctggaagcagctccaacatcggaataatactgtaaactggtaccagcagctcccaggaaccggcccccaaactcctcatctataataataatcagcgccctnaggactccctgaccgattctctggctccaagtctggccncctcacgccctccctggcccatcgagtcgggcctccgagtctgaggatggaggctgattatcactgtgcagcagtgggatcgacnggtcctagaagttgggtgggttggttcgggcgggaacgggaccgtaaggtccgtaggtaccgtcgtaggtccacggtacccgaaggtcccg

SEQ ID NO: 22134 - DNA, 526 bp, Homo sapiens
  misc_feature: GYAE6OF02HA2PJ.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactactggagttggatccgccagcacccagggaagggcctggagtggattgggtacatctattacagtgggaggacccactacaacccgtcctcaagagtcgacttacatatcagtagacacgtctaagaccagttctccctgaacgctgagctctgtgactgccgcggacacggccgtgtattactgtgcgagagattccttactagtggttcgggagtttattataagttatcgtcgtcttttgattagtttggggacctaagggtactaagtcgg

SEQ ID NO: 22135 - DNA, 607 bp, Homo sapiens
  misc_feature: GYAE6OF02J0K5Y.35.3.A03.1.454.CMB.1.raw
  modified_base (236)..(236): a, c, t, g, unknown or other
  misc_feature (236)..(236): n is a, c, g, or t
  modified_base (348)..(348): a, c, t, g, unknown or other
  misc_feature (348)..(348): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgancagtggtggttactactggagttggattccgccagcacccgagggaagggccctggagtggattgggtacatctattacagtgagaggacccactacaacccgtcctcaagngtcgacttaccatactcaagtacgacacgtctaagaaccagttctacctagaacgtctagagctctgtcgactgccgtcggacacggtccgtgttacttaccgtggttcgcgtaacgacgtacgttcccttaacgtacgttacgggttcggggtaagttttaacgtttaagttaaacgtttagttacccggtacgtttacgttttttacggtaacgttacgttttacggggggacccttaaaggggtaccttaaacggg

SEQ ID NO: 22136 - DNA, 617 bp, Homo sapiens
  misc_feature: GYAE6OF02IV7V6.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgagcagtggtggttactactggagttggatccgccagccacccgagggaaggcctggagtggattgggacatctattacgaggtgggacgacccataccaaccgtcctacaagcgtcgacttaccatactcagtacgacacgtactaacgaacctagttcctacccgtagaacgtctagacgtcttcgtagtcgacgttcgccggacggaccacgggccgtgttaacgtttacgtcggtgaccgaagtacgtacgttacctttaacgtagtttcggggttacggggtattttaagtttaagttaaactttacgtaccggtcgtttacgtttttagtacgtttacggtttacggggacccgtaaagggtacgtaagtttaccggg

SEQ ID NO: 22137 - DNA, 518 bp, Homo sapiens
  misc_feature: GYAE6OF02GARU1.35.3.A03.1.454.CMB.1.raw
  modified_base (488)..(488): a, c, t, g, unknown or other
  misc_feature (488)..(488): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccatgtccctcacctgcactgtctctggtggctccatgagcagtggtggttactactggagttggatccgccagcacccagggaagggcctggagtggattgggtacatctattacagtgggaggacccactacaacccgtcctcaagagtcgacttaccatatcagtagacacgtctaaagaaccagttctccctgaagctgagctctgtgactgccgcggacacggccgtgtattactgtgcgagagatccttatatggttcgggagttagttaataattatcgtcgtnttttgattagtttgggcctaagggactaag

SEQ ID NO: 22138 - DNA, 510 bp, Homo sapiens
  misc_feature: GYAE6OF02G91CL.35.3.A03.1.454.CMB.1.raw
  modified_base (404)..(404): a, c, t, g, unknown or other
  misc_feature (404)..(404): n is a, c, g, or t
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctgggcccagtctgtggtgactcagccaccctcaacgtctgggacccccgggcagagggtcaccatctcttgttctggaagcagctccaacatcggaagtaatactgtaaactggtaccagcagctcccaggaacggcccccaaactcctcatctataataataatcagcggccctcaggacgtccctgaccgattctctggctccaagtctggcgcctcacgccctccctggccatcagtgggctccagtctgagntgaggctgtattatcactgtcgcagtcagtgggatgacagccgtagagtgggtgggttgttgggcggaggaccagcgtcgaccgtcgtaggtccacgccgagtccg

SEQ ID NO: 22139 - DNA, 577 bp, Homo sapiens
  misc_feature: GYAE6OF02GDW7N.35.3.A03.1.454.CMB.1.raw
  modified_base (187)..(187): a, c, t, g, unknown or other
  misc_feature (187)..(187): n is a, c, g, or t
  modified_base (414)..(414): a, c, t, g, unknown or other
  misc_feature (414)..(414): n is a, c, g, or t
tcagtacagatcgtcacgaccggtgctcgatttagagagcgtcacagggggggtagagaagacaggactcaggacaatctccagcatggccagcttccctctcctcctcaccctcctcactcactgtgcagggtcctgggcccagtctgtggtgactcagccaccctcaacgtctgggacccccggnagagggtcaccatctcttgtctggaagcagctccaacatcggaagtatactgtaaactggtaccagcagctcccaggaaccggcccccaaactcctcatctaataataataatcagccggcccctcgaggacgtcccctagacccgtatttcctctgggccttaccaagttcctggcctcctcgacgcccttccctgggcccaatcaggtcggctccgagtctgagntgagctagattactcactgtgcagcagtgggatcgacagcctagaagtgggtggttgtttggacggtagggaccaaggtcgtaggacccggttccgtagggtaccaacggtcccgaagggtcctaccggccccccgttagggtcctaccgttccgttacccgg

SEQ ID NO: 22140 - DNA, 542 bp, Homo sapiens
  misc_feature: GYAE6OF02JXB1Q.35.3.A03.1.454.CMB.1.raw
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctgggcccagtctgtggtgactcagccaccctcaacgtctcgggacccccggcagagggtcaccatctcttgttctggaagcagctccaacatcggaataatactgtaaactggtaccagcagcctccaggaccgccccaaatccnatctataataatatcagccgcctnaggactccngacctattcnctgctccaagtctgcacctnacgcctccnggccatcagtcggctcgagtctgagtntgagctagattanctacgtgtgcagctagtcgggatcgacngccgtaagacgtggggttaggttggtttcggggacgggtaacggtaccgtaacggtaccgtacggtacccgttaccggtacgggtaccgacggtacccgtacggtcccg

SEQ ID NO: 22141 - DNA, 797 bp, Homo sapiens
  misc_feature: GYAE6OF02J1Q0X.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtccgggcccaggactggtagaagccttcacagaccctgtccctcacctgcactgtctctggtgcttccatcgagcagtggtggttactactggtagttggacttccgcaggccacccgaggggaacggccgtgggagtggagttggggttacagttcttagttaacagggttagggacggaacccactaccgaaaccccgttcccgtagaacggtcgttaccgtaccttaaccgtataaacgtcaaacggttaacgaaaccgtaccggtttaacctaaacggtaaccctaacggttttaccctacccccgttaaggtaaaccggtccgtttacggaaaccgggtccctttaccggttaacggttccggtaaccgtttcgggaccccggttaccgggacccgtaccgggtacccgttgggttaaactttccggttacgttcggacgtaacgtaggtacctttacccgtttaagtacgttacggggttttaccgggtaaggtttttaacgttaacggtttaaactttaccggttaaccggttcccggttttaacggtttttttaggaacggttttttaacgggtttaccgggggaaccctttaaaacgggggtaccttaagggtttacccggg

SEQ ID NO: 22142 - DNA, 589 bp, Homo sapiens
  misc_feature: GYAE6OF02I72N9.35.3.A03.1.454.CMB.1.raw
  modified_base (201)..(201): a, c, t, g, unknown or other
  misc_feature (201)..(201): n is a, c, g, or t
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctgggcccagtctgtggtgactcagccaccctcaacgtctcgggacccccgggnagagggtcaccatctcttgttctggaagcagctccaacatcggaataatactgtaaactggtaccagcagctcccgaggaaccggcccccaaactcctcatctaataataataatcagccgcctcaggacgtccctgaccgattctcgtgcctaccaagtcgtcggccgcctcacgtccctccgtcggcctatccgaggtcgggccttccgagtcctaggagtacgtgaggccttagtattactctacgtagtcgcagtactagtgggtatacgacgacgtaccgtaggacggttggggttgggttggtttcggggacgggacgggtaccgaaggtccgtacggtacccggttaccgtacggtccgaccggtacccgaacggtcccgg

SEQ ID NO: 22143 - DNA, 631 bp, Homo sapiens
  misc_feature: GYAE6OF02IXK83.35.3.A03.1.454.CMB.1.raw
  modified_base (467)..(467): a, c, t, g, unknown or other
  misc_feature (467)..(467): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccagggactgggtgaagccctttcaccagacccctgtccctcacctgcactgtctctggtcgctccatgagcagtggtggttactactggagttggactccggccacgcaacccgagggaagggcctgggagtggaattgggtacattctagttacgaggtcgggacggacccacctacgaaccccgtcctcaagacgttcgaactttaccatactcagtacgacacgtacaacgacctacgttctaccgtgaagtctagacgtctcgtagtcgaccgtcggacccgcggaaccnccgggtcgtagttaacgttacgtgtacgtacgagtaacgtacttccgttaacgtaggttacgggttacgggtagtttagtttaataacgtttacgtcggttccgttagtttttaggtaacgttttacgggttagggtaaccgtaacgggtactaggttaccggg

SEQ ID NO: 22144 - DNA, 628 bp, Homo sapiens
  misc_feature: GYAE6OF02FXSY4.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtgttactacgtggagttggatccgcagccacccgaggggacggcctgggagtggagttgggtacatctattacgaggtgggacggacccactaccaacccgtcctacgaagacgtcgaacttaccatactacaagtacgacacgtactaagaacctacgtttacctaccgtagaacgctagacgctcgtgtcgactcggccgcggaccgaccgggtccgtagttacttacgtgttcgacgaagtacgtacttccgttaacgttaggttacggggttaccggggttagtttaacgtttaagttaagtttaacgttccggtcgtttacgttttaggtacgtttacgggttttacggggaaccgtaaacgggtaactaggttaccggg

SEQ ID NO: 22145 - DNA, 542 bp, Homo sapiens
  misc_feature: GYAE6OF02HFLNX.35.3.A03.1.454.CMB.1.raw
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactactggagttggatccgccagcacccagggaagggcctgggagtggattgggtacatctattacagtgggaggacccactacaacccgtccctcaagacgtcgactttaccatatcagtagacacgtactaagaaccagttcctcctgaagctganctctgtgactgccgcggacncggcgtgtacttactgtcgcgagagactccttactagtcgggttcggggtagtttattagtaattacttcgtcgtcttttagattagtttcggggacctaagggtactagttcggg

SEQ ID NO: 22146 - DNA, 616 bp, Homo sapiens
  misc_feature: GYAE6OF02J13OB.35.3.A03.1.454.CMB.1.raw
  modified_base (128)..(128): a, c, t, g, unknown or other
  misc_feature (128)..(128): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
  modified_base (372)..(372): a, c, t, g, unknown or other
  misc_feature (372)..(372): n is a, c, g, or t
  modified_base (506)..(506): a, c, t, g, unknown or other
  misc_feature (506)..(506): n is a, c, g, or t
  modified_base (576)..(576): a, c, t, g, unknown or other
  misc_feature (576)..(576): n is a, c, g, or t
tcagtacagatcgtcacgaccggtgctcgatttagagagcgtcacagggggtaggaggaagacaggactcaggacaatctccagcatggccagcttccctctcctcctcaccctcctcactcactgtncagggtcctgggcccagtctgtggtgactcagccaccctcaacgtcctcgggacccccgggcagacgggtcaccgatcctcttgttctggaagccagctccaacgntcggaagtatactgtaaacnggtaccagcanctccaggaacggccccaaactccncactctataataataactcacgcggacctcaggcgttaccctgaacccgtattcctcgtcggcctcgaagtctcggccgcctnacgtccctccctggccctatccaggtcgggtcctccgagtcctggacgtactggaacggcttggaattactcgaccttgtcgccaggtccagtgggatagacgagtccctagaacggtggggttacggggtttnttcggggacggaggggacctagggtacgcggttaccgcggttaccggtgaccgggtcccaaacggttccncccggtaccccgttcccggtcctacgttccgttaccccgg

SEQ ID NO: 22147 - DNA, 742 bp, Homo sapiens
  misc_feature: GYAE6OF02I81WI.35.3.A03.1.454.CMB.1.raw
  modified_base (240)..(240): a, c, t, g, unknown or other
  misc_feature (240)..(240): n is a, c, g, or t
  modified_base (297)..(297): a, c, t, g, unknown or other
  misc_feature (297)..(297): n is a, c, g, or t
tcagtacagatcgtcacgaccggtgctcgatttagagagcgtcacaggggcagcttcagctgtgggtagagaagacaggactcaggacaatctccagcatggccagcttccctctcctcctcaccctcctcactcactgtgcagggtcctgggcccagtctgtggtgactcagccaccctcaacgtctcgggacccccggcaggagggtcaccatctcttgttctggaagcagctcaacntcggaataatactgtaaactggtaccagcagctccgaggaaccggccccaaactccncactctaataataataatcgacgccggtccctacgaggtacgtccctaggacccgtaatttccgtacgtcgggtccttaaccgaagttccgttacgggcccgtaccccgtacgaccggtaccccttccccgtcgggacccctacgttcccgtagggttccggggtccctacccgtaacggttccgttacggaacgggtacgtacgggtacgggtctttaggtaacgttttaaccgtccgtaccgttacggttaccggaccgtaacggccgtaacgggttacggggaacttacggaacccgtacggttacccgtaaggggttaacgttcggggggtttgggttcgggttttacggggaccggggtaacgggaacccgtaaggttccgttaaccggtacccggttaccggttaccgggtaccgtaacccgggtccccgtaaccgggg

SEQ ID NO: 22148 - DNA, 763 bp, Homo sapiens
  misc_feature: GYAE6OF02J28PY.35.3.A03.1.454.CMB.1.raw
  modified_base (200)..(200): a, c, t, g, unknown or other
  misc_feature (200)..(200): n is a, c, g, or t
  modified_base (713)..(713): a, c, t, g, unknown or other
  misc_feature (713)..(713): n is a, c, g, or t
  modified_base (760)..(760): a, c, t, g, unknown or other
  misc_feature (760)..(760): n is a, c, g, or t
tcagtacagatcgtcacgaccggtgctcgatttagagagcgtcacagaccctgtccctcacctgcactgtctctggtggctccatgagcagtggtggttactactggagttggatccgccagcacccgagggaagggcctggagtggattgggtacatctattacaggtgggagacccactaccaacccgtcctacaagngtcgacttaccatatcagtagacacgtactaagaacctagttcctcctgaagctgacgtctctgtcgactcgccggcggaccaccgggccgtgtattaccgtggtcgccggaggacgtcttacctttactagttcggggtttacgggggtaattttattaagtaaatttcgtccggtacgtttcgttttggaactttacggtttcggggggaacctaaagggggtaacctaaaggtttcggtaccctaaacccgggttcttaccgtttccgaacggtacccccgttaccaaccccgggaaaccgggggtcccctaaggtttccccgggttacccctttccccccggtgggtcccgtcccccttcggtcccgtacccggtaacgggctacccgtaaccccgttcgggaacgtcgaccacggacgggtcccggtacccgtggggtacctcggcccgttaggggtacccaaagggtcccttacttacccgacgtacgtttccgtaacggtaccggnggtaccgggccgggtacgttacgggaccggtaacgggccacggttanggc

SEQ ID NO: 22149 - DNA, 690 bp, Homo sapiens
  misc_feature: GYAE6OF02J25FL.35.3.A03.1.454.CMB.1.raw
  modified_base (298)..(298): a, c, t, g, unknown or other
  misc_feature (298)..(298): n is a, c, g, or t
  modified_base (545)..(545): a, c, t, g, unknown or other
  misc_feature (545)..(545): n is a, c, g, or t
  modified_base (561)..(561): a, c, t, g, unknown or other
  misc_feature (561)..(561): n is a, c, g, or t
  modified_base (682)..(682): a, c, t, g, unknown or other
  misc_feature (682)..(682): n is a, c, g, or t
  modified_base (688)..(688): a, c, t, g, unknown or other
  misc_feature (688)..(688): n is a, c, g, or t
tcagtacagatcgtcacgaccggtgctcgatttagagagcgtcacagaccctgtccctcacctgcactgtctctggtggctccatgagcagtggtggttactactggagttggatccgccagcacccgaggggaagggcctggagtggattgggtacatctattacaggtgggacggacccactaccaaccccgtccctacaagacgtccgacttaccatatcagtagacacgtctaacgaacctagttcctccctggaacgctgagccttcgtgtacgactcgcccggacgggaccnccgggccgtgttaattacgtgtgcggagacgacttccttagtagttcgggttacggggtatttacttaagttaacttcgtacggtcgtttcgttttaggtaacttacgggtttacgggggaccgaaagggtactaagttcggtacctaccgttcttccttaccgacgtccctaccaaccggtaacggccctaggttccgttccccgttccccgtcggcccgttaccgtcgtcccgacgacgggtacncccgtaacccgcgacncgccgaccgcgggtccgcccggtgggaccttccgaccgttcgggaaccctacgggtaacccttccgttacgaccgtacgttccgtaacgtcgtaggcccggttcggcgtcggacgccggtnacgtangc

SEQ ID NO: 22150 - DNA, 767 bp, Homo sapiens
  misc_feature: GYAE6OF02IITS4.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggccaggactggtgaagccttcacgagaccctgtccctcacctgcactgtctcgtggtggctcatgagcaggtggtgttactacgtggagttggactccgcagccacccgaagggaacgggtcctagggaggtagggtacgttggggtactactacgtattaacgaggtcgggaacggacccctactaaccgaacccgtccctacgaagtacgtccgtaaccttaaccatacttacgaagttaacgacctaacggtacgtaaaccgaaaccgttacgttacctacccttaggaaacgtcgttacggacgtaccgttacgttcgggttacgtaaccggttcggacccggacccggggtaaccggtaacccgggttcccggtttaacggtttaacgtttaaccgtcgggttacggaaccgggttaagacggtttaacctttacccgtttaaacgttacggtttacgggggttttaacggggttacgtttttaaacgttttaagttaaacgttttaacgtacggttaacgtttccgttttttaaggtacgtttacgggttttaccggggaaccgtaaagggtaccgttaaggttacccggg

SEQ ID NO: 22151 - DNA, 539 bp, Homo sapiens
  misc_feature: GYAE6OF02IPAC5.35.3.A03.1.454.CMB.1.raw
  modified_base (404)..(404): a, c, t, g, unknown or other
  misc_feature (404)..(404): n is a, c, g, or t
  modified_base (494)..(494): a, c, t, g, unknown or other
  misc_feature (494)..(494): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgagcagtggtggttactactggagttggatccgccagcacccagggaaggcctggagtggattggggtacatctattaccagtgggagacccactacaacccgtcctcaagagtccgaactttaccatatcaagtacgacacgtactaagaacctagttctaccctgaaanctgagcttctgtagactcgccgcggacacggccgtgttacttacgtgtgcgagagtatcctatagtggttcgggatttattataatttancgtcgtcgttttgagttagtttgggacctaagggtacaagttcgg

SEQ ID NO: 22152 - DNA, 626 bp, Homo sapiens
  misc_feature: GYAE6OF02IF81L.35.3.A03.1.454.CMB.1.raw
  modified_base (208)..(208): a, c, t, g, unknown or other
  misc_feature (208)..(208): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctnacctgcactgtctctggtgctcatgagcagtggtggttactacgtggtagttggactccgccagccacccgaaggggaacggcctagggacgtggtagttgggtacattctaattacgaggtgggacgaccctactaccgaacccgtcctacaagtcgtacgacttaccatactcaagtacaacacgtactaaagaaccctagtttcctaccctagaacgtctagacgtctcgtagtagacgtacgcccgacggtaccgacgggtccgttagtactttacgaggtacgacggaagtacgtacttccgttaacgtaggttagggttacggggtaacttttaagttaacgttaagttacgtacggtccgtttattttagtagtttagggtttacgggaaccgtaagggactagttaccgg

SEQ ID NO: 22153 - DNA, 719 bp, Homo sapiens
  misc_feature: GYAE6OF02FNIL4.35.3.A03.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (355)..(355): a, c, t, g, unknown or other
  misc_feature (355)..(355): n is a, c, g, or t
tcagtacagatcgtcacgaccggtgctcgatttagagagcgtcacagggtctgtgaaggcttcaccagtcctggacctcctgtgcaagaacatgaaacacctgtgttcttcctcctgctggtggcagctcccagactgggtcctgtcccaggtcgcagctgcgaggagtcgggccaggactgggtgaagtcctttcgacagaccctgtccctcacctggcactgtcctcngtggctccatgancagtggtgttctactggacgtggatccgccagcacccgagggaacggcctggagtggattgggaccagtcgtatacgagtcgggaggtaccccataaccgaccttcccgtanaacgagtcgtaacttaccgactatacaaggtacgtaacctacggttactaaaggaaacccgtagtttacctaccccgtagtaaacggtcttaggtaacgtcgttcgtaggtcgtaacgttcggccccggtacgggaaccgtaccgggtacccggttacgttaacgttttaccggaggtttcgggaaccggttaggaaccggtaccttcccttttaaaggccgtttaagggggtttccgggttaacgtttaacggttaaggttttaaacttaccgttaccggtcggtttaccgttttttaccggaagttttaccgggttttccggggggtacctaaacccggggggttaacgtaaccgtttcggg

SEQ ID NO: 22154 - DNA, 655 bp, Homo sapiens
  misc_feature: GYAE6OF02IFYG2.35.3.A03.1.454.CMB.1.raw
  modified_base (479)..(479): a, c, t, g, unknown or other
  misc_feature (479)..(479): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgacgaggagtcgggacccaggactggtcgaacgccttcacacgaccctcgtaccctcacctgcacttgtctcgtggtcgctccagtgacgctaggttggtagttacgtacgtgggtagttggactccgacgtacgaccgacccggaaggggacggccgtggacggtggtagttcggtaactagtcgttaacgttacgagggttacgggaacggaccccgtaacgtaacccgtacccgtccctaggaagtacgtaccgttactacaatactacgaagtacaacgtaccgtacgtaacgaccgtagtttccaccgtagaacncgtagacgtcttacgtgtacgacgtcggaccgacggacctacgggtcgtagttacttacggtgtacgacggtagtacgtaccttccgttagtacggtgggttacggtattagttaacgtagttcctcgtcgttttacgttgtacgttacgggttcggaaccgtaggacgtagttcg

SEQ ID NO: 22155 - DNA, 735 bp, Homo sapiens
  misc_feature: GYAE6OF02GXTE7.35.3.A03.1.454.CMB.1.raw
  modified_base (203)..(203): a, c, t, g, unknown or other
  misc_feature (203)..(203): n is a, c, g, or t
tcagtacagatcgtcacgaccggtgctcgatttagagagcgtcacagggggagcttcagctgtgggtagagaagacaggactcaggacaatctccagcatggccagcttccctctcctcctcaccctcctcactcactgtgcagggtcctcgggcccagtctgtggtcgactcagccaccctcaacgtcgtcgggaccccggnaggagggtcaccatctcgttgttctaggaagcacgcctaccaactagtacggaaagtaactactagtaaactcggtaaccagacacgtcctacccgaaggaacccgacccccaaactccctacactactaataaacgtaaactaacacgtacgccggtaccctagaacggtccgtccctacgaccgtattcctcgtcgccttaccgaaggttcgcggcctccctacgacgtcccttaccgcgggaccctagtccgtacggttcggtacctaccgtaggttccgtagggtaaggtagttcgggacggtacttaggtactttaacgtccgtaacgttcggtacgacgtacggtccgtaaggtacgggtaacgtcgtaaccgaccggttacgtaacggttaacgggttgggggttacggggtttcgggtttacgggggaaccggggtaaccgggtaacccgtaacggtccggttaccgggtaacccggttaccgggtacggttaaccgaaccggtacccggtaacggtccccggg

SEQ ID NO: 22156 - DNA, 588 bp, Homo sapiens
  misc_feature: GYAE6OF02GN72L.35.3.A03.1.454.CMB.1.raw
  modified_base (236)..(236): a, c, t, g, unknown or other
  misc_feature (236)..(236): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctctggtgctcatgancagtggtgttactacgtggagttggactccgcagccaccgaggggacggcctgggagtggagttgggtacattctatacgaggtagggacgacccactaccaacccgtccctagaagcgtcgaaccttacatatcagtagtacacgtactaacgacctacgttcctaccctagaacgtctagagctcgtgtgtacgtcgccgacggaccgccggtcgtgttacttccgtgtcgcgagacgtacttccttagtacggttcgggttacgggttagtttaattaagttaatttactccggttcgtttcgtttaggtacttaggtttccggggactaaggggtactaaggttccgg

SEQ ID NO: 22157 - DNA, 628 bp, Homo sapiens
  misc_feature: GYAE6OF02I9U2K.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgagcagtggtggttactactggagttggatccgccagcacccgagggaggctggagtggagttgggacatctattacgagtgggacggacccactaccgaaccccgtcctacaacgagtccgacttaccaatactacagtacgactacgtactaaacgaacctagttaccctaccctagaacgtcgtacgacgtcctcgtgtacgaccgttggacccggccgggaccgaccgggtccgttagttacttacgtggtacggacgaagtacgtactttaccgttacttagttcgggtttacgggttatttaagttaacgttaagtttacgttacggtcgttacgtttttagaacgtttagggtttaccgggaccgtaaaggggtacctaaggttccgg

SEQ ID NO: 22158 - DNA, 567 bp, Homo sapiens
  misc_feature: GYAE6OF02GQNQN.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctccatgagcagtggtggttactacgtggagttggatccgccagcacccgagggaacggcctggagtggagttgggtacatctagttacaggtgggacggacccactaaccaacccgtcctacaagacgtacgacttacatatcagtagactacgtactaaacgaaccagttacctcctagaacgctgacgtctcgtgtagacttgccgcggacacggcgtagtacttcgtgtgcgagagacttaccttactagttgggttacgggtagtttattataacgttattcgtcgttacgttttagacgttaggtttcgggtacctaacgggtacaagttccgg

SEQ ID NO: 22159 - DNA, 946 bp, Homo sapiens
  misc_feature: GYAE6OF02G7YW8.35.3.A03.1.454.CMB.1.raw
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctccagatggtcctgtcccaggtgcagctgcaggagccgggcccaggactggngaacgccttnacagaccctgtccctcacctgcactgtctcgtggtgctccagtgagcaggttggtggttactacgtgggagtttcggactccgcacggccaacccggaggggaaacggcccgtagggtaacggtgggtaaggtttcggggtaactaacgttaccgtttaagtttaaccgaggggtacgggggtaaccggaaccccctaacggtttaaaaccccaaacccccggttaccccctaagtaaaacgggtaccgggttaacccggtaaacccttttaaacccgaaaggtttaatacccgtaaagttaaacggaccttaaaccggtacctttaaaacggaaccccttaaaggttttcccccttacccggtaaaggtaacggttaccccgttaagggaacgttcccccgttacggttagggttaccgtaaaccttcccgggggaccccgaaccggggtaacccggtaacccggggtccggttttaagtttaaacccgttttaacggggtaaccgtttcgggaaccccgggttaaggtaaaccttccgttttaaacccccggttttaaagttaacgggggttttcccgggggtttaaccgggggggttttaaacgttttttattttaaaaacccgggttttaaaacggtttttcccgaaccggggtttcccggttttaaaccggtttttttaggaacgttttttaacggggttacgggggtaaaccccgtaaagggggttaaacttaaccgtttacccggggg

SEQ ID NO: 22160 - DNA, 591 bp, Homo sapiens
  misc_feature: GYAE6OF02GR2HF.35.3.A03.1.454.CMB.1.raw
  modified_base (202)..(202): a, c, t, g, unknown or other
  misc_feature (202)..(202): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctntcccggtcacctgcactgtctctggtgctcatgagcagtggtggttactactggagttggatccgccagcacccgagggagggcctgggaggtggagttgggtacatctattacaggtgggacggacccactacaacccgtcctcaagagtcgacttaccatatcagtacgacacgtctaaacgaccagttcctccctgaacgctagagtctctggtgtacgtcgcccggcggacaccgggtccgtgttacgttactgtcggcgaggagtacttccttaacttagttggggttacgggtagtttaattaagtttaaatttacgttcggtaccgttcgtttttagaacgtttaggtttaggggtacccgtaaggggtactaggttacggg

SEQ ID NO: 22161 - DNA, 692 bp, Homo sapiens
  misc_feature: GYAE6OF02IN8RO.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcgaggagtcgggcccaggactggtgaagccttcacacgaccctgtccctcacctgctactcgtctctggtcggctcatgagcaggtggttggttactactggtagttggactccgcagccaccgaggggacggccgtggagtgggtagttgggactatctaagttacgaggtgggacggacccacgtaccaacccgtcctacgaagtacgtacgactttaccattactcagtacgactacgtactaacgacctagttccctaccgtagaacgtctacggtacgtacgtcgttggtacgtaccgttcggccccggtacggaaccgtaaccgggtcccgtagttacgttaccgtggtcgacgtaagtagtacgtttaccgtttaaacgttaaggttcggggtttaacggggtagttttaacgtttaacgtttaaaggttttaacctccgggttaggttttaccgttttttaggaacgttttaacggggttttccgggggaaacccgttaaaggggttaccaagggtttcccggg

SEQ ID NO: 22162 - DNA, 540 bp, Homo sapiens
  misc_feature: GYAE6OF02G0K28.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactactggagttggatccgccagcacccagggaagggcctggagtggattgggtacatctattacaggtggggggacccactacaacccgtccctcaagagtcgacttaccatatcagtacgacacgtctaagaacctagttctccctgaagctgagctctgtcgctgccgcggacacggccgtgtattactgtgcgagagacttccttacgtatgggttcgggagtttagttatagttatcgtcgttcttttagattagtttcggggacctaagggactagtggttacccg

SEQ ID NO: 22163 - DNA, 697 bp, Homo sapiens
  misc_feature: GYAE6OF02GMDBE.35.3.A03.1.454.CMB.1.raw
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgccctcacctgcactgtcctcgtggtcggctccgagtcgagcaggttggtggttaactagttgggtagttggacttccggctaggccaccggaggggaacggtcctgggatgggattggggtacagtctaatacgacgggtgggaacgacccataaccgaaccccnccgtanaagtcgcgtaacttaccagttnacgagttacgaactacggtacctaaaagacccgtagttaccgtacccgtaggaaacgtcgtacggaactcgttaccgtgtaccggtaacgttccgacccggtacggaaaccctcgggtaccgttagtacgtttaaccgtgttacggaccgaagtaggtacttacccgttaagttaacgttcggggtttaccggggtagtttttaagttaaccgtttaaggttaacgttccggtacgtttaccgtttttaggaacgttttacggttgggggtaaccctttaacggggaacttaaggtaccggg

SEQ ID NO: 22164 - DNA, 677 bp, Homo sapiens
  misc_feature: GYAE6OF02GIW24.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtcggctccatgagcagtggtggttactactggagttggatccgcagcacccgagggaaggcctggagtggagttggggtacatctattacgaggtgggacggacccactaccaaccccgtcctacgaagagtccgacttaccatatacagtaagacacggtactaaacgaacctagtttacctcctagtaacgcgtagacgcttcgtgtcgacttcggccgtacggacaccgggtccgtagttacttacgtggtcgacggtaacggagttaccttaccgttaacgttaggttaccggggttaggggtttaacgttttaagtttaacggttttaaaactttacggtttacccgggtaccggtttttacgttttttacgggtaaagtttttacggggtttttacccgggggtaacccgtaaaacgggggtttacctaagggttttaccccgggg

SEQ ID NO: 22165 - DNA, 582 bp, Homo sapiens
  misc_feature: GYAE6OF02HP2YO.35.3.A03.1.454.CMB.1.raw
  modified_base (343)..(343): a, c, t, g, unknown or other
  misc_feature (343)..(343): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgctcatgagcagtggtggttactactggagttggatccgcagcacccgagggaaggcctgggagtggagttgggtacatctattacaggtgggagacccactacaacccgtccctanaagagtcgacttaccatatcagtagaccacgtctaaagaaccagttcctccctagaacgtctagacgtctcgtgtcgactcggccgcggaccaccggtccggtagttacttacgtggtacgcgaggagacttccttactaagttcgggttacggggtattttagttaagttaattacgtcggtcgtttacgttttagaagtttaggtttcggggaccgttaaagggtctaaggttcggg

SEQ ID NO: 22166 - DNA, 629 bp, Homo sapiens
  misc_feature: GYAE6OF02FNQBW.35.3.A03.1.454.CMB.1.raw
  modified_base (194)..(194): a, c, t, g, unknown or other
  misc_feature (194)..(194): n is a, c, g, or t
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
tcagtacagatcgtcacgaccggtgctcgatttagagagcgtcacagaccctgtccctcacctgcactgtctctggtggctccatgagcagtggtggttactactggagttggatccgccagcacccagggaagggcctggagtggattgggtacatctattacagtgggaggacccactacaacccgtccctnaagagtcgacttaccatatcagtagacacgtctaagaaccagttctcctgaagctgagctctgtgactgccgcggacacggcgtgtattactgtgcgagagatccttactagttggtcggggtattattataattntcgcgttnttttagattagtttggggacctaaagggactaagtcggtactaccgtctaccttcgagtccctaccgaaccgaacgggcccctagtccggttcccttcccccgtggccctccctcgcctccgaggacgtccaccgtccgagacgtccaacgacggccggtcccgtaggggtctccggtccggttaggtacccgaaacgggtccttaaccgttacccgagtaccttacgtacggtacctcgggtaccgggtccggggtcttacggggaccgaacgggtcctacgtagtaggc

SEQ ID NO: 22167 - DNA, 796 bp, Homo sapiens
  misc_feature: GYAE6OF02GKPVQ.35.3.A03.1.454.CMB.1.raw
  modified_base (200)..(200): a, c, t, g, unknown or other
  misc_feature (200)..(200): n is a, c, g, or t
  modified_base (384)..(384): a, c, t, g, unknown or other
  misc_feature (384)..(384): n is a, c, g, or t
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctgggcccagtctgtggtgactcagccaccctcaacgtctcgggacccccggnaggaggtcaccatctcttgttctggaagcagctaccaacatacggaagtaatactagtaaactggtaccagcagcctacccgaaggaacccggaccccccaaacgtcctacacttactaataaactaactaactcaacggcccggtaccctacgaacgggtactccccgtagaccgtatttccncgtcggcctaccgaagttcgtcggccgtccctacgacccgtccccttacccgcgggaccctagtccgacggttcgggtaccctaccggtaacgttccggtaggaacgggttacgtacgggaacggtcgttagtaacgtttacgtaccgtaacgttcggtacggaccgtaggaccgtacgggttagggaacgtttaaccgggaaccgttaaccgggttacccgttaaaggggttaacggggttttccgggggggtttaggggtttacggggttttacccggggggtaaccggggtaaaccgggggtaacccgtaaacccgggttcccgggttaacccgggtaccccggtttaacccggggttaaccgggacccggttaacccgggtaacccccggttaacggggtccccccgg

SEQ ID NO: 22168 - DNA, 748 bp, Homo sapiens
  misc_feature: GYAE6OF02HHPUM.35.3.A03.1.454.CMB.1.raw
  modified_base (154)..(154): a, c, t, g, unknown or other
  misc_feature (154)..(154): n is a, c, g, or t
  modified_base (214)..(214): a, c, t, g, unknown or other
  misc_feature (214)..(214): n is a, c, g, or t
  modified_base (633)..(633): a, c, t, g, unknown or other
  misc_feature (633)..(633): n is a, c, g, or t
  modified_base (697)..(697): a, c, t, g, unknown or other
  misc_feature (697)..(697): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtncagctgcaggagtcggccaggactggtagagccttcacagaccctgtccctcacctgacnctcgtctcgtggtcgcctaccagtcgacgacgtaggtggttacgttaccgtagtggtagtttggaacttccggccacgccaaccccggagggggaaccggcccgtgggaggttagggagtttacggggtactacgttacgtaactttaaccggagggttacggggaaccggacccccgtaacgtaaccccgtaaaccccgtccccgttaagaaacggtacggttacccgtaaccgtttaccaattaacgtcccgtaaagttaacgaaccgtaacccgttaacgtaaacggtaaccctacgtttcccgtaaccgtttcggaaaaccgtcgttagaccggttcttcggtagtacgtacgtccgggaccgccggaaaccgtccgggtacctacggttaacttacgttgtacggaccgttaanacggtactttaccctacgttagggttccgggtttagggtatttacttacggtaattacggttcnccgttttgttagttacgtacggttacgggacgtaacggtagtagttaccgg

SEQ ID NO: 22169 - DNA, 690 bp, Homo sapiens
  misc_feature: GYAE6OF02J1MQW.35.3.A03.1.454.CMB.1.raw
  modified_base (267)..(267): a, c, t, g, unknown or other
  misc_feature (267)..(267): n is a, c, g, or t
  modified_base (408)..(408): a, c, t, g, unknown or other
  misc_feature (408)..(408): n is a, c, g, or t
  modified_base (435)..(435): a, c, t, g, unknown or other
  misc_feature (435)..(435): n is a, c, g, or t
  modified_base (454)..(454): a, c, t, g, unknown or other
  misc_feature (454)..(454): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
tcagtacagatcgtcacgaccggtgctcgatttagagagcgtcacagggtctgtgaaggcttcaccagtcctggacctcctgtgcaagaacatgaaacacctggtggttcttcctcctgctggtggcagctcccagatgggtcctgtcccaggtgcagctgcaggagtcgggcccaggactggtgaagccttcacagaccctgtccctcgacctgctactcgtctctgggtcgcctccagtgacggtctacgtggttaggtttaacncgtgggtaagtttcggaacttcccgctagacccacccgtagggggaagggtccctaggggattacgggtattcggggtaacatttccgtaagttacgaaggtcggggaaaccggacccctaacttaccgaacccgttcccngaaacgtcgtacgtacttaccgatacncgaagtacgaactaccgtntaaacgaacctgttaccnccgttaaggaacnccgtagtacgcgttactaggtcgaacgtcgacccggacggacaacccgggtcgttagtttaaccttcgacggttgaccgtaagacggttaacctaccgttagtacgttaggggttaccgggtattacgttagtaacgtttggtacgtaccgttttgtttaacgtagtttcgttacggggacctaacggggtacctagttaccggg

SEQ ID NO: 22170 - DNA, 709 bp, Homo sapiens
  misc_feature: GYAE6OF02JUCD4.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtgcagctcccagatgggtcctgtcccaggtgcagctgcaggagtcgggcccaggactggtgaacgccttcacacgaccctgtcccctcacctgctactcgtctcgtggtcgcctccatggacgctaggttggttacggtttaactacggtggtaggttcggactcccgcgacgccaccggaggggacggccgtgggacgtggtagttacgggtacctatcgttagttacgaggtacgggaacgtaacccctaactaacccgtacccgtaccctagaacgtacggtacctaaccttacactacgtactaagtaacactaaccgtactaaacgtaaccctagtttaccctaccgtagtaacgtccgtagaaccgttctacgtacggtacgaccgtaccggtaccgaccgggacctaccgggtaccgtttgtaaccttcggtcgcggtacgacggtattaccttccgttaacgtggttaccgggttaacgggttatttaacgttaacgtacgtttacggtcgttccggttattttaccgtacggtttaaggtttaccgggaaccgttaagggttaacctaggttacccgg

SEQ ID NO: 22171 - DNA, 787 bp, Homo sapiens
  misc_feature: GYAE6OF02I3PFL.35.3.A03.1.454.CMB.1.raw
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctgggcccagtctgtggtgactcacgccaccctcaacgtcgtcgggacccccgggcaggagggtccaccatctcttgttctggaagggcacgcctaccaacagtacggaagtaatactagtaaactggtaccagcagcctaccccgacggaaccgacccccaaacttccctacacttactaataaataaacttaatccgacggcccggtcccctacgaacgggtaccgttccccgtagtaaccccgtatttcctccgtcgggtaccttaccgtaacggttcgtcggccgtaccctcgacccgtccccttcccgtacgggcctacgtccgacgggttaccgggtcctaccgtacggttacgtacgggaacggtacggtacgggaacggttccgttaagttactttacgtaccgtaccggtttagtaccggtacgtacggtacggtaaagggttcggggtaagttacggaacccgtaacgggttacccgttaacgggtaagggtttggggggtaggggtttttacggggttacgggggaaccggggtaaccgggaaacggtaaccgggttccggttaacccgggtacccggttacggtaacccgggttccggaaccgggtaccccggtacggttacccccgg

SEQ ID NO: 22172 - DNA, 669 bp, Homo sapiens
  misc_feature: GYAE6OF02F427W.35.3.A03.1.454.CMB.1.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
tcagtacagatcgtcacgaccggtgctcgatttagagagcgtcacaggggtgggtagagaagacaggactccaggacgaatctccgaacgcatggccagcttccctctcctctcaccctcctcactcactgtgcgaggtcctggcccagtctgtggtgactcacgccaccctctaacgtctcgggaccccgggcaggaggtccaccatctcttgttctggaancagtctaccgaacntacgaagttaatactagtaaaactggtaaccagacaacgcctcccgaacggaaccggacccccctaaaacgtccccttcaacttaccttaataaactaataactcctaagccggacccctacgaacgggacgttacccgacgtaaccgtactttccgtacgtacggtaccttaccgtaaacggtcgtcgggtaccgccttacgaacggtccccttccgtacggacctaacttccgaaggtcgggtacctccgagtcgtaggacgtaacgtggaacggtcttagactttaagcctaagttgacgctaagccaggttacggacttggacacgtccgtaagtaagtggggttcgtaggttggaccggtagactagcgtagtacccggtatacgggtcagacccgtagtcctaccggccccttggacctcgtcccg

SEQ ID NO: 22173 - DNA, 728 bp, Homo sapiens
  misc_feature: GYAE6OF02JI4AS.35.3.A03.1.454.CMB.1.raw
  modified_base (193)..(193): a, c, t, g, unknown or other
  misc_feature (193)..(193): n is a, c, g, or t
tcagtacagatcgtcacgaccggtgctcgatttagagagcgtcacaggggggggtagagaagacaggactcaggacaatctccagcatggccagcttccctctcctcctcaccctcctcactcactgtgcagggtcctgggcccagtctggtggtgactcacgccaccctcaacgtcgtcggggacccccggnaggagggtcaccatctcttgtctggagcagctaccaacagtcggaagtatactgtaaactggtaccagcagcctcccgaagggaaccgacccccaaatccgtcacttactaataataattaactcgacggccgtccctagacgggacgtcccgtagaccgtacttctcgtacggccttacgacgttcgtcggcctcccttagaccgtcccttacccgtgggaccctacgttaccgtaacggttccggggaccctttacccgagggttcctacgggaacgggtagtacgggtaccgggtacgttacgtaacgtttaacgtaccgtaaccgttggtacgaccggtacgtaccgtacggtagggtaacacgggtaacgacggtacgtacggtaaggttcgggggttagggttcgggtttcggggacgggtaaccgggacgtacggtcgtaccgggtaccggtccggtaggacgtaacccggaccggtacggtaccgtacccggttcccggtacggtacctacccgttccgttccccgg

SEQ ID NO: 22174 - DNA, 657 bp, Homo sapiens
  misc_feature: GYAE6OF02JH6RY.35.3.A03.1.454.CMB.1.raw
  modified_base (189)..(189): a, c, t, g, unknown or other
  misc_feature (189)..(189): n is a, c, g, or t
  modified_base (250)..(250): a, c, t, g, unknown or other
  misc_feature (250)..(250): n is a, c, g, or t
  modified_base (316)..(316): a, c, t, g, unknown or other
  misc_feature (316)..(316): n is a, c, g, or t
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
tcagtacagatcgtcacgaccggtgctcgatttagagagcgtcacagggggggtagagaagacaggactcaggacaatctccagcatggccagcttccctctcctcctcaccctcctcactcactgtgcagggtcctgggcccagtctggtggtgactcagccaccctcaacgtctcgggacccccggnaggaggtcacatctcttgttctggaagcagtctaccaacatcggaaatatactagtaaacncggtaccagcagcctaccgaaggaacccgacccctaaaactcctacactactaataaataaataancgaagccgtacctacgaggtactccgacgtactattcctcgnggtacctaccaagtccgtggcncctagaccgtccctacgcggacctaagtcgacggtcggctacccagttccgtaggacggagtacgaggtactaggtaacttactcctaacgtcgtacggtcgaagtacgtaggtaggtacgtacgtaacgacgtacgtaggtaaacgggttgggggttcgggttagggtttcgggacgggtaacggaccgtaaggtcgtaccggacgtcggttaacgacgtaacggacgtaacggtccgttccggacccgtacggtccgtacgttcccgttacccgg

SEQ ID NO: 22175 - DNA, 691 bp, Homo sapiens
  misc_feature: GYAE6OF02GFY7B.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtcccctcacctgcactgtctctggtggctccatgagcgtagtggtcggttactacgtggtagttggacttccgacagccaaccccgaggggaagggccctgggaggtggaagttcgggactagtacttagtacgtaggtgggacggaccctaactaccaacccgtcctacgaaacgacgtccgtacttaccgatacgtacagtacactacgtacgtaaacaccgtacgtttacctaccgtagtaaacgtccgtagacgtcttactcggtacgtaccgtcgacccggccggtaaccgtaccgggtccggtttagttaacttaccggtaggtcggacgtaggaacgttaccttacctttaacgttaaggttcgggttaccggggtttatttaacgtttaagtttaacgttaacgttccgggttacgtttcgtttttaggtaacgttttacggtttaccgggggacttaaacgggttacgtaagtttccggg

SEQ ID NO: 22176 - DNA, 593 bp, Homo sapiens
  misc_feature: GYAE6OF02IZUI5.35.3.A03.1.454.CMB.1.raw
  modified_base (255)..(255): a, c, t, g, unknown or other
  misc_feature (255)..(255): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
  modified_base (413)..(413): a, c, t, g, unknown or other
  misc_feature (413)..(413): n is a, c, g, or t
  modified_base (443)..(443): a, c, t, g, unknown or other
  misc_feature (443)..(443): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactacgnggtagttggatccgccagccacccgagggaagggccgtagggagtgggattggggtacagtctattacgaggtgggacgacccactacaacccgtcctanaagacgtcactacatacncagtagacaacgtctaacgaacctacgttcctccctgaancgtgagtctctaggtgactcgccgcggacncggtaccgtgtacttactgtcgacgagtagacttccttaacgtgtaggggttacgggtagttacgtttaagttaactttagttcggtacgttacgttttagtacgtttacggttttacgggggaccgtaaagggtacctaagttaccggg

SEQ ID NO: 22177 - DNA, 692 bp, Homo sapiens
  misc_feature: GYAE6OF02GE91C.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagcctcccagatgggtcctgtcccaggtgcagctgcaggagtccgggcccaggactggtgaagccttcacacgaccctgtccctcacctgcactgtctcgtggtcgctccatgagctaggtggttacggttactacgtgggtagttaggactcccgacctagaccgacccgaaggggaacggtccgtagggaggtggtagtttcgggaactattactagttaacgaggtacgggacggacccctaactaaccgaccccgtacctacgaacgtacgtaccgtaacttaccatactacaagtacgaacctaacgttactaaacgaacctacgttacctaccctagtaacgtctacgacgtcttcgtagtcgacgtcggccgtacgaccgaccggtcgttacgtacttacgtggtacgtcgaggtattaccttacgttacgttaggttcgggttaacggggttattttaacgtttaagttaaacgtttcgttacggttaccgtttacgtttttagaacgttttacggttaaccggggaccggtaaacgggtacttaaggtttacccggg

SEQ ID NO: 22178 - DNA, 762 bp, Homo sapiens
  misc_feature: GYAE6OF02I1LC9.35.3.A03.1.454.CMB.1.raw
  modified_base (201)..(201): a, c, t, g, unknown or other
  misc_feature (201)..(201): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctgggcccagtctgtggtgactcagcccaccctcaacgtctcgggacccccggnaggagggtcaccatctcttgtctgaagcagcctccaacagtcggaagtaatactagtaaacgtggtaccagcagcctacccgaggaaccgaccccaaactcctcatactataaataataatcagccgcctgaggactcctacgaccgtattctctggtcctacgaagtcngggacctcctacngtccctcccgtggcctactcgaggtcgggccttacccgagttccgtacgggtaaggtaaccgtggtaacggtcgttacgtaagtttacctcgttaaccgttaggtaccgacgtacgtacgttaggtcggggttaacgtaaccgaaccgttaaccggtaccccggtttaagggtaacggggttttcggggggtttacggggttttacggggtttttaccggggggaaacccgggggttaaccgggggtaaaacccggttaacggggttaaccccggggttaacccgggtttaccccgggttaaaccggggttttaaacccggggttacccgggtaaaccccggggtacccccgggttaaaaccgggttcccccccgggg

SEQ ID NO: 22179 - DNA, 720 bp, Homo sapiens
  misc_feature: GYAE6OF02HJLUB.35.3.A03.1.454.CMB.1.raw
  modified_base (240)..(240): a, c, t, g, unknown or other
  misc_feature (240)..(240): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcgaggagtcgggcccaggactggtgagccttcacacgaccctgtccctcacctgcactcgtcctcgtggtcggcctaccngtgagtcgtaggtggtacggttaactcgtaggtacgttggactccgtaccacgtccgaacccggagggacggccgtagggaggtggtagttcgggactattacttaattacgaggtggaccggaccctacgtaacctaacccgtacctacgaacgtacgtaccgtacttaaccaatacgtacgtaagtactaccgacgtaactaaaccgtacgtacgttacctaccgtagaaccgtacgtacgaacgtccttcgtacggtacaccggttacgacccgtacggaccgtaacggtccgttacgttaacgtacgtcggtacgaccggtaagtaacgttcgttaaccgttagtaccggttaggggtttacgggtagttttaacgttaagtttaaacgttacggttccgtacgttacggttttaacgttacggtttaccgggtttaacggggtaccggtaaagggttacgttaaacggttccggg

SEQ ID NO: 22180 - DNA, 801 bp, Homo sapiens
  misc_feature: GYAE6OF02F2KRQ.35.3.A03.1.454.CMB.1.raw
tcagtacagatcgtcacgaccggtgctcgatttagagagcgtcacaggggggggtagagaagacaggactcaggacaatctccagcatggccagcttccctctcctcctcaccctcctcactcactgtgcagggtcctgggcccagtctgtggtgactcagccaccctcaacgtcgtcgggacccccggcagagggtcaccatctcttgttctggaagcagctccaacagtcggaagtaatactagtaaactggtaccagcagctcccgaggaaccggacccccaaactcctcactactataataataactcgagccggtccctcgacggtacgtcccctaggacccgtactttacctccgttacggccttacccgaaacgttccgtacggcccgtacccgttacaccggtccccttcccggtcggaccctaagtccgtaacgggttccggggtaccttccccgtagttcccgtaggtaacgggtacgttacgggacgggtaccgttacggttaagtttacgttaccttaccgttacgggttacggtacccgtaggcccgtaagggttagggtaacgtttacgggaaccgtaaccggtacccgttaaggtaacgggggtttagggggtttcggggtttacgggggttttaggggaccggggtaacggggtaaccgtaacgggttccgtaaccggggtttaaccccggtaacccggttacgggacccgtaaccggacccggtaaccggtcccgtacccggtaccccccgttcggtacccttaccgttccccggtttaccccc

SEQ ID NO: 22181 - DNA, 635 bp, Homo sapiens
  misc_feature: GYAE6OF02FSHAW.35.3.A03.1.454.CMB.1.raw
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactacgtggtagttggactccgccagccacccgagggaacgggcctgggagtggagttgggacatctattacgaggtggaggacccactacaacccgtccncaagngtcacttaccatancagtagacacgtactaacgaacctacgttcctaccctgaacgtcgtagacgtcctcttgtcgtaaccgtcggccgcggaccgaccgggtccgtcgttaacgttaccgtgggttacgacgtaacggagtaccgttacccgtttaacttagttcggggtttacgggttagtttaagtttaacgttaagtttacgttaccggtccgtttacgtttttaggtaacgtttacggtttagggggacctaaacgggtacgtaaggttacccggg

SEQ ID NO: 22182 - DNA, 740 bp, Homo sapiens
  misc_feature: GYAE6OF02IEA31.35.3.A03.1.454.CMB.1.raw
  modified_base (237)..(237): a, c, t, g, unknown or other
  misc_feature (237)..(237): n is a, c, g, or t
  modified_base (349)..(349): a, c, t, g, unknown or other
  misc_feature (349)..(349): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtcgctccatgancagtggtgttactactggtagttggactcgcagcaccgagggacggcctggtaggtggtagttgggtacagtctattacgaggtgggacgaccactacaacccgtcacaagngtcgactacatatcaagtagacacgtactaacgactacgttctacccgtagaacgcttaggacgtctacgtcgtagtaccgtcggtccccggtacggaaccgtaccgggtaccggtacgtttaaacgtttacggttacggttacgggtaccggtaaggtaaccgttaacgtttaaccccgttttaaacgttaagggtttaccgggggtttaaccgggggtttaagtttttaaacgtttttaaaggtttaaaacgtttttaaccggttttacccggggttacccgttttttaacggttttttacggtaaaagggttttttaccgggttttttaaccgggggggaaaccccgtttaaaagggggttccgtttaaaaccggggtttccccgggg

SEQ ID NO: 22183 - DNA, 735 bp, Homo sapiens
  misc_feature: GYAE6OF02HJNGV.35.3.A03.1.454.CMB.1.raw
tcagtacagatcgtcacgaccggtgctcgatttagagagcgtcacagggtctgtgaaggcttcaccagtcctggacctcctgtgcaaagaacatgaaacacctgtggttcttcctctgctggtgcagctaccagagtgggtcctgtcccaggtgcagctgcgagggtacgtcgggacccagggtactgggtagaacgtccttacaaccgacgtacccgttcgtcccctacaccgtgctacttggtctcgtgggcgcctccagtgacgctaggttggtaggttacaggtggagttgactccgacacgtccgaaccggaggggacggtctagggtaaggtgggtaagttcggactagttccgttaagttacggagggttacggggaaccggaacccctaataacccggaacccgtcccgtagaaagtccgtacgtaactttaaccagtaaacgtgaaacgtacgaacttaaccgtataaaccgtaacctgttccgtacctaggtaacgcgtaggacttcgttcgtaggtacgtaccggacggtacccgacgggtaccgtaccggtacgtttagtaacgttccgtagtccggaaggttaagtaacgttcttaacccgttagttacggttacggggttacgtatttaacgttaacgtaacgtttcgtaccgttaggtttaacttttacggtaggtttaccggttaacgggtacccggtaaacggttctaggtaccccgg

SEQ ID NO: 22184 - DNA, 677 bp, Homo sapiens
  misc_feature: GYAE6OF02GJYVM.35.3.A03.1.454.CMB.1.raw
  modified_base (306)..(306): a, c, t, g, unknown or other
  misc_feature (306)..(306): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatggtcctgtcccaggtgcagctgcaggagtcgggcccaggactggtgaacgccttcacacgaccctgtccctcacctgcactgtctcgtggtcggctccatgagctaggtggtggttactacgtggagttggatccgcagcaccgaggacggctggagtggagtgggtangtctattacgaggtgggacgacccaacgtacctaaccccgttccacgaacgtacgtccgtaacttaccaatactacaagtacgaacctacgttaacctaacgaacctaggttccctacccgtagaaacgtcttacggaactccgttacgttacggtacgtaaccggttcggacccgggtccgggaaccgtacccgggtccgtttaaggttactttaccggtggtcggtaccggaggtaacgtaccgtttacctttaacgtaggttggggttaccgggttatttacgtttaagtaaagttcgtccggtcgtttacgttttagaagttttacgggttccggggtaacccgtaagggtacctaaggttaccggg

SEQ ID NO: 22185 - DNA, 793 bp, Homo sapiens
  misc_feature: GYAE6OF02GYZ9A.35.3.A03.1.454.CMB.1.raw
  modified_base (169)..(169): a, c, t, g, unknown or other
  misc_feature (169)..(169): n is a, c, g, or t
tcagtacagatcgtcacgaccggtgctcgatttagagagcgtcacaggggggggtagagaagacaggactcaggacaatctccagcatggccagcttccctctcctcctcaccctcctcactcactgtgcagggtcctgggcccagtctgtggtgactcagccaccctnaacgtctcggggacccccgggcagagggtcaccatctcttgttctggaagcagctccaacagtacggaagtaatactagtaaacgtgtaaccagcagcctacccgaaggaaccgcccccaaactcctacatactaataataataactcacggccggtcctacgacggtacgttccctaggaacccgtatttccgtcgtcgggtaccctacctaacgtccgtcggtacccgtcctcgaccgcccttaccccgtcggcctagtccgtacggtcgggtaccgtacccgtaggtccgtaggtacggtagtacgagggtaccttaggtaactttacgtaccgtaccgttggttccggacgtacggtcgtaaggttagggtacgtacggtaacgtaccggggtcccgttaaggggtaaccggggtttgggggggtttacgggggttttcgggtttaacgggggaccggggtaaaccggggaccggtaaacgggtcccggttaaccgggtaccccggttaccgggttaacgggttacccgaacccgggtaccccggtaaacgggtccccgttaccccgggtaccccccggtttacgggtaccccgttaccggttccccgtttccccccggg

SEQ ID NO: 22186 - DNA, 683 bp, Homo sapiens
  misc_feature: GYAE6OF02FN94V.35.3.A03.1.454.CMB.1.raw
  modified_base (376)..(376): a, c, t, g, unknown or other
  misc_feature (376)..(376): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgccacttgtctctggtgctccatgagctaggtggtggttactacgtagggtagttggactcccgcacgcaacccggagggaacgggccgtgggaggtggtagttgggtacagtcttaagttacgaggtgggacggaccctaacgtaaccaaccccgttccctanaaggtacgtaccgtacttaccaattactacgaagtacgaacctaacgtacgtaaacgtaacctacgtttcctaccgtagaacgtctagcgtaccttcgtgtcgacgttcggccgtcgaccgtaccggtccgttagttacgttatcggtagtcggaacgtacgttaacttaccgtttaacgttagggttcgggggtttaacggggtttattttaagttacgttttaaatttaccgtcggttaccgtttgtttttaggttaagtttacgggtttacggggaacccgtaaagggttactaacggtttcgg

SEQ ID NO: 22187 - DNA, 671 bp, Homo sapiens
  misc_feature: GYAE6OF02FZ3GA.35.3.A03.1.454.CMB.1.raw
  modified_base (202)..(202): a, c, t, g, unknown or other
  misc_feature (202)..(202): n is a, c, g, or t
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctgggcccagtctgtggtgactcagcccaccctcaacgtcgtcgggacccccggnagagggtcaccatcctcttgttctggaagcagctaccaacatacggaagtatactgtaaactggtaaccagacagcctacccgaggaacccgacccccaaactcctacatactaataataataatcagccgcctgacggtacgtcccctgaccgtattcctcgtggcctaccgtaagtccgtcggccgtccctacgtaccgccccttacccgtaccgggaccctacgtcccgtagggtccgggtacctaccggtacgttccgtacggtacgggtaagtacgggaacgtcgttagtaatttacacgtacgtgtacgcgagacgtagtagggctagacgtacgtacggtagtagggttcgggttagggttaggtttacggggcgggtaaccgggtaccgtaacggttccggttacggtacccggttaccggtaacgggttaccgacccggtaccccggtacgggtccccgg

SEQ ID NO: 22188 - DNA, 742 bp, Homo sapiens
  misc_feature: GYAE6OF02JLP4X.35.3.A03.1.454.CMB.1.raw
  modified_base (184)..(184): a, c, t, g, unknown or other
  misc_feature (184)..(184): n is a, c, g, or t
  modified_base (192)..(192): a, c, t, g, unknown or other
  misc_feature (192)..(192): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtnaagccttnacagaccctgtccctcacctgcactgtctgtggtcgctccatcgagcaggttggttagttactacgtgggtagttggactccggacacgtccgaaccggagggacgggtcctgggacgtggtagttcgggtacattaccgtaacgttacgaggggtacgggaaccggtaacccctaccgttaaaccgaaccccggtttcccaagtaaacggtcgttaaccgtaacctttaaccaagttacgtacgtaggtaaacctaccggttaaccgtaactaaacgtaacccgttacgtttccccgtacccgtagtaacgacgtcgtagtccttacgtacgtaccgtacgttaccggacccggacgggtaacccacgggttaccgttacgttacgttaacgttcggtacggacgtaagtaccgttactttaacccggttaagttcgggtttacgggttaacgggttatttaagttaagttaactttacggttccgtacgtttgtttacggttacggttacggtttacgggaaccgtaacgggtacttagggttaaccg

SEQ ID NO: 22189 - DNA, 709 bp, Homo sapiens
  misc_feature: GYAE6OF02JY18Y.35.3.A03.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagtacagatcgtcacgaccggtgctcgatttagagagcgtcacaggggagcttcagctgtgggtagagaagacaggactcaggacaatctccagcatggccagcttccctctcctcctcaccctcctcactcactgtgcagggtcctgggcccagtctggtggtgactcagccaccctcaacgtcgtcgggacccccggnaggagggtcaccatctcttgttctggancagcctaccaactagtcggaaagttaactacttaggtaaaccgtggtaaccagtcacggtcctaccccgaggaaccccggacccccaaactcctacatactaagtaactaagtatcgagcccggtccctagaggtacctccccgagaccgtattcctgtcgccttaccgaattccgcgggcctcctagaccgtcccctccgtcggacctacgtcgacgtcgggacctcgagtcgagtagtgtaggacgtcgttagttacgttactcgtacgtggtacgtacgtagtaaccgtagggtaacgggttacgtaccgaaaccggttaacgtacccggtaagggtttacggggttcgggggtttgggtttacggggttaccggggaaccgggtacggggtaaacccaacggggttcccgttaccggggtaccccgttacggttacgggtaccgaccccggttaaccgggccgttaccccccggg

SEQ ID NO: 22190 - DNA, 699 bp, Homo sapiens
  misc_feature: GYAE6OF02JIIN1.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagcctccagagtgggtcctgtcccaggtgcagctgcgaggagtccgggcccaggactggtagaacgtccttcacacgaccctcgtccctcacctgcacgtgttcctcgtgggtcgcctccagtgagcgtaggtggttcggttaactacgtggtagttggacgtcccgcacgccacccggagggaacgggccgtggagtcggtagttcggggaactattacttagtacgagggtgggaccgacccctaactaaccgaaccccgtcccaacgaacggtaacgtccgtaaccttaccaattacgtctaaggacaacgtaccgtaacgtaaagaaccctcgtttacccacccgtagaacgtcgtaggtacgcttcgtgtacgaccgtcggcccgaggtaacccgccggtaccgttagttacttacgtcgtacgcgaaggtactacgttactacgttggttacgggttacgggttatttaagtaacgtttaacgttaacggttccggtaccgttttagtttacgttacgtttacgggtttaccgggaacggttaacgggtacctaaggtttacccggg

SEQ ID NO: 22191 - DNA, 750 bp, Homo sapiens
  misc_feature: GYAE6OF02JO28Y.35.3.A03.1.454.CMB.1.raw
  modified_base (364)..(364): a, c, t, g, unknown or other
  misc_feature (364)..(364): n is a, c, g, or t
  modified_base (636)..(636): a, c, t, g, unknown or other
  misc_feature (636)..(636): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtagagccttcacagaccctgtccctcacctgcactcgtctcgtggtcggcctaccagtcgagctaggttggtacgttactacgtgggtagttggacgtccgacgacgccgaaccggtaggggaacgggtcccgtaggggaggtaggacgtttgggtaacctaggttactaaggtttaaccgnggggttacgggaccggaacccctaaccgtaaccgtaaccccggtacctacgaaacgggttacgacccggttaacctttaacgaacgttaacgttacgaaacggttaccgaaaccggaacgtttaaccctaaaaggtaacccgttacgtttaacccttaccgttaaggaaccgtacgtacggaacgtcgttaaccgtcgtaccgtagtaccggtaccggccgacggtacgtcggttagttacgttaacgtggtacgacgtagtacgtaccttntacggttaggttcgggttacgggtacgttagtttaacgtacttacgtcggtaacgtttcgtttagttaacggttacggtttacgggaaccgttaacgggtacgttagtaaccgg

SEQ ID NO: 22192 - DNA, 858 bp, Homo sapiens
  misc_feature: GYAE6OF02IRTKD.35.3.A03.1.454.CMB.1.raw
  modified_base (210)..(210): a, c, t, g, unknown or other
  misc_feature (210)..(210): n is a, c, g, or t
tcagtacagatcgtcacgaccggtgctcgatttagagagcgtcacagggggaggcttcagctgtgggtagagaagacaggactcaggacaatctccagcatggccagcttccctctcctcctcaccctcctcactcactgtgcagggtcctcgggcccagtctgtggtgactcacgccctaccctacaacgtccgtacggggaccccggnaggacggtcacatcttcttgttcgtaggaagcacgcctaccaaacacgtacggaaagtaactacgtacgtaaaacgtcggtaaccagacagcctacccgaaaggaacccgccccctaaaactcccgtactaacttactaaaacgtaaataaaacttaaactccgaacggtcccggtaccccttaaggaaccgggtacgtaccccgtaacggtaaacccgttcgttacgtttaccgttaaccgggtccccttaaaccgaaggtttaccgccgggtacccggtcccaactaacccggtccccttacccggtacgggtaccctaacgtcggtaccgggtcgggacccgttacccgtacggttccgtaagggtaacggtaacgtacgggtaacggtaccgttaacgttaacgtttaacgtaacccgtaaagtttcgggtacggtacctaccgggaacgttaacggtaacggggtaacgtaccgggtaaacgaccggttacccggtaagggtaaacgggttcggggggttaggggtttacggggtttacgggggaaccggggtaacgggtaaacccggttaacggacggtttaccggtacccgggttaccggtaacggtacccggtaacccggtaccggaaccggtaccccgg

SEQ ID NO: 22193 - DNA, 666 bp, Homo sapiens
  misc_feature: GYAE6OF02HAAEM.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctccagatgggtcctgtcccaggtgcagctgcaggagtcgggcccaggactggtgaagtccttcacacgaccctgtccctcacctgcactgtctctggtcgctccatgagctaggttggtacggttactacgtggtagttggactccgccgagccgaccgaggggaacggccgtggagtggtagttaggactagtctattacgaggtcgggacgacccctacgtaaccgtacccgtacctagaaacgtcgtaccgtaccttacagtactacgagttaacacctacgtactaaacgaccgtacgttccctacccgtaagacgtctgtaacggtcttcgttcgtacgacgttcgaccggaccggacgccggtcgtagttactaggtcgagagagtacgttacttccgttaagttggttacggggttacgggttatttaacgttaagttaaacgtttcgtaccggttaccggttttgttttaacggtaacggttttcggtttaccggggaaccgttaacggggtaccttaggttaccccgg

SEQ ID NO: 22194 - DNA, 909 bp, Homo sapiens
  misc_feature: GYAE6OF02JNCW1.35.3.A03.1.454.CMB.1.raw
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcgaggagtcgggcccaggactgggtgaagcccttnacncggaccttgtccctcacctgcactgtctcgtggtcggcctccagtcgacgcgagtggtcgttactacgtaggagttggctccgccgtacgacaccggacgggaacggtccgtaggcgtaggtagttcggggttaacacgttacgttacttaacgtaggtacgggtacggaccccgtaaacgtaacccgtaaccccgtacccgttaccgaaacggtacggtaccgttaaccgttaaccaactacgttaacgtaccgtaaacggtaccgtaaccggttacgtaaaacgtaaacccgttaacgtttacccgtttaaccccgtaagggtaaacggttaaccgtggttaaaccggtacttacgggtttacggtaaccgttaacgttaccgggtacccggtaacccggggaaacccggtacccgggttaaccggtttacgggtttaaccgttttaaccgtacgggttaaccggtccggggtaaacgggttaaccctttaacgggtttaaccccccttttttaaagggttaaccgggttttttaacgggggggttaccccgggggttttaaagttttaccgtttaaaaggtttttaaacccgtttaacgtttaaccggggttcccgtttaggttttttaacccgggtaagtttttaaacccggggtttcgggtaaaaccccgggtttaagggttacccgttaacgggtttaacccggg

SEQ ID NO: 22195 - DNA, 617 bp, Homo sapiens
  misc_feature: GYAE6OF02JIC8T.35.3.A03.1.454.CMB.1.raw
  modified_base (461)..(461): a, c, t, g, unknown or other
  misc_feature (461)..(461): n is a, c, g, or t
tcagtacagatcgtcacgaccggtgctcgatttagagagcgtcacagggtctgtgaaggcttcaccagtcctggacctcctgtgcaagaaacatgaaacacctgtggttcttcctcctgctggtggcagctcccagatgggtcctgtcccaggtgcagctgcaggagtcgggcccaggactggtgaagccttcacagaccctgtccctcacctgccactgtctctggtcgctccatgagcaggtggtggttactactggtagttgatccgccagccaccgaggggaagggcctgggagtggaagttgggtacatctattacgagtgggacggacccactacaacccgtcctacaagacgtctacttaccgatactacgagtacgactacgtactaaacgaaccgtagttacctccctaagaacgtctgtagtctcgtgtcgtacgtcgcccggacggaccncgggtccgtagttaacttcgtacgttgaccggtaggacgtacttcctttaactgttacgggttacgggtagtttaagttacgttaaatttacgtacggtccgttacgttttagaagtttcggtttacgggaccgtaaggggtactaggtttacggg

SEQ ID NO: 22196 - DNA, 721 bp, Homo sapiens
  misc_feature: GYAE6OF02GS0ZT.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtcccctcacctgcactgtctcgtggtgctccatgagcagtggttgttactacgtggtagttggactccgccgagccacccgagggaacggccgtagggacgtggagttcgggtacattacgttatacgagtgggacgacccactaccgaacccgtcctacgaacggtacgtcgtaaccttaccatactacgacgtaacgacctaaccgtagtaaacgaacctacggttccctaccgtaggaacgtcgtacggtacgtccttcgtcgttcgaccgttcggacccggacggtaccaccgggttccgttaggttacgttaacgtggtacgacgtaaggtaacgtacgtttacccgttaagttacgggtttacggggtttaccggggttaagttttaacgtttaaacgtttaaacggttttaccgtttccgggttaccgttttacgttttttaacggtaacgtttttacggggtttacggggaaacccggttaaacggggttacccgtaaggtttaacccggg

SEQ ID NO: 22197 - DNA, 709 bp, Homo sapiens
  misc_feature: GYAE6OF02JLY5R.35.3.A03.1.454.CMB.1.raw
  modified_base (444)..(444): a, c, t, g, unknown or other
  misc_feature (444)..(444): n is a, c, g, or t
  modified_base (554)..(554): a, c, t, g, unknown or other
  misc_feature (554)..(554): n is a, c, g, or t
  modified_base (647)..(647): a, c, t, g, unknown or other
  misc_feature (647)..(647): n is a, c, g, or t
tcagtacagatcgtcacgaccggtgctcgatttagagagcgtcacaggggagcttcagctgtgggtagagaagacaggactcaggacaatctccagcatggccagcttcctctcctcctccacctcctcactcactgtgctagggtcctgggcccaggtcctgtgggttagaccgttcacgacctacccctctaaacgtccgttcggggaccccccggcgacggaacgggtccaccgaacttcctccgttgttccttacggaacgccgacggtccttaccaaacgtacgtaaccggaagttaacgttacctagtaaacgtcgttaaccgagtaccagtccgtacccaaggtaaccccggccccgtaaaaccttccactacctataacgttaattaactaaagtcaacggtccgtaccctagacggtacctccgtacgaccgttntacgtcgtcggttccacgtactcggtacggccttcctacacggccctacccgcggtacacgttgacggtcggtcgcgtactcgtaagacgtcgacggaggtctcgttaancgtacgttactgtagtgtactacgtggattagggacacggactacgtagtacgtcggggtagggttcgtagggttacccgggaggttaaccgngggtaccgtacggtacccggtaccggtttagacccgggttacacccggggttaactcccggg

SEQ ID NO: 22198 - DNA, 547 bp, Homo sapiens
  misc_feature: GYAE6OF02HZBPX.35.3.A03.1.454.CMB.1.raw
  modified_base (392)..(392): a, c, t, g, unknown or other
  misc_feature (392)..(392): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtcggctcatgagcagtggtggttactactggagttggatccgccagcaccgagggaaggcctggagtggattgggtacatctattacaggtgggagaccactacaacccgtcctacgaagacgtcgacttaccatactcagtagacacgtactaacgaaccagttcncctagacgctgagtctctgtgactgcgcgacacggccgtgtattcgtgtcgacgagtacgacttccactttttagcgggttacgggtattagttaagtaatttacgtacgtcgttagttttgattaggtttcgggacgtaagggtactagttcgg

SEQ ID NO: 22199 - DNA, 965 bp, Homo sapiens
  misc_feature: GYAE6OF02HK2MK.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagagtgggtcctgtcccaggtgcagctgcgaggacgtccgggacccaggactggtgaacgtccttcacacgaccctgtccctcacctgcactgtctcgtgtcgcctcagtgagcgagtggtacgttactagtggtagtgactccgcacgacctaccggaggggacggtcgtggtacgtggtacgttacgggtactacgttacgtacgttaacggtagggtacgggaaccgggtaacccctaaccgtaaaccccgtaaaccccggttaccccgtaacggtaaaacggtaccggttaacccgttaaaccgtttaacccgtaacgttaaccttcccggtaaaacggtttaaaccggaaacccgttaaacccggtttaaacccgttaaaccgggtaaacccgttaacccgggttttacccttaacccccggtttaaagggtaaaccccgttaccggttaaacggtaccgtttaccgtttacccggtttacgggtaaccgttaacccgggttcccgggtacccgggttacccgggtaaccccggtaaccggggttacccgggttacggttttaaccggtttacccgggttacggttaccggggtaacccggggtacgggttaaaccggtttaaccctttaaccccggtttaaagggtttaaccgggttttccggggggtttaacgggggtttactttttaaaggttttaaccggttttaaaacggtttacggttacccggggtttaaccgttttaccggtttttaaggttaccgggttttaacgggtttccgggggtaaaccggtttaacggggtaaccgttaacggtttacccggg

SEQ ID NO: 22200 - DNA, 790 bp, Homo sapiens
  misc_feature: GYAE6OF02F1NXD.35.3.A03.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (478)..(478): a, c, t, g, unknown or other
  misc_feature (478)..(478): n is a, c, g, or t
tcagtacagatcgtcacgaccggtgctcgatttagagagcgtcacaggggcagcttcagctgtgggtagagaagacaggactcaggtacaatctcagcatggccagcttccctctcctccctcaccctcctcacgtcactgtgcgtagggtcctgggcccagttctagtggtcgactcagccacctcaacgtcgtcggggaccccggnaggacgggtcacgattcctacttcggttacagggaanccgtaagcctaccaaacgtacgtcgggtaaataactacgtaacgtaaacgtcggtaacccagtaccgtacggactacccgtaagggaaccgaccccctaaacgtcctacgactactaataactaacgtaagtaccgacggccggtacccttacgaacgggtacctaccgttaacgaccgtacgtttaccgtccggtacgggtacctaaccgtaacgttcggagggttaccccncgttaccacggccccgtacccgtagggaccctagtacgacggttacgggcctacgtacgtacgttacggaagttcgtacggtagttaccgtagttacctttaacgacctaaccgtggtacgtaccgaagtacgttacggggtacgggttaacaccgggaaagtacccggtacttagggttaacggttcgggggttagggtttacggggtaacggggtacgggaaaccgggtaaacccgacgggttaacgttacccgggttaccggttaaacccgggttaccgccgggtttaaaacccgccggttaaccccgg

SEQ ID NO: 22201 - DNA, 772 bp, Homo sapiens
  misc_feature: GYAE6OF02H1CJJ.35.3.A03.1.454.CMB.1.raw
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
tcagtacagatcgtcacgaccggtgctcgatttagagagcgtcacagggtctgtgaaggcttcaccagtcctggacctcctggtgcaagaacatgaaacacctgtggttcttcctcctgctggtggcagctccagatgggtcctgtacccaggtgcagctgcgaggacgtcgggccaggactggtgaacgccttcacacgtaccctgtccctcgacctgcacctgtctcgtgggtcgctacgatgacgcgtaggttggtacggttacncgtggngttcggactccggtcagccgtacggaaggggtacggcgtttagggaggttaggtacgttcggggtacctaggttactttacgttacgtaggtaacgggttcgggaacccggtacccgttaacccgtaaaccccgtaacccccggtccgttaacgtaaacggtaccgtaacccggttaactttaacccgaatttaccgtacgtaagtaaccggtaacgtaacgttaaccggtaataacccgtactttacccgtacgacggtaaactcgtacgggtaccgtcttcgtaggttaaccgcgtcggaccgacgttccgaacggttccgtaagttaccgtaacgttggaccgtacggtactacggttactttaccgggtacgttaggggttaccgggtaacggtttattaaccgttaaacgtttaagttcccgtaacggttacttttcggtttaacgtaacgggtttacgggtacgggttaacccggtacggtaccttaacggg

SEQ ID NO: 22202 - DNA, 698 bp, Homo sapiens
  misc_feature: GYAE6OF02GC87M.35.3.A03.1.454.CMB.1.raw
  modified_base (196)..(196): a, c, t, g, unknown or other
  misc_feature (196)..(196): n is a, c, g, or t
  modified_base (692)..(692): a, c, t, g, unknown or other
  misc_feature (692)..(692): n is a, c, g, or t
tcagtacagatcgtcacgaccggtgctcgatttagagagcgtcacagaccctgtccctcacctgcactgtctctggtggctccatgagcagtggtggttactactggagttggatccgccagcacccaggggaaggcctggagtggattgggtacatctattacagtgggagacccactacaacccgtcctcaagngtcgacttaccatatcagtagacacgtactaagaaccagttcctcccgtagaacgctaggacgtcttctggtcgtactcggccggacggacaccgggtccgtgtaacttacgtgtggacgaggacgtatccttactagttgggttcggggtaatttattaattaattagtcgtcgtctttgattagtttcggggactaagggactaagttggtcctaccggttctacttcacgtccctaccacgaacggccctaagtcccggttccctcccccgtgggtccccgtccgtcgcccgtaccgaggtaccgaccctaacccgtccgaagacggtacctaaccggacgggtccccgggccgtaggggtcccgttcggcccgttgggtaaacccgtaaccggtaccgtttacccgtcctaacgggtaactccggttaacggttaccgtacgggaaccgggttccggggacgtccgggaacggtaccgggtcaccggttaancggtag

SEQ ID NO: 22203 - DNA, 704 bp, Homo sapiens
  misc_feature: GYAE6OF02G9BO8.35.3.A03.1.454.CMB.1.raw
  modified_base (190)..(190): a, c, t, g, unknown or other
  misc_feature (190)..(190): n is a, c, g, or t
tcagtacagatcgtcacgaccggtgctcgatttagagagcgtcacaggggggggtagagaagacaggactcaggacaatctccagcatggccagcttccctctcctcctcaccctcctcactcactgtgcagggtcctgggcccagtctgtggtgactcagccaccctcaacgtctcgggacccccgggnaggagggtcaccatctcttgttctggaagcagctaccaacatcggaaagtaatactagtaaactcggtaccgccaacttccgaaggaaccgacccccaaactcctactacttacagtagaataatcgagcggccctacgacggggtccctaggactccgtccttcgtcgtcggtcctaccgtaacgtccgtacggaccaaaccgaccgggtccctttaccccgttaccgtcttcggtcgggtcctaccgtacgacgtggaggtactagggtacggtacgtagtatttacgttacgtcgtaccgtagtcttacacttagtcgacgtaggctaacgtaccgttaacggtttaggttacgtttcgggaccgggtaacgggtaccgttaaggttccgtaacccgtaaccggtacgtaccacgacccgtacggtccgtacccggtccccgtacggttacccaccgtttaccgttcccggttacccctcccgttccctaccgaccgttacttcgtaccgg

SEQ ID NO: 22204 - DNA, 601 bp, Homo sapiens
  misc_feature: GYAE6OF02INFO7.35.3.A03.1.454.CMB.1.raw
  modified_base (353)..(353): a, c, t, g, unknown or other
  misc_feature (353)..(353): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtcgctccatgagcagtggtgttactacgtggagttggactccgacagccacccgaggggaacggcctggacgtggagttgggtacatctaattacgaggtcgggaacgacccagtaccaccgtcccanaagacgtcacttacatactcagtacgacacgtactaacgaacctgttcctaccgtagaagtctagacgtcttctgtcacgttggacccgcggaccacggtccgtagttacttacgtgtacgcgagtacgtacttccgttaacgtaggttgggttaacgggtatttaactttagtaaacgtttacgtcggttcgttacgtttttagacgtttacggtttcggggaaccctaagggtacctaggttccgg

SEQ ID NO: 22205 - DNA, 755 bp, Homo sapiens
  misc_feature: GYAE6OF02G0SSY.35.3.A03.1.454.CMB.1.raw
  modified_base (187)..(187): a, c, t, g, unknown or other
  misc_feature (187)..(187): n is a, c, g, or t
  modified_base (351)..(351): a, c, t, g, unknown or other
  misc_feature (351)..(351): n is a, c, g, or t
tcagtacagatcgtcacgaccggtgctcgatttagagagcgtcacagggtctgtgaaggcttcaccagtcctggaccctcctgtgcaagaacatgaaacacctgtggttcttcctcctgctggtggcagctcccagatgggtcctgtcccaggtgcagctgcagaggtccgggcccagggactggtnaacgccttacacagtaccctcgtcccctcacctcgaccacttcgtctcgtgggtcgtccctaccgatacggacgtcgtaagggttgggtttacggttaccttaggtcggtaggttcgaccgttcccgaccgacaccgaaccggtaggggaacgggtccgtaggnggttacggtggtacgggtactacgtacgttaattacggagggtgggaacgacccctaacgtaccgaaccccctcgtaacgaacgttgaaccgttaaccctagtactaagcacgtaggaacccttgaactaacgacccgtacttaccctccgacgaacgtctagtacacttccgtagtccgaacgttccggaccggaccgtaccgggtacccgtcgtagttaccgttccgtaggttccggtacgaggtaaccgttacctttacggttaacctttaggggttggtttaacccggggtttagtttacgttttaacgttaaacgtttcggtaacggttccgttttacggttttataggttttacccgggtaccggggtaccggtaaacggttacgttaccggttaccg

SEQ ID NO: 22206 - DNA, 725 bp, Homo sapiens
  misc_feature: GYAE6OF02GTE2Y.35.3.A03.1.454.CMB.1.raw
  modified_base (170)..(170): a, c, t, g, unknown or other
  misc_feature (170)..(170): n is a, c, g, or t
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
tcagtacagatcgtcacgaccggtgctcgatttagagagcgtcacgaggggggggtagagaagacaggactcaggacaatctccagcatggccagcttccctctcctcctcaccctcctcactcactgtgcagggtcctgggcccagtctgtggtgactcagccaccctnaacgtctcggggacccccggnaggaggtcaccatctcttgtcnggancagctccaacntcggaaatatactagtaaactggtaccagcagctacccgaaggaaccggcccccaaatcctcacgtctaataactaataactcgaagccggcccctcgaggtaccgtccctaggacccgtattcctcgtcggtactacccgtaagtccgtacggcctccttcgaccgtccctcccgtcggcccaatccgacggtcgggacctccgacgttctggacggtagtacggaggtccgttagtacgttacgtccgaacggtttcgtcgttacggaacgtccgtaaggttacggggtattacgggaacgacggttacccgtaaggggttaacgggttgggggtttcggggttagggttttcggggaaccgggttaacgggtacccgaacgggtcgtacggtacccggttaccggttacggttaccgaaccgggtaaccccggtaggtacccgttacccggtacccccgttaccgggtacccttacccgttccgttacccccgg

SEQ ID NO: 22207 - DNA, 716 bp, Homo sapiens
  misc_feature: GYAE6OF02J22UT.35.3.A03.1.454.CMB.1.raw
  modified_base (100)..(100): a, c, t, g, unknown or other
  misc_feature (100)..(100): n is a, c, g, or t
  modified_base (134)..(134): a, c, t, g, unknown or other
  misc_feature (134)..(134): n is a, c, g, or t
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (547)..(547): a, c, t, g, unknown or other
  misc_feature (547)..(547): n is a, c, g, or t
  modified_base (553)..(553): a, c, t, g, unknown or other
  misc_feature (553)..(553): n is a, c, g, or t
  modified_base (564)..(564): a, c, t, g, unknown or other
  misc_feature (564)..(564): n is a, c, g, or t
  modified_base (584)..(584): a, c, t, g, unknown or other
  misc_feature (584)..(584): n is a, c, g, or t
tcagtacagatcgtcacgaccggtgctcgatttagagagcgtcacagggtctgtgaaggcttcaccagtcctggacctcctgtgcaagaacatagaaacncctgtcgttctcctctgctggcgcagcctccagngtcgggtcctcgtacccgaggtgcagtctgacgaggccggttcccggaccgaaggtccgttagggtacgaaccgtcccttaccacgaaccgtccccgttcgttcccccncgtaaccctgacctaccttcgtaaccttcggtacggcgtccttaccagtccggngtaccgtaggttcggttacgtacncggtcggtagtccggcnccgactacggcccaacgggtagggaccggngtacggngttacgtagtaggtactcgtacgttaccgtaggaggaccggttaacccgccctaaccgtaaaccccgtcccgacgttaacgaaacggtcgttccttaaacctaacgtaactactcggaaaacgtacggaacccctgtaaacttaaaccgtcgtccttccgtacgtgaacgtnagttcnctcgatcgccncgacgcgtaccgcgttcgtntaagcgtcggccaaggattccgttcgacgttacggcggttagttacggttaacttagttaaccttggtccgtacttggttttaaacgtgacggttttcggtacggaaccggttagtaccgtcggttaacccg

SEQ ID NO: 22208 - DNA, 640 bp, Homo sapiens
  misc_feature: GYAE6OF02JTZRK.35.3.A03.1.454.CMB.1.raw
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagcctcccagatgggtcctgtcccaggtgcagctgcaggagtcgggcccaggacgtggtgaagccttcacacgaccctcgtccctcacctgccactcgtctcgtggtcgctcagtgagctaggtggttgttactacgtggtagtcggactccgcagaccgaccggagggacggccgnggagtaggngttaggacagtctatacgaggtcggacgaccactaccgaccgtaccagaacgcgtacgtacttacatactactagtacactacgtacgtaacgaactacgttaccaccgtagaacgtcgtagacttctacgtgtacgtacgtacggtaccgacggaccgtacgggtaccgtaggttaactcggtggtacgacggataacgtctttaccgtaagttagggttacggggttaacgggttatttaacgtttaacgttaaacgttacgtcggttcgtttaacgtttgtaacggtttacgggttacgggaacttaagggtacctagggttacg

SEQ ID NO: 22209 - DNA, 629 bp, Homo sapiens
  misc_feature: GYAE6OF02JD5Z1.35.3.A03.1.454.CMB.1.raw
  modified_base (330)..(330): a, c, t, g, unknown or other
  misc_feature (330)..(330): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctcgtggtgcctcatcgagcagtggttggttactacgtggtagttggactccgccagaccgacccgaggggaacggtccgtgggagtggtagttggtactatcttatacgnggtaggacgaccactacgacccgtcctagaacgagtaccgtaacttaccgattactacgacgtaacgacctacgtacgtaaacgacctagttaccctccgtagaacgtctagacgtcttcgtgtacgacgtcgtacccgcggaccgcgggtccgtagttaaccgttgtacgtaggacgaggtacgttacttaaccttacgttaggtacgggtttacgggttatttacgttaagttaactttagtacgtccgtttatttagtacgtttaggttaccgggacgtaagggtactaggttccg

SEQ ID NO: 22210 - DNA, 962 bp, Homo sapiens
  misc_feature: GYAE6OF02H75YT.35.3.A03.1.454.CMB.1.raw
tcagtacagatcgtcacgaccggtgctcgatttagagagcgtcacagaccctgtccctcacctgcactgtctctggtggctccatgagcagtggtggttactacgtggagttggactccgccagcacccgagggaggcctggagtggagttgggacatactactaagtacgtagggtacgggaccgacctaaccgtaacccgtaaccccgtcctaacgaacggtacgtaccgttaaccgtaactatacgtacgtacgaacgaccgtaccgttaactaaaccgtaaccgtttacgttacccgttaccggaagaccgtacgtacgtacgttccgttcgtacgttacgtaccggtccggaccgggacccggaaccggtaccgggttacgttacgtttaaccttacggtacggtaacggacggtaacggtacgttacccgttttaaccgtaacggtttcgggtttacgggggttaacgggttttaagttttaaagtttaaacgttaacgtttaccggtccggtttacgttttacggtttaaacgtttacgggtttaaccggggtttaacggggaaacgggtaaacggtaacgttaacgggttaccggttaacccgttaccggtttaccgttcccgtacgtaccccgttacccgaaaccccggtaacccgggaaaccccgggttaccgttaccccgggttttccccggtttaccccccgtcccgggttcccggttacccggttcccccgtaaccggttcgtaacccgggaccggttacccgtaccggtaacccgagggaacccgtacgaacccgccgggtaccggtacccgggtcggcccgttcgaccggttacggaccggttaaccgaaccgtttaacccgtaccgtacgtacggttaccgtacttacgtaacgggccggttaccggtccggtacggaaccggtacgggaaccgcgtacgtagtcg

SEQ ID NO: 22211 - DNA, 709 bp, Homo sapiens
  misc_feature: GYAE6OF02FM9EO.35.3.A03.1.454.CMB.1.raw
  modified_base (536)..(536): a, c, t, g, unknown or other
  misc_feature (536)..(536): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagtccttacacacgaccctcgtccctcacctgcctactgtcctcgtggtgcctacctatggagcgtaggttggtcggttaactacgtggtagttggactccgaccagtccgaaccggaaggggaacggtcccgtaggggtacggtagggtacgttacgggtaactagttacgttacgttaaccgtggggtacggggaacggaacccccaacgtaacccgtaaccccgtccctaacgaagacgtaccgtaactaaccctataacgtcgacgttaacgaccaacgtaccgtaaacgtaacccgtaacgtttcccgtaaccgtacggtaaaccgtctacgaacgttccttacgngttacgaccgtcgaccgcggtaccgacggtcgtagtactcgtgtcgagtacgacttattaccgttagtacgttagggtttacgggatttaaccgttaagtaagtttcgtacggttacttacgttttaggacggtttaggttaccggggaaccgtaacggtacttaacggtcgg

SEQ ID NO: 22212 - DNA, 809 bp, Homo sapiens
  misc_feature: GYAE6OF02JAH30.35.3.A03.1.454.CMB.1.raw
  modified_base (99)..(99): a, c, t, g, unknown or other
  misc_feature (99)..(99): n is a, c, g, or t
tcagtacagatcgtcacgaccggtgctcgatttagagagcgtcacagggtctgtgaaggcttcaccagtcctggacctcctgtgcaagaacatgaaacncctgtgttcttcctctgctggtgcagcctccagatcgggtcctcgtacccaggtcgcagctgccgaggtacgtccgggacccaggacttggacgaacgtcccttacgaacacgtacccctgtcccctaccgaccgtgacctacgttcgtccttcgtggggtctaccttaccgagttaggacgtaccgttaggttacgggttcggtttaaccctaacggttgggttaacggttttcgggaaccttccccggaccgttaaccgtaccgaaccccgggaggggtaaacggttcccggtaagggtacggttacggtacgtttacggggtaactaacgtttaccgttaacgttaaccggtaggttaccgggtaaccgtaaccccacgttaaccccgaacccgttccgtaaccgaacggtacgtaacctaccgttaacgtaacgtttacaacgtacgtaaccgaacgtaccgtaacgtaacgtaccgtaccgtttcctaccgtaacgtaaacgtctacggtacgtccgttacgtcggtacgttacgaccggtccgacggaaccgtacggtcttaagtcgtaattcgggacgtacgacgtaacgttccgttaagttaccgtaaggttcgggttaccggtaattttctaacgttacgttacgtcggttcgttagtttagtgtttaacggtcggtaccgtaaggtaacttgttaaccgg

SEQ ID NO: 22213 - DNA, 1199 bp, Homo sapiens
  misc_feature: GYAE6OF02IJ690.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagcctcccagagtgggtcctgtcccgaggtcgcagctgcgaggaggtccgggccaggacgtgggtacgaacgtccttacaaccgacgtaccctcgttcccctaccgaccttgacctacgttcggttaccttccgttggggttccggacccttacccgaaagttcggacggttaccggttaaggggtttacggggtttaacgggttttaaccgttaaccggtttacggggttaacgggtttaccgggtaccggtacccccggtaccgtaaccggaaccggttaaaacccccggggaaggggggaaacccggggtccgggttaaggggtaacgggtttaacggggttaacggtttacggggtaaacctaacggtttaaccgtttaacgttaaccggaacgggttaacgggggaacccggtaaaccccgtaacccttaaaaccccggtaacccccggttaaccccttaacggaaaacggttacccggttaacccgttaacccgtttaaaccgtaaccgttaaacgttaccgttaaacgggttaaaccggtaacccgttaaacccggttaacgtttaaaaacccgggtaaccgtttaacccgttttaccccgttaaacccggttaaccggtaaaacggtcccgttaaaggttacccgggttaacccttacgggttaccggtttaaccggtaaccgtcccgggttaaccccgggaaccgggtaaccggtaccgggtttacccggtttaaaggttaaccggtttaccggtacgggttaaccggtaaccgggtaaacggttttaaccggtaaccgtttttaaaccccggttttaaagggttttaccgggggtttaaccccggggggttttttaaacgggggtttaaacgttttttttaaaacgggttttaaaaccgtttttaaaaaccgggttttttaccgggttaacccggttttttaaacggggtttttttaacccggtttttttaaacgggtttaaccgggtttttaacgggggggtttttaaaccccgggtaaaccggggtaaaaacgggttttccccggttaaaacgggttttta

SEQ ID NO: 22214 - DNA, 898 bp, Homo sapiens
  misc_feature: GYAE6OF02G7HC7.35.3.A03.1.454.CMB.1.raw
  modified_base (233)..(233): a, c, t, g, unknown or other
  misc_feature (233)..(233): n is a, c, g, or t
  modified_base (514)..(514): a, c, t, g, unknown or other
  misc_feature (514)..(514): n is a, c, g, or t
  modified_base (570)..(570): a, c, t, g, unknown or other
  misc_feature (570)..(570): n is a, c, g, or t
tcagtacagatcgtcacgaccggtgctcgatttagagagcgtcacagggggggggtagaagaagacaggactcaggacaatctccagcatggccagcttccctctcctcctcaccctcctcactccactgtgcacgggtcctcgggcccagtctggtggtgactcagcccaccctcaccgtcgtcgggacccccggcaggacggtcaccattcttcttcgttcgtaggaacgntagactaccaacaggtacggaaagttactaactagtaaacgtcggtaacctacgacacgtcctacccgaacggaaccccgacccccaaacgtcctacgtacttaacttaaacgtaaacttaaactaactacggaaccggtccggtacccgacggtaaccggtaccggttccccgttaaccggaaccgtttaaccttccgtccgtaccggttcctaacccgttaacggtacgttaccggcccggtaccttacgacccgtaccccgttcccgacggttaaccncgttaacgcgggtaccggtccctaccggttaagtttaccggagggacgggttaacnccgggtaaggtcccgtttaagttacggttaacctccttaacggtttacggcggtaaccgtacgttacgtaaggggtcgggtaaacttaccgggaaccttaccggtcgtaaacggggtttcggggttagggttggggttttaaccgggttggggggaaacccggtaggttaaacccggtagggttacccgttaacccgggggcccgttttaaaccgggtaccgggtaacccgttaacccgggaaacccccgtttagggaaccccccggttttccccgggacccccgtttaggggttaaccccctcgtttaacccccgttttccccccgg

SEQ ID NO: 22215 - DNA, 695 bp, Homo sapiens
  misc_feature: GYAE6OF02GBUO1.35.3.A03.1.454.CMB.1.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
tcagtacagatcgtcacgaccggtgctcgatttagagagcgtcacaggggggggtagagaagacaggactcaggacaatctccagcatggccagcttccctctcctcctcaccctcctcactcactgtgcagggtcctgggcccagtctgtggtgactcagcccaccctcaacgtcgtcgggaccccggnagagggtccaccatctcttgtctaggancagctacaacagtacggaataatactagtaaacgtcggtaaccagtacacgctacccgaaggaacccggaccccaaactcctactactacgtaataactaaatactacgacgccgtacctacgacggtacgtccacgtactacttactcgtcgtactaccgtaagtcgtacgcgctcaccgtcctacgtggacctagtacgtcggtaccggtctaccgtaacgtcgtaggaacggtacgtggtacggtagttacgtattaacgttcgaacgttcgtaacgaacgacgttaccgtagtacgggttacaccggaactacgggtacttaacgggtagggttcggggttacgggttaggttcgggtaacggaaaccgggtacacggttaccgtacggtaccgttacggtaacggtccaaccggggtactaaccggtccgtccccgtaccggtacggtaccgtttccgaccgtttaccccgg

SEQ ID NO: 22216 - DNA, 723 bp, Homo sapiens
  misc_feature: GYAE6OF02J0OQQ.35.3.A03.1.454.CMB.1.raw
  modified_base (198)..(198): a, c, t, g, unknown or other
  misc_feature (198)..(198): n is a, c, g, or t
  modified_base (252)..(252): a, c, t, g, unknown or other
  misc_feature (252)..(252): n is a, c, g, or t
  modified_base (336)..(336): a, c, t, g, unknown or other
  misc_feature (336)..(336): n is a, c, g, or t
tcagtacagatcgtcacgaccggtgctcgatttagagagcgtcacagggtctgtgaaggcttcaccagtcctggacctcctgtgcaagaacatgaaacacctgtggttcttcctcctgctggtggcagcctcccagatgggtcctgtcccaggtgcagctgcgaggacgtcgggcccaggactggtgaagtcccttanacacgaccctcgtaccctccacgtgcaccgtgtctctgggtcgacctccgtaangtagctaggtggtcggttacagtggagttgactccgctagcctaccgagggacggctggagtgacgttggacatacgtatacgnggtacgggactaccactaaccgaacctccgtacgaaacggtcgtaccgtaacttacccgattacgacgtaaggtacacgtaccgtacgaaactaaccgtacgtactacccggatacggtactacggactcgttacgtcggtacgtaacggtccgtaccgggtaccgaaccggttaccggtacgttacggttaaacgttcggtttacggcggtaccggtaacgaaccgtttaaccgttaaccgttacggttacggttacgggggttacggttagtttaggttaaaccgtttaaggtttaccgtccggtttaacgtttacgtttaacggtttacggttaaccggggtttaccggtaacggttaacggtaccggttaaggtttccccggg

SEQ ID NO: 22217 - DNA, 953 bp, Homo sapiens
  misc_feature: GYAE6OF02HKPSP.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagagtggtcctgtcccaggtgcagtctgcgaggacggtccgggcccaggaccgtggtagaacgtcccttacgaccgtacgtacccctcgtaccctccgtaccgtgacctacttcgttccttacggttcggtaccggtcccttaccgtagtacggacgtacggtagggttcggggtttacgtttaaccgttaacggtgggttaagggttcgtaccgtccccgccgtaaccgcccgaaacccggtaggggaccggtaccgtggggtaacggttgggtacgttacgggtacaacgttcgtttaaccgtacgggtggtaaccggggtaaccgaccccgttaacgtaaccccctaccccggttaccctaccgaaaggtaccgtacccgttaacctttaccgaacgtacgttacgtaaacgtaaccgtaacgtaacccggttaacctaaaacggttaccctaaccggttacccgtaccgtacgtaaacgtcggttacgacgttacgttaccggtagtaccggtaccgtaccggtacccggtacggtaccccggtacgggttacccggtttaacggttaccggtttaaccggttaccggtaccgggtaaccgtaacggtttaaccgtaaccgtttaacccccgttttaaggttacggggtttaccggggtttaacggggttttaacgttttaaggttttaaacgtttaaccggtttaccggtttacggttttaacccgttttacggtttaacggtttacggttttaacggggttaacccgggtaaccggggtttaaacggtacccggttaaagggtttacccccggg

SEQ ID NO: 22218 - DNA, 785 bp, Homo sapiens
  misc_feature: GYAE6OF02HXLP6.35.3.A03.1.454.CMB.1.raw
  modified_base (164)..(164): a, c, t, g, unknown or other
  misc_feature (164)..(164): n is a, c, g, or t
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (395)..(395): a, c, t, g, unknown or other
  misc_feature (395)..(395): n is a, c, g, or t
tcagtacagatcgtcacgaccggtgctcgatttagagagcgtcacagggtctgtgaaggcttcaccagtcctggacctctgtgacaagaacatacgaaacacctggttcggttcttcctcctgcgtgggtggcagcctaccagagtgggtcctcgtcccaggtncgagtctcggcgaggtacggtccgggaccgaggtacgtggtacgaacgtcctacacggacgtcctcgtcctcacgtcgctacgttcgtcgtcgtcggtcgactctagngacgcgtggtcgttacgttacngtaggagtcgcgtcagcgacgacggaggacgtcgngngtagtcgtagtactatcgtaagtagaggtcggaaccgaactccggaacctacccgtaccgtaanaacggtaccgtactaacctaacgtaagtacgacggtaaacgtaccgaacgttaacgtaaccgaaccgttaacctcggtttaccctacggttaacgacgtcgtaggttaaccggctttaacggtcgggttaaaccgccggtaccggtaacgacccgggtaacccgtttagggtctttaaacggttcgttaaaccgggtcggttaacggaccgttaacggtacccggtttaaccttaccggtttaaaggtacgggttttgggggttaaaccggttaatttaacgtttaacggttaaacgttcggttccggtaaccggttttaagttaacccggtttggtaaccccggggttagggttaaaaccccgggtagggtactttaccccggggttac

SEQ ID NO: 22219 - DNA, 769 bp, Homo sapiens
  misc_feature: GYAE6OF02I2WFW.35.3.A03.1.454.CMB.1.raw
  modified_base (213)..(213): a, c, t, g, unknown or other
  misc_feature (213)..(213): n is a, c, g, or t
tcagtacagatcgtcacgaccggtgctcgatttagagagcgtcacagggtctgtgaaggcttcaccagtcctggacctcctgtgcaagaacatagaaacacctgtggttcttcctcctgctggtggcagctcccagatgggtcctgtcccaggtgcagctgcaggaggtccgggccaggctgggtgacgccttacacgacgaccctcgtcccncgacctgccacttcgtcttcggtcgggcggtcctaccgagtcggacgagtacggttcgggttacgttacgttacggtaggtacgttcgggactccccgacgacgaccgaaccgggaagggggacggtccggtagggaggtcggggtaacgttcgggtaactactacgtttaacgtacggaacgggtcggggtaaccggtaaccctaaccgtaacccgaaccccgtacccgtacgaaaaggttccgttaacccggttaaaccttaaccgaagttaacgttaacgacggttaaccgaacccgttaaacgttaaccgtaaaacgaaccgttaccggttaccctaacccggtaagtaaaccggtcgtacggtacggtacttcgtacgtacggtacgtcggaccggttaccgaccggtaccggtacgttacgttacgttacggtgtcggtacgtaggtaacttacgtaccttagtacggttcgggttagttattaagttacgtaagttcgtacgtcgttacgtttagtacgttaggtaccggtagaacggtgtacgtacgg

SEQ ID NO: 22220 - DNA, 904 bp, Homo sapiens
  misc_feature: GYAE6OF02IDRUP.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgctggtggcagctcccagagtgggtcctgtcccgaggtgcagctgcgaggacggtccgggcccgaggacgtgggtagaacgccttcacacgaccctcgtccctccaccgtgcacttcgttcctcgttcgggtcggcctcacgtgagcgtagggttggttcggtttacttacggtgggtaggtttggaccgtccgacgacgaccgaccggaaggggacggccgttaggggcggttacgggtaggttacgggtacttacgttaccgttaacgttacggagggttaacggggaacccggtaacccctaaccgtaaccccgtaaaccccgttacccgtaacgtaacggtaccggttaccgttaaccttaaccgtaacgtataccgtaaggtaacccgaaccgttaaccgtaaaccgtaaaccgtaacccgttacgttttacccgtaacccgttaaggaaaccggttccttaaggaccggttaccttcggttacgggtaccgtaccgggttcccggacccggggtaccggtaccccgggttaacgggttcccgttaaggtttaacgttaccgggtttcgggacggccgggtaaagtaccggttaacctttaccgtttagggttaacgggtttaccgggggtttaagggttacgtttttaaacgttacgtttaaacggttaccgtttaccgggtaccttttttaggttttaaaccggtttcggttttaacgggggttacccgggggtaaacccgggtttaaacgggtacccgtttaaaggggtttcccccggg

SEQ ID NO: 22221 - DNA, 880 bp, Homo sapiens
  misc_feature: GYAE6OF02IM4HU.35.3.A03.1.454.CMB.1.raw
tcagtacagatcgtcacgaccggtgctcgatttagagagcgtcacagggtctcgtgaaggcttcacccagtcctggacctcctggtgcaagaacactgaaacacctgtggttcttcctcctgctggtcggcagctccagatgggtcctcgtccaggtgcagctgaccaggacgtaccggcccaggactggtacgaacgtccttcacacgtaccctgtccctctaccgtgccacgtcgtctacgtcggtcggcctccgatcgacgacgtaggttaggttcggttaactacgtacgggtgttacgaccgtcccgaccgaacgtcccggaacccggaaggggtaacggtccgtaggggtaaggtacgggtagtttacgggtaacctaagttacgttaacgttacgtagggtacggggaccgtaaccccgaaccgttaaccaaccccgttaccgtaccgaaaacgtacgtaacccgtaaccgtttaactactaacgtaccgtaaggtaacccgtaaaccgtacgttaaccgaaaccgttaaacccgtaccgtttacccggttaaccgtaaaccggtaaccgttaaccggtaacgtaccggtaccgttcgttaccggtttacggaaccggttcccgggtaacccggtaccggaaaccgtccgggggttaaccgttacgtttaaccgttaaccgttcgggtaacgaacccggtaagttaaccgggtaaccttttaccggtaaacgttcgggtttaaggggtttaccgggttagttttaacgtaacgttttaacggtttaaccgttaccgggttcctttaaggttttaccggtaacggtttacggttaccgggtaccggaaacgggttacgtaacggttaaccccgg

SEQ ID NO: 22222 - DNA, 784 bp, Homo sapiens
  misc_feature: GYAE6OF02JNTO2.35.3.A03.1.454.CMB.1.raw
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
tcagtacagatcgtcacgaccggtgctcgatttagagagcgtcacaggggcagcttcagctgtgggtagagaagacaggactcaggacaatctccagcagtggccagcttccctctcctcctcaccctcctcactcgactgtgcgacggtcctcgggaccctagtcgtggtggtacgactcagccaccctcgacgtcgcgggaccccggnacggacggtcactctcttcttgtcgtggacncagcctacgaatcgtacggtaactacttaacgaggtaaacgtcggtacagtcgaccgtactaccccggaaggacccgaccccaaactccgttacacttactaataaactaaacttcgaccgacggccgtacccctagaaccgggttccgtccgtacgttaaaccggcttttcgtccgttaacggcccgttaaacgtacgttacggtcggtccctccgttaaccgccggtaccccgttaccgccggtacctaccgtaccggtacggtccgggtacccttaccggtacggtaccggttacgggaacgtaaccgggtacgggtaaccgggttaccgttacgttaaccggtttacgtaacccgtaaggtccggttaaccgacggacctttaggacggtacgggttaactacggtaacccggtagtaaccggtggttaaccgggtggggtttacgggttcgggttaacgggaccgggttaagggaaccggaccgttacgttacccgggaccggttaccggtacgtacccggacgtacccgggtaccgg

SEQ ID NO: 22223 - DNA, 781 bp, Homo sapiens
  misc_feature: GYAE6OF02I42CS.35.3.A03.1.454.CMB.1.raw
tcagtacagatcgtcacgaccggtgctcgatttagagagcgtcacagggtctgtgaaggcttcaccagtcctggacctcctgtgcaagaacatgaaacacctgtggttcttcctcctgcgtggtggcagctccagagtggtcctgtcccaggtgcagctgcaggcgtcgggccaggtactggtagaacgcctttacaccaagacccgtgtccctcgacctcgcactgtctacgtgtacgtctccataggatcgaggtggttacgtaaccgttacgtcgggtaacgttcggagttccccgagaccgtaccgaccgtaaacgggggtaacggtccccgtaaaggtcggtttacgggtagttaccggggttaacctacggttacctaattaacccggttaagggtacggggaaccggtaaccccgaaaccgttaaaccgtaacccccggttacgtaacgtaaaacggggtcttaacggtaaccttaacgtaaacttcgacctaaacggttgaaactaccggttaaaccgaggtaaacccgtacgtttcctaccgtaggtaaacggtcttacggactacgtacgtaggttactacgcgtaccggacgacgtaaccgcgttaacgttagttacgcgtacgacgtaggtacgtaacttccgtaataccgggtaggttaccgggttacgttaaacggttaactttaattaccgttacggtacgtttacgtttaacggttacggttttacggtacggggttaaccgaacgggttacgttacggtaacgg

SEQ ID NO: 22224 - DNA, 249 bp, Homo sapiens
  misc_feature: GYAE6OF01DYFIL.41.38.D05.1.454.CMB.1.raw
  modified_base (240)..(249): a, c, t, g, unknown or other
  misc_feature (240)..(249): n is a, c, g, or t
tcagtctatactatcacgaccggtgctcgatttagtatctgatagttgggtttggggagttgcatactactactacggtatggacgtctgggccaagggaccacggtcaccgtctcctcagcttccaccaagggcccatcggtcttcccctggcgccctgctccaggagcacctctggggcacagcggccctgggctgcctggtcaaggactgtctgagcgggctggcaaggcgcatagnnnnnnnnnn

SEQ ID NO: 22225 - DNA, 262 bp, Homo sapiens
  misc_feature: GYAE6OF01EI9Y7.41.38.D05.1.454.CMB.1.raw
  modified_base (256)..(262): a, c, t, g, unknown or other
  misc_feature (256)..(262): n is a, c, g, or t
tcagtctatactatcacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccatgagcacctctggggcacagcggccctgggctgcctggtcaaggactacttcctatatactgtctgagcgggctggcaaggcgcatagnnnnnnn

SEQ ID NO: 22226 - DNA, 628 bp, Homo sapiens
  misc_feature: GYAE6OF01D8TKE.41.38.D05.1.454.CMB.1.raw
  modified_base (282)..(282): a, c, t, g, unknown or other
  misc_feature (282)..(282): n is a, c, g, or t
tcagtctatactatcacgaccggtgctcgatttagtatctgatagttgggtttggggggaagaggaagactgacggtcctcccaggagttcaggtgctgggcaccttgggcacgggggaggcttagttcagcctggggggtccctgagactctcctgtgcagcctctggattcaccttcagtagctactggatgcacgtgggtccgccaagcctcgaggggagggtctggtgtggtctcacgtattaagtgtgagtgggagtagcacagctacgcgactcgngaacggctatcacatcaccagacacacgaccaagacacgctagtactctagactaaatcgaactgtactagagacgccggaggacgcggtctgtagtactacgtggtagacgaaggtcggccgggtggacgggtaggttcggggacttcgactaacgttactacgttacggtacggttagtacgggtacgtcgggtacgggaccgacgggaccctcggtaccaccgttcctacgtacaccgtcctaccgaaccggtaccggccctacggttcccggttccccctcccggtcggcccgtcccgtcgccctaccggacggccgaccctaccggtcgggacgggtaccc

SEQ ID NO: 22227 - DNA, 339 bp, Homo sapiens
  misc_feature: GYAE6OF02IP4F8.41.38.D05.1.454.CMB.1.raw
  modified_base (269)..(272): a, c, t, g, unknown or other
  misc_feature (269)..(272): n is a, c, g, or t
  modified_base (274)..(280): a, c, t, g, unknown or other
  misc_feature (274)..(280): n is a, c, g, or t
  modified_base (282)..(339): a, c, t, g, unknown or other
  misc_feature (282)..(339): n is a, c, g, or t
tcagtctatactatcacgaccggtgctcgatttagtatctgatagttgggtttggggaggttgcatactactactacggtatggacgtctggggccaagggaccacggtcaccgtctcctcagccttccaccaagggccctatcggtcttccccctggtccgccctgctccagggagccaccgtctgggggcacagcggccctgggctgcctggtcaaggctacgttcctatatacgtgtctggacgcgggctggccaaggcgcatagnnnntnnnnnnnannnnnnnnnnnnnnnnnnnnnnnnnnnnnnnnnnnnnnnnnnnnnnnnnnnnnnnnnn

SEQ ID NO: 22228 - DNA, 262 bp, Homo sapiens
  misc_feature: GYAE6OF02G4K6M.41.38.D05.1.454.CMB.1.raw
  modified_base (257)..(262): a, c, t, g, unknown or other
  misc_feature (257)..(262): n is a, c, g, or t
tcagtctatactatcacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnn

SEQ ID NO: 22229 - DNA, 568 bp, Homo sapiens
  misc_feature: GYAE6OF02FP3EA.41.38.D05.1.454.CMB.1.raw
tcagtctatactatcacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatgggacgtcgtggggccaagggaccacggtcaccgtctcctcagcttccaccaagggcccagtcggtccttcccctggccgccctcgcctcccgaggacgccgaccgtcgtcggggccacgacgccggcccgtggggcctcggcccgttgggtccgaacgggtaccttaccgtttcccaccggttcttaccgtgtaccg

SEQ ID NO: 22230 - DNA, 769 bp, Homo sapiens
  misc_feature: GYAE6OF02IRQR0.41.38.D05.1.454.CMB.1.raw
  modified_base (289)..(289): a, c, t, g, unknown or other
  misc_feature (289)..(289): n is a, c, g, or t
tcagtctatactatcacgaccggtgctcgatttagtatctgatagtggagtccgggggaggcttagttcagcctggggggtccctgagactctctgtgcagcctctggattcaccttcagtagctactggatgcactgggtccgccaggctccgagggaagggctggaggtgggtctcgagtctatttatactggtgtatttcacatactacgcagactccgtgaagggccattcacatcctccgaggacattaccgaaggaactacgtttatctacaaatgaactacngagagcgacgacgacggcctatacttactgtcgcgacgtacgaaggtcggacgtcgtacgggtaggttgggtttatttacgtttcggttttagtaccgtttccggtcgggggtacccaaacggggtaccctagggtccctacccggtccgccccgtcccgtcccctaccgaacccgacgggccctacgttcccggttccccgttccccgtcgggtacccctaccccgttcccgtacccgtaaacggaccgtcccgtaacccgtccgggtccggggacctaaccgaccggtcccgggtaccccggttcggggtcccgttaccggtcccggttccgggttaaccggtaaacggttaacccgtttacccgtttacccgttaacgtttacccgttaaccgttccggttaaccgttacggggtacccggtacggggttaccgttaccgggacggtaaaccgggtccggtaacgtacgttacggcg

SEQ ID NO: 22231 - DNA, 608 bp, Homo sapiens
  misc_feature: GYAE6OF02F1I36.41.38.D05.1.454.CMB.1.raw
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (540)..(540): a, c, t, g, unknown or other
  misc_feature (540)..(540): n is a, c, g, or t
tcagtctatactatcacgaccggtgctcgatttagtatctgatagtggagtccgggggaggcttagttcagcctggggggtccctgagactctcctgtgcagcctctggattcaccttcagtagctactggatgcactgggtccgccaagctccagggaagggctggtgtgggtctcacgtattaatagtgagtgggagtagcacaagctacgcggactccggtgaacgggccgattccacatcctccagacgacaaccgccaagaaccacgctgtactctgacaaatgaacngtctgagcgcgagacncggctgtgtattacngtgagaagcggtccgggnggcgggtagggtttcggggagttcgactaacgttacgtactacgtaagggttatcgggtacgttcggtacgggggaccgaacgggaccgacggtccgtaccgtcctcctcgacgtccttaccgacccgaacgggccacgttccggttcccttccccgtcgccgtccctcgccgtcgacgacgccgccgtcgcgggacncgacgtccggccgtcggcgtcgccgtcggtacgaacggtacttacgttccgtacgtcttacgtgtcgg

SEQ ID NO: 22232 - DNA, 191 bp, Homo sapiens
  misc_feature: GYAE6OF01AK4ZQ.12.40.D07.1.454.CMB.1.raw
  modified_base (190)..(191): a, c, t, g, unknown or other
  misc_feature (190)..(191): n is a, c, g, or t
tcagatacgacgtacacgaccggtgctcgatttagtgatagagcgtaacaacagaggactcaccatggagttggctgagctgggtttcctcgttgctccaggagcacctccgagagcacagcggccctgggctgcctggtcaaggactacttcctacgtcgtatctgagcgggctggcaaggcgcatagnn

SEQ ID NO: 22233 - DNA, 192 bp, Homo sapiens
  misc_feature: GYAE6OF01BT240.12.40.D07.1.454.CMB.1.raw
  modified_base (192)..(192): a, c, t, g, unknown or other
  misc_feature (192)..(192): n is a, c, g, or t
tcagatacgacgtacacgaccggtgctcgatttagtgatagagcgtaacaacagaggactcaccatggagtttgggctgagctgggtttcctcgttgctccaggagcacctccgagagcacagcggccctgggctgcctggtcaaggactacttcctacgtcgtatctgagcgggctggcaaggcgcatagn

SEQ ID NO: 22234 - DNA, 540 bp, Homo sapiens
  misc_feature: GYAE6OF01D21LX.12.40.D07.1.454.CMB.1.raw
  modified_base (361)..(361): a, c, t, g, unknown or other
  misc_feature (361)..(361): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttanctgcaaatagacagcctgagaccagacgacacggctgtctattattgcgcgagagagacacacgaacctactggccaatactaagtgggggcttgttcgtggggccagggggaccctggtcatcgtctccccagcctccaccaaggcccagtccggtccttccccctggccgcccgtcg

SEQ ID NO: 22235 - DNA, 580 bp, Homo sapiens
  misc_feature: GYAE6OF01AZUVN.12.40.D07.1.454.CMB.1.raw
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
tcagatacgacgtacacgaccggtgctcgatttagtgatagagcgtaacaacagagggctcaccatggagtttgggctgagcggtggtttcgcgtaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcattatgcacatgatggctcaacaattcacgcaaattccgngaggggccattcaccatctcagagacaattacaagaacnccctttanctanacaatagacagcctagaacgaccagaccgacgacgtctgtactattagtcgcgacgagagacgacaacgaaccgaacctacgtacgacctaagtacgtaggtcggggtcttggttcggtcggggaccgtacgggtaccgtggtactacgtccgtccctcccgacgtccctaccgaccgaccggccctacgtcccggttcccttccccgtcggcccgtcccgtcg

SEQ ID NO: 22236 - DNA, 194 bp, Homo sapiens
  misc_feature: GYAE6OF01A9JFG.12.40.D07.1.454.CMB.1.raw
  modified_base (192)..(194): a, c, t, g, unknown or other
  misc_feature (192)..(194): n is a, c, g, or t
tcagatacgacgtacacgaccggtgctcgatttagtgatagagcgtaacaacagagggctcaccatggagtttgggctgagctgggtttcctcgttgctccaggagcacctccgagagcacagcggccctgggctgcctggtcaaggactacttcctacgtcgtatctgagcgggctggcaaggcgcatagnnn

SEQ ID NO: 22237 - DNA, 541 bp, Homo sapiens
  misc_feature: GYAE6OF01BDNJD.12.40.D07.1.454.CMB.1.raw
  modified_base (361)..(361): a, c, t, g, unknown or other
  misc_feature (361)..(361): n is a, c, g, or t
  modified_base (530)..(530): a, c, t, g, unknown or other
  misc_feature (530)..(530): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttanctgcaaatagacagcctgagaccagacgacacggctgtctattattgtgcgagagagacacacgaacctactggaccaatactagtggggcttgttcgtggggccaggggccctggtcatcgtcctccccgagccctccgaccacggcccagtccggtccttcccccgnggccgccctcg

SEQ ID NO: 22238 - DNA, 533 bp, Homo sapiens
  misc_feature: GYAE6OF01A73PR.12.40.D07.1.454.CMB.1.raw
  modified_base (489)..(489): a, c, t, g, unknown or other
  misc_feature (489)..(489): n is a, c, g, or t
  modified_base (523)..(523): a, c, t, g, unknown or other
  misc_feature (523)..(523): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtggggcttgtctggggccaggggaccctggtcatccgtctccccgngccctccaccacgggcccatccggtcttccccgngccgccctcg

SEQ ID NO: 22239 - DNA, 537 bp, Homo sapiens
  misc_feature: GYAE6OF01BR83X.12.40.D07.1.454.CMB.1.raw
  modified_base (524)..(524): a, c, t, g, unknown or other
  misc_feature (524)..(524): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttggttctggggccaggggaccctggtcatcgtctccccagcctccaccacgggcccagtccggtcttccccgnggccgccctgccc

SEQ ID NO: 22240 - DNA, 535 bp, Homo sapiens
  misc_feature: GYAE6OF01AIO4O.12.40.D07.1.454.CMB.1.raw
  modified_base (489)..(489): a, c, t, g, unknown or other
  misc_feature (489)..(489): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctgggccaggggaccctggtcatcgtctccccgngccctccaccacggccccacgtccggtctccccctggccgccctcg

SEQ ID NO: 22241 - DNA, 599 bp, Homo sapiens
  misc_feature: GYAE6OF01CDSIP.12.40.D07.1.454.CMB.1.raw
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
tcagatacgacgtacacgaccggtgctcgatttagtgatagagcgtaacaacagaggactcaccatggagtttgggctgagcgtggtttcgtcgtaggctctttaagaggtgtccagtgtcaggggcacctggtggagtcgtgggggagccgtggtccagcctgggccggtccctgacactcgcctgtgttgcctctggtactttcccttctaattttctattccatgcacgtgggtccgccaggctccgaggcgaaggggctggagtggggtgcacttatgcanatgatggctnaacaattcacgctaaattccgngagggccattcaccatcgcaganacaataacgaacaactacctttanctanactaatagacacncagacgacagacgacacgtctgtacttattagtgcgagaagagacgaccaacaccgaacctacgacgaacctaacgtacgtagggtcgggttcgttcggttcggtcgggaccggtacgggtaccgtcgtacgtaccgtccgtcccgacccgtacgtcccctacccgacccggaccggtccctaccgtcccgttcccgttaccccgcgtcccgccgtcg

SEQ ID NO: 22242 - DNA, 544 bp, Homo sapiens
  misc_feature: GYAE6OF01CC23A.12.40.D07.1.454.CMB.1.raw
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtggggtggcacttattgcacatgatggcgtcaacaaattctacgcaaaattccgtgaggggccattcaccatctccagagacaatacaagaacacctttanctgacaaatagacagcctagagaccagacgacacggctgtctatattgcgcgagagagacacacgaacctactcggacaatactagtggggcttgtcgtgggccaggggaccctggtcatccgtctccccgcgccctccaccaacgggcccacgtccggtccttcccccgcggccgcccgtccg

SEQ ID NO: 22243 - DNA, 869 bp, Homo sapiens
  misc_feature: GYAE6OF01D10Y7.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggatttcccttcaatttctattccatgcactgggtccnccaggctccaggcaaggggctcggaggtgggtggcacttattgcacatgatggcgtacaaactaaattctaacgactaaaagtttcccggtaggacgggggcccgtaatttccaacccgaattcctacccaaggaacgaaacctaaaactttaaccaaaacggtaaaccctaaccccctttttaatacccttaggaacctaaaaagttaacggaaccaacggtcccctaggaaacggaaccccaaaggaacccggaacccgaaccgggtaccttacggttaccctttaagttttaacgtttcggaccggtaaccggaaacggaacgggaacggaaacccaaaccgaaacccggtaaacccgttaacccgtacgggaacccctaaaagttaaccgttaacggttacgggggggttacccttttacgggttttaccggttaccggggggtaccccggtaaccgggggggtacccccgttcggggttacctaaccggttcccggtacccgttaccccccgtaccggtacccccttaccccgaaaccccggtaaacccggggtcccccctaaaccggttccccgggttacccccgtttccccccccggttcgggtcccccggtcccccgttacccggg

SEQ ID NO: 22244 - DNA, 214 bp, Homo sapiens
  misc_feature: GYAE6OF01AYV00.12.40.D07.1.454.CMB.1.raw
  modified_base (194)..(214): a, c, t, g, unknown or other
  misc_feature (194)..(214): n is a, c, g, or t
tcagatacgacgtacacgaccggtgctcgatttagtgatagagcgtaacgaacagaggactcaccatggagtttgggctgagctgggttttcctcgttgctccaggagcacctccgagagcacagcggccctgggctgcctggtcaaggactacttcctacgtcgtatctgagcgggctggcaaggcgcatagnnnnnnnnnnnnnnnnnnnnn

SEQ ID NO: 22245 - DNA, 560 bp, Homo sapiens
  misc_feature: GYAE6OF01B32LD.12.40.D07.1.454.CMB.1.raw
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
tcagatacgacgtacacgaccggtgctcgatttagtgatagagcgtaacaacagagggctcaccatggagtttgggctgagcggtggtttcgctaggctctttaagaggtgtcagtgtcaggggcacctggtggagtctgggggagccgtggtccagcctgggcggtccctgacactcgcctgtgttgcctctggtatttcccttcaatttctattccatgcactgggtccgcaggctccaggcaaggggctgagtgggtgcattatgcacatgatggctacaacaaattctacgcaaattccgngaggggccattcaccatcgcaganacaattacaanactaccttanctagacaatanacanactgagacagacgacacggctgtctattattgcgacgagagagacacaacgaactactagacgaactactaagtgggtcgtcgttcgtcgggtcgacgggaccgtcggtcgtacgtcgtccgtacccgccgtacctaccgacccgaacggacccgacgtaccgtcccgttaccccgtccggtccgcccgtcccgg

SEQ ID NO: 22246 - DNA, 541 bp, Homo sapiens
  misc_feature: GYAE6OF01BYUOG.12.40.D07.1.454.CMB.1.raw
  modified_base (360)..(360): a, c, t, g, unknown or other
  misc_feature (360)..(360): n is a, c, g, or t
  modified_base (530)..(530): a, c, t, g, unknown or other
  misc_feature (530)..(530): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttanctgcaaatgacagcctgagaccagacgacacggctgtctattattgcgcgagagagacacacgaacctactggaccaatactagtggggtcttggttctggggccaggggaccctggtcatccgtctccccgagccctccgccaacgggcccagtccggtccttcccccnggccgccctcg

SEQ ID NO: 22247 - DNA, 562 bp, Homo sapiens
  misc_feature: GYAE6OF01BFKJX.12.40.D07.1.454.CMB.1.raw
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaacaaattctacgcaaattccgtgagggccattcaccatctccaganacaattacaagaacacctttanctgacaaatagacagcctgacgaccagacgacacggctgtctattattgcgcgagagagacacacaaacctactgaccaatactagtaggggtcttggttcgtcggggaccgacggggaccctggtcgacgtccgtaccgtccccgacgccctaccacccgaacgggccccacgtccgtaccttcccccgtggcccgtcccgtcg

SEQ ID NO: 22248 - DNA, 194 bp, Homo sapiens
  misc_feature: GYAE6OF01BOR7E.12.40.D07.1.454.CMB.1.raw
  modified_base (193)..(194): a, c, t, g, unknown or other
  misc_feature (193)..(194): n is a, c, g, or t
tcagatacgacgtacacgaccggtgctcgatttagtgatagagcgtaacaacagagggctcaccatggagtttgggctgagctgggttttcctcgttgctccaggagcacctccgagagcacagcggccctgggctgcctggtcaaggactacttcctacgtcgtatctgagcgggctggcaaggcgcatagnn

SEQ ID NO: 22249 - DNA, 564 bp, Homo sapiens
  misc_feature: GYAE6OF01C4DI8.12.40.D07.1.454.CMB.1.raw
  modified_base (312)..(312): a, c, t, g, unknown or other
  misc_feature (312)..(312): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaaacaaattctacgcaaattccgngaggggccattcacatctcagagacaattacaaagaactaccctttatctagacaaaatagacagcctgagaccagacgacacggctgtctattattgcgcgagagagacacacgaacctactggaccaaatactagtgggggctttgttcgtggggccaggggccctgggtctatccgtcctccccgacgccctaccaacccgaacgggccccacgtccggttacccttcccccgtggcccgtcccctcgg

SEQ ID NO: 22250 - DNA, 808 bp, Homo sapiens
  misc_feature: GYAE6OF01B0Z5M.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacaggagggctcaccatggagtttgggctgagctgggttttcctcgttgctcttttaagaggtgtccagtgtcaggggcacctggtggagtctggggggagccgtggtccagcctgggcggtccctgacactcgcctgtgtgcctctggatttcccttcaatttctattccatgcactgggtccnccaggctccaggcaaggggctcggagtgggtgctacttatgcacatgatggctacaaactaaattcacgactaaagttccggtggaacgggggccctaatttccaaccctaattccctaccgaaggaacgtaacctaaactttaaccgaaacgtaaacccttaccccttttaagtcccttagaacctaaaaagttacgggaacctaacgtaccccgtaggaaacggaaccccgaaaggaaacggaaccgaaccgggtaccttacggttacctttaacgtttaacgtttcggaccgggtaacggaaacgggaaaggaacgggtaaacctaaccgaaacccggtaaacccctttaaccggtacgggtaacccctaaaagttaacgtaacggttaccggggggttacttttacgggtttccggtacggggggtacccgtacggggggtaccccttgggtacctaccggttcccgtacccgtcccccgacggtccccctaacccgaacccggaaccgggtccccctaacggttccccgggttaccccttacccccgcgggtccccgtccccgtaccg

SEQ ID NO: 22251 - DNA, 556 bp, Homo sapiens
  misc_feature: GYAE6OF01BSKNN.12.40.D07.1.454.CMB.1.raw
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacacctttanctgacaaatagacagcctgacgaccagacgacacggctgtctattattgcgcgagagagacacacgaacctactcggaccaatactagtggggtcttggttcgtggggccaggggaccctggtctacgtccgtcctccccgacgccctcccaccgacggcccacgtccggtccttcccccgtcggccgtcccgtcg

SEQ ID NO: 22252 - DNA, 560 bp, Homo sapiens
  misc_feature: GYAE6OF01ATA4V.12.40.D07.1.454.CMB.1.raw
  modified_base (316)..(316): a, c, t, g, unknown or other
  misc_feature (316)..(316): n is a, c, g, or t
  modified_base (364)..(364): a, c, t, g, unknown or other
  misc_feature (364)..(364): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagccctgggcggtcccggtgacgactacggcctgtagttgcctctggatttcccttcaatttctattccatgcactgggtccgccaggctccaggcaaggggctcgagtgggtgcacttatgcacatgatggcgtcaacaattcacgcaaattccgngaggggccattcaccatctccagagacaattacaagaacaccctttanctgacaaatgacagcctgacgaccagacgacacggctgtctattatgcgcgagagagacacaccgaacctacgtacggaccaatactagtcggggtcttcggttcgcggggtccacggggtaccctggtctacgtccgtcctaccccgacgccctccgaccgacggcccacgtccgtcctccccgcgccgccctcg

SEQ ID NO: 22253 - DNA, 572 bp, Homo sapiens
  misc_feature: GYAE6OF01ELJJ4.12.40.D07.1.454.CMB.1.raw
  modified_base (438)..(438): a, c, t, g, unknown or other
  misc_feature (438)..(438): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccaccaggctccaggcaaggggctcgagtgggtggcacttatgcacatgatggcgtcaacaaattctaacgcaaattccggtgaggggccattcaccatctccagagacaattacaagaactaccctttatctagacaaatagacagcctagagaccagacgacacggctgtctattattgcgcgagagagacacacgaacctacncggaccaatactagtggggtcttggttcgtcggggccacggggaccctggtcacgtccgtcctccccgacgccctacccgacccgaacgggccccacgtccggttcccttccccccgtggtcccgcccgtccgg

SEQ ID NO: 22254 - DNA, 586 bp, Homo sapiens
  misc_feature: GYAE6OF01B0P0I.12.40.D07.1.454.CMB.1.raw
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
  modified_base (441)..(441): a, c, t, g, unknown or other
  misc_feature (441)..(441): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggatttcccttcaatttctattccatgcactgggtccgccaggctccaggcaaggggctcggagtggggtgcacttatgcacatgatggctacaacaaattcacgcaaattccgtgagggccattcacatctcaganacaattacaaagaactacctttaanctagacaaatagacacgcctagaacgaccagaccgacacggctgtcttaattattgacgcgaagagagacacacgaactacngacaatacgtagtcggggtcttgtcgtcggggaccgacggggaccctggtctacgtccggtccctaccccgacgtccctacccgaacccgaacgggccccaacgttcccggttccccttaccccgtcgggcccgtccccgtccgg

SEQ ID NO: 22255 - DNA, 580 bp, Homo sapiens
  misc_feature: GYAE6OF01AXHZ7.12.40.D07.1.454.CMB.1.raw
  modified_base (359)..(359): a, c, t, g, unknown or other
  misc_feature (359)..(359): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattcacgcaaattccgtgaggggccgattcaccatctccagagacaattacaagaacacctttanctgacaaatagacagcctagacgaccagacgacacggctgtctattattgcgcgagagagacacacgaacctactcggaccaatactagtcggggtcttggttcgtcggggccgacggggtaccctgggtccacgtccgtcctccccgacgtcccctaccgacccgaacgggcccctaacgtcccggttcccttaccccccgtcggccccgtcccgtccgg

SEQ ID NO: 22256 - DNA, 571 bp, Homo sapiens
  misc_feature: GYAE6OF01DF857.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttccttcaattttctattccatgcactgggtccgccaggctccaggcaagggctcgagtgggtggcacttattgcacatgatggcgtcaacaaattctacgcaaattccgtgaggggccattcaccatctcagagacaattacaagaacaccctttatctgacaaatgacagcctagacgaccagacgacacggctgtctattattgcgcgagagagacacacgaacctactggaccaatactagtggggacttgttcgtggggccaggggaccctggtcacgtccgtcctccccgtagtccctaccgacccgtaacggggcccccaagttcccgggtcccttccccccggtgggcccgtcccccgtccgg

SEQ ID NO: 22257 - DNA, 603 bp, Homo sapiens
  misc_feature: GYAE6OF01D3ICX.12.40.D07.1.454.CMB.1.raw
  modified_base (150)..(150): a, c, t, g, unknown or other
  misc_feature (150)..(150): n is a, c, g, or t
  modified_base (234)..(234): a, c, t, g, unknown or other
  misc_feature (234)..(234): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
tcagatacgacgtacacgaccggtgctcgatttagtgatagagcgtaacaacgagagggctcaccatggagtttgggctgagctgggttttcctcgttgctcttttaagaggtgtccagtgtcaggggcacctggtggagtctggggganccgtggtccagcctgggcgtccctgacactcgcctgtgttgcctctggatttcccttcaatttctattccatgcactgggtccnccaggctccaggcaaggggctcggagtgggtgcacttatgcacatgatgggctcaacaaattctacgcaaattccgtgagggccattcaccatcncaganacaatacaagaacncctttanctgcaaatgactagcctagagaccagaccgtacacggctgtctattattgcgcgagagacgacacacgtaacctacgtacggacccaataaccgtaagttacggggggctttgggttccgtacgggggcccagggggtaacccccgttgggtacccgtaacgttccggtacccgtcccccgtaacgccccgttacccgacgggacgacccacccgtaccggacgaacgccgaaccgtagggccccggg

SEQ ID NO: 22258 - DNA, 553 bp, Homo sapiens
  misc_feature: GYAE6OF01A9J85.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagacccagacgacacggctgtctattattgcgcgagagagacacacgaacctactggaccaatactatgggggctttggttcgtggggccaggggaccctgggtcagtcgtcctccccgagccctccaccgaacgggcccacgtccggtccttcccccgtcggtccgcccctcg

SEQ ID NO: 22259 - DNA, 570 bp, Homo sapiens
  misc_feature: GYAE6OF01C4ITZ.12.40.D07.1.454.CMB.1.raw
  modified_base (556)..(556): a, c, t, g, unknown or other
  misc_feature (556)..(556): n is a, c, g, or t
tcagatacgacgtacacgaccggtgctcgatttagtgatagagcgtaacaacagagggctcaccatggagtttgggctgagcgtggttttcgtcgttgctcttttaagaggtgtccagtgtcaggggcacctggtggagtctggggggagccgtggtccagcctgggcggtccctgacactcgcctgtgttgcctctggattttcccttcaattttctattccatgcactgggtccgccaggctccaggcaagggggctcggagtggggtgcacttatgcacatgatggcgtcaaacaaattctacgcaaaattccgtgaggggccgattcaccatctccaagagacaattacaaagaactaccctttatctagacaaaatgacagcctagagaccagacgacacggctgtctattatgcgcgagagagacacacgaacctactggaccaagtactaagtggggtcttagttcgtgggccgaggggtaccctggtccagtccgtcctccccgagccctccgaccgaacgggccccagtcccgggtccttcccccgnggcccgcccgtcgg

SEQ ID NO: 22260 - DNA, 581 bp, Homo sapiens
  misc_feature: GYAE6OF01CUW96.12.40.D07.1.454.CMB.1.raw
  modified_base (235)..(235): a, c, t, g, unknown or other
  misc_feature (235)..(235): n is a, c, g, or t
  modified_base (365)..(365): a, c, t, g, unknown or other
  misc_feature (365)..(365): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtatttcccttcaatttctattccatgcactgggtccnccaggctccaggcaaggggctcggagtgggtggcacttattgcacatgatggctacaacaaattctaacgcaaattccgagaggggccattcaccatctccagagaacaattacaagaactaccctttanctagacaaatagacagtcctagagaaccaagaccgacgacggctgtactattatgcgcgagagagacacacgaactacgtcgacaatacgtagtggggtacttggtacgtcggggccaggggccctggtcctacgtccgtcctccccgacgtccctacccgaccgaccgggtccccacgttcccggttcccttcccccgtcggcccgtcccgtcgg

SEQ ID NO: 22261 - DNA, 812 bp, Homo sapiens
  misc_feature: GYAE6OF01BRAPN.12.40.D07.1.454.CMB.1.raw
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtcccngacncncgctgtgtcgctcgtgtctttcctatattctactcatnctgtcggccncgagccacgagacggaggctggaggtgggcgactactttagtcgacactgtgagtcggaccgtaacaaaacttaacttccgaacgaacttaaacgtttccggtaggggaccggggaccttacttacccaacctacttcctaccgaagaacgaaacttaaacttaacgaaacgtaaaccctttacctttatcgtacgaaactaaagtacgaacgacgtaccgtaggaaaccgaacccgaacggaaccgaaccggaccggtcttacgtaactttaagtttaagtcggacggaacggaaggaacggaacgaaccaaccgaaacccgtaacctacggtaccggaacctaacgttaccggtaggggtcggggttactttcggggttaccggggtaccggggtacccgggtaacccggggtacccgttcgggtaccgtaccggtttcccgtacccccgttaccccggacccgttacccccgtaaccccggaaaccccgggtaaccccgggtaccccgttaacccgggtttccccgggtttaccccccccttccccgggtcccgggtcccccggttcccgttaccccggg

SEQ ID NO: 22262 - DNA, 748 bp, Homo sapiens
  misc_feature: GYAE6OF01CZ5RU.12.40.D07.1.454.CMB.1.raw
  modified_base (209)..(209): a, c, t, g, unknown or other
  misc_feature (209)..(209): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggcacctggtggagtcgtgggggagccgtggtccagccgtgggcggtcctgacactcgcctgtgttgcctctggtactttccctntaatttctattccatgctacgtcgggtcccgccgaggcctccggaggcgaagggctcggaggtcggtgctacttatgacacgtagtgtagtcggtacgtaactaaaactaacgtttccgtaacgtaactaaacgtttccgggaggtaacggggacccttacgttaccaacctactcccttaaccgaaggtaacaaacttaaacgttaacgaaaccgtaacctttaacccctttagtctacgaaactaaacgttcgaaccgtacgaccgtacggaaacgaccgtaaccggacgtaacccgacggttacgttagttacctttaagttcgtcggaccggaacgtaaagacgacgaaccaaccgtaacgtacccgtagtacggaactagttacggttggtacggttcgttacgggtccggcgggtaccgtaccgggttcgtcgtacgtccgtcccgttaccacccggccgtaccccgtaccggacccggtaccgtcccgtccgttaccccgttccccgtcccggccggtccctccgtacccgg

SEQ ID NO: 22263 - DNA, 555 bp, Homo sapiens
  misc_feature: GYAE6OF01EF2WP.12.40.D07.1.454.CMB.1.raw
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
  modified_base (543)..(543): a, c, t, g, unknown or other
  misc_feature (543)..(543): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttatgcacatgatggcgtcaacaaattctacgcaaattcccgtgacggggccgattcaccatctccagagacaattacaagaacaccctttanctgacaaatagacagcctganaccagacgacacggctgtctattattgcgcgagagagacacacgaacctactcggaccaatactagtcggggcttggttcgtcggggccgacggggaccctggtcacgtccgtcctccccgacgccctccaccgaacggcccagtccgtaccttcccccgnggccgcccgtcg

SEQ ID NO: 22264 - DNA, 569 bp, Homo sapiens
  misc_feature: GYAE6OF01ALZZ8.12.40.D07.1.454.CMB.1.raw
  modified_base (361)..(361): a, c, t, g, unknown or other
  misc_feature (361)..(361): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcggagtggggtggcacttatgcacatgatggctcaacaaattctacgcaaattccgtgaggggccattcaccatctcagagacaattacaagaactaccctttanctgacaaatagacagcctagacgaccagacgacgacgctgtctattatgcgcgagagagacacacgaacctactcggacaacgtactagtggggacttggttcgtgggccgacggggtaccctggtcagttccgtcctccccgacgtccctaccgacccgaacgggcccctacgtcccggtccttcccccgcgggtcccgccccgtcg

SEQ ID NO: 22265 - DNA, 603 bp, Homo sapiens
  misc_feature: GYAE6OF01A1LT5.12.40.D07.1.454.CMB.1.raw
  modified_base (234)..(234): a, c, t, g, unknown or other
  misc_feature (234)..(234): n is a, c, g, or t
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
  modified_base (405)..(405): a, c, t, g, unknown or other
  misc_feature (405)..(405): n is a, c, g, or t
tcagatacgacgtacacgaccggtgctcgatttagtgatagagcgtaacaacagagggctcaccatggagtttgggctgagcgtggtttccgtcgttagctctttaagaggtgtccagtgtcaggggcacctggtggagtctgggggagccgtggtccagcctgggcggtccctgacactcgcctgtgttgcctctggactttccctcaatttctattccatgcactgggtccncaggctccaggcaaggggctcgagtgggtgcacttatgcacatgatggctacaacaattctacgcaaattccgngagggccattcaccatcncagaganaatacaagaacacctttaanctgacaaatagacagcctagacgacagacgacacgctgtctattagtgacgngagagagactacacgaactactcgacaagtactacgtaggggtccttggttcgtacggggtccgtaacgggggtacccttgggtactacgttccgtaccctacccccgtacgtccccttacccggaaacccgaaccggggtcccctacggttcccggttacccgttaccccccggtacgggtcccgtcccccgtacgg

SEQ ID NO: 22266 - DNA, 596 bp, Homo sapiens
  misc_feature: GYAE6OF01DCLYX.12.40.D07.1.454.CMB.1.raw
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
  modified_base (335)..(335): a, c, t, g, unknown or other
  misc_feature (335)..(335): n is a, c, g, or t
  modified_base (356)..(356): a, c, t, g, unknown or other
  misc_feature (356)..(356): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccncaggctccaggcaaggggctcgagtggggtgcacttatgcacatgatggctacaaacaaattctacgcaaattccgnggaggggccattcacatctcagngacaatacaagactaccttanctgcaaatgacagcctagagaccagacgacacgctgtactatatgcgcgagagagacaacaccgaacctactacggacctaatacgtaacgtggggtactttcgggttcgtcggggacccacgggggtaccctagggtaccaagttccgtcctacccccgacgtccccgttacccgaaccgaacggggcccctaacgttcccgggttaccctttccccccgcggtcccgtccccgtacgg

SEQ ID NO: 22267 - DNA, 540 bp, Homo sapiens
  misc_feature: GYAE6OF01C956M.12.40.D07.1.454.CMB.1.raw
  modified_base (235)..(235): a, c, t, g, unknown or other
  misc_feature (235)..(235): n is a, c, g, or t
  modified_base (528)..(528): a, c, t, g, unknown or other
  misc_feature (528)..(528): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttatgcacatgatggcgtcaaacaaattctacgcaaaattccgtgaggggccattcacatctccagagacaatacaagaacaccctttatctgacaaatagacagcctgagaccagacgacacggctgtactattattgcgcgagagagacacacgaacctactgaccaatactagtggggctttgtcgtgggccagggaccctggtcatcgtctcccgagtccctaccaccgacggcccagtccgtccttcccccgnggcccgccctcg

SEQ ID NO: 22268 - DNA, 555 bp, Homo sapiens
  misc_feature: GYAE6OF01EYNDW.12.40.D07.1.454.CMB.1.raw
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttanctgacaaatagacagcctgacgaccagacgacacggctgtctattattgcgcgagagagacacacgaacctactggaccaatactagtggggcttgttcgtggggccaggggaccctggtcacgtccgtcctccccgacgccctacccaccgaacgggcccacgtccggtcccttcccccgcggcccgcccgtcg

SEQ ID NO: 22269 - DNA, 830 bp, Homo sapiens
  misc_feature: GYAE6OF01EEQC1.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgtcgcctgtgtactttcctatatttctactcatcgcacgtcgggtcccaccgaggtcctccgaggacggaaggggtctacggagggtggggtcgactactttatgacacatgagtggctacaaactaaatttccacgataaacgttccgtagggacggggacctattccaaccatcctaccgaagacgaactaaattaacgaaacgtaaacccttacccttttaagtcctagaactaaaaagtacgaacacgtcctaggaacgaacccgagaaccgaaccgacgggtccttagttaccttaattttagttcggaccggacgaaaggaacggaacgaacccaaaccgtaaacccggtaaaacccctttacgggtaccggaaaccctaaactttaaaccgttaagggggttaccggggggttacctttttacgggtttcccggggttacccgggggggaacccggtaacccggggggttaaccccgtttcggggtacctaacgtttccccggttcccctaccccccggtaaccgttacccccgtacccccgaaaacccgggaaacccggggtacccccttaacgggttcccccgggtttacccccctttacccccccggcggggtcccccgtcccccgttccggg

SEQ ID NO: 22270 - DNA, 555 bp, Homo sapiens
  misc_feature: GYAE6OF01E1NUL.12.40.D07.1.454.CMB.1.raw
  modified_base (433)..(433): a, c, t, g, unknown or other
  misc_feature (433)..(433): n is a, c, g, or t
tcagatacgacgtacacgaccggtgctcgatttagtgatagagcgtaacaacagaggactcaccatggagtttgggctgagctgggtttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcggagtgggtggcacttattgcacatgatggcgtcaacaaattctacgcaaattcccgtgaggggccgattcaccatctccagagacaattacaagaacaccctttatctagcaaatagacagcctgagaccagacgacacgctgtctattatgcgcgagagagacacacgaacctacncggaccaatactagtcggggcttcggttcgtggggccgaggggaccctggtcagtccgtacctcccgacgcctacccaccgacgggcccacgtccggtccttaccccctcggccgcccgtcg

SEQ ID NO: 22271 - DNA, 554 bp, Homo sapiens
  misc_feature: GYAE6OF01C0UHG.12.40.D07.1.454.CMB.1.raw
  modified_base (235)..(235): a, c, t, g, unknown or other
  misc_feature (235)..(235): n is a, c, g, or t
  modified_base (313)..(313): a, c, t, g, unknown or other
  misc_feature (313)..(313): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtggcacttatgcacatgatggcgtcaaacaaattctacgcaaattccgngaggggccattcaccatctccagagacaattacaagacaccctttatctgacaaatgacagcctgacgaccagacgacacggctgtctattatgcgcgagagagacacacgaacctactcgccaatagttagtggggtctttgttcgtggggccacggggaccctggtcagtccgtctccccgacgccctaccacccgacgggcccacgttccggtcccttccccgtcggccgtcccgtcg

SEQ ID NO: 22272 - DNA, 923 bp, Homo sapiens
  misc_feature: GYAE6OF01BR7M5.12.40.D07.1.454.CMB.1.raw
  modified_base (211)..(211): a, c, t, g, unknown or other
  misc_feature (211)..(211): n is a, c, g, or t
tcagatacgacgtacacgaccggtgctcgatttagtgatagagcgtaacacagagggctcaccatggagtttgggctgagctgggtttcctcgttgcttctttaagaggtgtccagtgtcgagggcaccgtggtggagtcgtgggggagccgtggtccagcctgggccgtccctgacactcgcctgtgttcgcctctggtactttcccttntaatttctattccatcgcacgtgggtccgcaggcctccgaggcgaaggggctcggagtgggtgctacttatgcacatgagtggacgtacaaactaaattccgaacgactaaagtttcccggtagggaacggggcctaattccaaccgtatccctaccgaaggaacgaactaaagttaaccgaaaacgtaacctaacccctttaatccgtacgaacctaaaagtacggaaccacggtccctaggaaccgtaaacccgaacggtaaccgaacccgtaccggtaccgttacgttaccgtttaacgtttacggttaccggtaccgggtaaccgggtaaacgggaacggtaaccgggaaaccctaaacccggaaaacccggtaaaaccccgttaacccggtaaccgggtaaacccctaaaacggtttaacccggtttaaacggggtttccgggggggtttacccgttttacgggggttttacccgggttacccgggggggtaacccggtaacccggggggggttaccccccgttacgggggtttaacccggtaaccggtttcccccggttacccccgttaccccccggtaacccgggtacccccgtttacccccggaaaccccgggtaaacccggggtaccccccgtacgggtttccccgggtttacccccgtttacccccccggttccgggggtccccgtccccccggttaccggg

SEQ ID NO: 22273 - DNA, 576 bp, Homo sapiens
  misc_feature: GYAE6OF01CWP0F.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctggtagagtctgggggagccgtggtccagcctgggcggtccctgacactcgcctgtgttgcctctggatttcccttcaatttctattccatgcactgggtccnccaggctccaggcaaggggctcgagtggggtggcacttattgcacatgatggcgtcaaacaaattctaacgctaaaattccgtgaggggccaattcacatctccagagacaattacaagaacaccctttatctgacaaatagacagccctagacgaaccagacgacaacggctgtactattatgcgagagagagacacaacgaacctacgtgaccaatactagtggggtcttgttcgtggggccacggggtccctaggtccagtccgtcctaccccgacgccctacccacccgaacgggcccctagtcccggtaccttcccccgtcggcccgtcccgtccg

SEQ ID NO: 22274 - DNA, 561 bp, Homo sapiens
  misc_feature: GYAE6OF01CNK95.12.40.D07.1.454.CMB.1.raw
  modified_base (238)..(238): a, c, t, g, unknown or other
  misc_feature (238)..(238): n is a, c, g, or t
  modified_base (365)..(365): a, c, t, g, unknown or other
  misc_feature (365)..(365): n is a, c, g, or t
  modified_base (438)..(438): a, c, t, g, unknown or other
  misc_feature (438)..(438): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctggtggagtctggggggagccgtggtccagcctgggcggtccctgacactcgcctgtgttgcctctggattttcccttcaattttctattccatgcactgggtccnccaggctccaggcaaggggctcggagtgggtgcacttatgcacatgatggcgtcaacaattcacgcaaattccgtgaggggccattcaccatcctccagagacaattacaaagaacctaccctttanctagacaaatgacagcctagagaccagacgacacggctgtctattatgcgcgagagagacacacgaacctacnggaccaatactagtggggctttgtcgtggggccagggccctggtctagtccgtcctccccagtccctaccgacccgaacgggccccacgttcccggtcccttaccccgcggcccgcccgtccg

SEQ ID NO: 22275 - DNA, 601 bp, Homo sapiens
  misc_feature: GYAE6OF01B56BG.12.40.D07.1.454.CMB.1.raw
  modified_base (237)..(237): a, c, t, g, unknown or other
  misc_feature (237)..(237): n is a, c, g, or t
  modified_base (362)..(362): a, c, t, g, unknown or other
  misc_feature (362)..(362): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggattttcccttcaattttctattccatgcactgggtccncaggctccaggcaaggggctcgagtgggtgcacttatgcacatgatggctacaaacaaattcacgcaaattccgtgacggggccattcaccatctccagagacaattacaagaactaccctttanctagacaaatagacagcctagacgaccagacgacacggctgtactattattgcgcgaagagagacacacgaacctactacggaccaatactagtcggggtcttggttcgtcggggccgacggggtaccctggtctaacgtccgtacctccccgacgtccctacccaacccggaaccgggccccctaacgttcccgggttacccttacccccccggtcgggtccccgtcccccttaccgg

SEQ ID NO: 22276 - DNA, 585 bp, Homo sapiens
  misc_feature: GYAE6OF01D9YXY.12.40.D07.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
tcagatacgacgtacacgaccggtgctcgatttagtgatagagcgtaacaacaggggactcaccatggagtttgggctgagcgtggtttcgtcgttaggctctttaagaggtgtccagtgtcaggggcacctggtggagtcgtgggggagccgtggtccagcctgggcggtccctgacactcgcctgtgttgcctntgactttccctntaatttctattccatgcactgggtccgccaggtctccaggcaaggggctggaggtgggtggcattatgcanatgatggctcaaanaaattcacgacaaattccgaggaggggccattccacntctcaganactaattacaagaacctacctttanctagacaaagtcacagccaggaacacagaccacgtcggctgtctattatgcgngagagacgacacacgactanggacaatacgtagtggggtcttacggttcgtacggggccgtacgggtacccgttcgggactacgttccggtccctcccgaacgccctacccgaacccggtacgggccctagtcccgttccttcccccgagggccccctccgtacgcccg

SEQ ID NO: 22277 - DNA, 818 bp, Homo sapiens
  misc_feature: GYAE6OF01AB8NI.12.40.D07.1.454.CMB.1.raw
  modified_base (235)..(235): a, c, t, g, unknown or other
  misc_feature (235)..(235): n is a, c, g, or t
  modified_base (319)..(319): a, c, t, g, unknown or other
  misc_feature (319)..(319): n is a, c, g, or t
  modified_base (346)..(346): a, c, t, g, unknown or other
  misc_feature (346)..(346): n is a, c, g, or t
  modified_base (372)..(372): a, c, t, g, unknown or other
  misc_feature (372)..(372): n is a, c, g, or t
tcagatacgacgtacacgaccggtgctcgatttagtgatagagcgtaacaacagagggctcaccatggagtttgggctgagctgggtttcctcgttgctcttttagaggtgtccagtgtcaggggcacctggtggagtcgtggggggagccggtgggtccagcctgggcggtccctgacactcgcctgtgttgcctctggatttccctcaatttctattccatgcactgggtccnccaggctccaggcaaggggctcgaggtgggtggcacttagtgcacatgatgggctacaactaaattctacgctaaagttcccgnggacggggcctattcaccatctcagancaattacaacgaacctacccttttanctagactaaaagtacgacacgtccctaggaagaccccagaacccgaacgacgggacttacggtacttaacgtttacgtttacggccgtacggtaaggaacggaacgggaacctaacccgtaaacccggtaaaaccccgtttaaccggacgggtaacccctaaaacgttttaacccggtaacgggttaccgggggggttacccgtttttacgggttttacccgggtacggggggtaacccccgttaacggggggttaccccgttaacggggttaccgtacggtttacccgggtttccccttaaccccccgggtaccgggttacccccgttaacccccggtaaacccccggttaaccgggggacccccccgttaacggttacccccggggtttacccccgtttaccccccgggtacccggggttccccggtaccccccggttcccggg

SEQ ID NO: 22278 - DNA, 531 bp, Homo sapiens
  misc_feature: GYAE6OF01AVOGL.12.40.D07.1.454.CMB.1.raw
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (518)..(518): a, c, t, g, unknown or other
  misc_feature (518)..(518): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtggggtggcacttatgcacatgatggcgtcaacaattcacgcaaattccgtgaggggccattcaccatctccagagacaattacaagaaccaccctttatctgacaaatagacagcctgacgaccagacgacacggctgtctattattgcgcgagagagacacacgaacctactggccaatactagtaggggcttgttcgtgggccagggccctggcatcgctcccncgccnccnccacggcccacgtccgtcctcccncggccgcccgtcg

SEQ ID NO: 22279 - DNA, 641 bp, Homo sapiens
  misc_feature: GYAE6OF01C4PJF.12.40.D07.1.454.CMB.1.raw
  modified_base (111)..(111): a, c, t, g, unknown or other
  misc_feature (111)..(111): n is a, c, g, or t
  modified_base (145)..(145): a, c, t, g, unknown or other
  misc_feature (145)..(145): n is a, c, g, or t
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
  modified_base (355)..(355): a, c, t, g, unknown or other
  misc_feature (355)..(355): n is a, c, g, or t
  modified_base (410)..(410): a, c, t, g, unknown or other
  misc_feature (410)..(410): n is a, c, g, or t
  modified_base (556)..(556): a, c, t, g, unknown or other
  misc_feature (556)..(556): n is a, c, g, or t
tcagatacgacgtacacgaccggtgctcgatttagtgatagagcgtaacaacagaggactcaccatggagtttgggctgagcggtggtttcgctaggctctttaagaggtntcagtgtcaggggcactggtggagtctggggganccgtggtccagcctgggcggtccctgacactcgcctgtgttgcctctggtattttcccttanaatttctattccatgcacgtgggccncaggcctccaggcaaggggctgagtgggtcgcattntgcanatgatggctcaaataattcaacgactaaacttccggnggacggggcattccacntcgaccaaggactaacaattaacgaanaaccttaacctttgctgacaaatgaactcgctgaacaccagaccgtacacggctntacttaattgtgcgagaagagacaacaccgtaacgacttaacggcgacctaagttacgtaaggtcggggtacttttcgggtacggtcgggggacccgttaacgggtcccggtaacggttcctaacgtcccgtttccgaacccccgnggttacccccaccgtaaacccggaacccggggtcccaccgttccccgggttcccctttccccggccgggtccttccccgaaccgg

SEQ ID NO: 22280 - DNA, 588 bp, Homo sapiens
  misc_feature: GYAE6OF01DBINU.12.40.D07.1.454.CMB.1.raw
  modified_base (378)..(378): a, c, t, g, unknown or other
  misc_feature (378)..(378): n is a, c, g, or t
  modified_base (526)..(526): a, c, t, g, unknown or other
  misc_feature (526)..(526): n is a, c, g, or t
tcagatacgacgtacacgaccggtgctcgatttagtgatagagcgtaacaacagagggctcaccatggagtttgggctgagctgggttttcctcgttgctcttttaagaggtgcccagtgtcaggggcacctggtggagtcgtggggggagccgtggtccagcctgggcggtccctgacactcgcctgtgttgcctctggactttcccttctaattttctattccatgcactgggtccgccaggctccaggcaaggggctcggaggtgggtgcacttatgcacatgatggcgtacaaactaaattctacgactaaattccgtggaggggccattcaccatctaccagacgaacaattacaaagaacctaccctttaanctagacaaaatgacagcctgacgaccaagacgacacggctgtactatattgcgacgagagacgaacacacgaacctacgtgaccaatactagtcggggcttggtcgtcggggaccacggggacccttggactcgtccgtcctccccgngtcccaccgaccgacgggccccacgttcccggtacccttccccgtcggcccgtccccgtcgg

SEQ ID NO: 22281 - DNA, 608 bp, Homo sapiens
  misc_feature: GYAE6OF01DK338.12.40.D07.1.454.CMB.1.raw
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctggtggagtcgtggggggagccgtggtccagcctgggcggtccctgacactcgcctgtgttgcctctggattttcccttcaatttctattccatgcactgggtccgccaggcctccaggcgaagggggctcggaggtggggtggcactttattgcacatgatggcgtacaaactaaattctaacgactaaaacttccggtggacgggggcctattccaaccctattcctaccaagaacgaactaaagtttaacaaacgtaacctacccttttatcctagactaaaatcgacagcctagacgaccagaccgacacggctgtactattatgcgngagaganacacacgaacctactcgacaatacgtagtcggggtctttggttcgtcgggaccgacggggtccctggtctgtccgtcctcccgacgccctccacccgacggccctacgtccgtcccttccccgtcgccgtcccgtcg

SEQ ID NO: 22282 - DNA, 796 bp, Homo sapiens
  misc_feature: GYAE6OF01BSAGK.12.40.D07.1.454.CMB.1.raw
  modified_base (241)..(241): a, c, t, g, unknown or other
  misc_feature (241)..(241): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctctggtactttcccttctaattttcctattccatgcactgggtccnccaggctccaggcaaggggctcggagtggggtgcacttatgcacatgatggcgtacaactaaattctacgactaaagttcccggtaggacgggggtcccagtttccaaccaattcctacccgaaaggtaacgtaacctaaaatttaaccaaacgtaaacctaaccccgttttaatcccttaggaacctaaaaataaggaaccacggacccttaggaacgaaacccaaggaaccggaaccgaaccgggtcccttaggttacctttaagtttaacgtttacggaccggtacggtaaacggaacggtaacgggaaccctaaaccgaaacccggtaaacccttaacgttaccgggaaccctaaacgtttaacgttaacggttcggggggtaccttttagggtttcccgggttacgggggacccgtaacgggggtacccgtcgggttacctacgttcccgtacccgtaccccgacgtaccccgtaccccgaaccgaacccgggtcccctaaccggttcccggttaccccttacccccgtcgggtccccgtccccgtccgg

SEQ ID NO: 22283 - DNA, 558 bp, Homo sapiens
  misc_feature: GYAE6OF01EVWWQ.12.40.D07.1.454.CMB.1.raw
  modified_base (238)..(238): a, c, t, g, unknown or other
  misc_feature (238)..(238): n is a, c, g, or t
  modified_base (291)..(291): a, c, t, g, unknown or other
  misc_feature (291)..(291): n is a, c, g, or t
  modified_base (365)..(365): a, c, t, g, unknown or other
  misc_feature (365)..(365): n is a, c, g, or t
  modified_base (425)..(425): a, c, t, g, unknown or other
  misc_feature (425)..(425): n is a, c, g, or t
  modified_base (546)..(546): a, c, t, g, unknown or other
  misc_feature (546)..(546): n is a, c, g, or t
tcagatacgacgtacacgaccggtgctcgatttagtgatagagcgtaacaacagaggactcaccatggagtttgggctgagcttgggttttcctcgttgctcttttaagaggtgtccagtgtcaggggcacctggtggagtcgtgggggagccgtggtccagcctgggcggtccctgacactcgcctgtgttgcctctggtatttcccttctaatttctattccatgcactgggtccnccaggctccaggcaagggctcgagtgggtgcacttattgcacatgatggcgtnaaacaaattctacgcaaattccgtggaggggccattcaccatctccagagacaattacaagaaccaccctttanctagacaaaatacgacagcctgacgaccagacgacacgctgtctattatgcgcgagaganacacacgaacctactggaccaatactagtgggggcttggttcgtggggccacgggggtaccctggtcacgtcgtctccgtcagccctccgaccgaacggccctactccggtaccttccccnggcctacccccg

SEQ ID NO: 22284 - DNA, 560 bp, Homo sapiens
  misc_feature: GYAE6OF01CD1TV.12.40.D07.1.454.CMB.1.raw
  modified_base (414)..(414): a, c, t, g, unknown or other
  misc_feature (414)..(414): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtgggggagccgtggtccagcctgggcggtccctgacactcgcctgtgttgcctctggatttcccttcaatttctattccatgcactgggtccgccaggctccaggcaaggggctcgagtggggtggcacttatgcacatgatggcgtcaacaaattcacgcaaattccgtgagggccgattcaccatctccagagacaattacaagaaccaccctttatctagacaaatagacagcctgagaccagacgacacggctgtctattattgcgngagagagacacacgaactactggaccaatactagtggggcttggtcgtcggggccgacgggaccctggtcatccgtcctccccgacgccctccgacccgaacgggccccacgtcccgggtcccttcccccgtggccccgcccgtcg

SEQ ID NO: 22285 - DNA, 552 bp, Homo sapiens
  misc_feature: GYAE6OF01D39NB.12.40.D07.1.454.CMB.1.raw
  modified_base (329)..(329): a, c, t, g, unknown or other
  misc_feature (329)..(329): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtacaacaaattctacgcaaattccgtgaggggcgatcacatcncagagacaattacaagaacacctttatctagacaaatagacagcctagacgaccagacgacgacgctgtactattattgcgcgagagagacacaacgaacctactcggaccaatactagtggggtcttgttcgtcggggcgacgggaccgtggtcagtccgtctccccgacgccctccgaccgaacgggcccacgtccgtccttccccgcggcccgcccgtcg

SEQ ID NO: 22286 - DNA, 629 bp, Homo sapiens
  misc_feature: GYAE6OF01DJ6BP.12.40.D07.1.454.CMB.1.raw
  modified_base (369)..(369): a, c, t, g, unknown or other
  misc_feature (369)..(369): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctggtggagtctggggggagccgtggtccagcctgggcggtccctgacactcgcctgtgttgcctctggattttcccttcaatttctattccatgcactgggtccgccaggctccaggcaaggggctcgagtgggtgcacttattgcacatgatggcgtacaaacaaattctaacgcaaaattccgtggaggggccattcaccatcgtccaagagaacaattacaagacaccctttanctgacaaaatacgacagcctgaacgaccagaaccgacacggtctgtactattaattgcgacgagagagacacaccgaacctactggacctaagtactagtgggggtctttaggttcgtacggggccgtaccgggggtaccctgggtacctaagttcccggttaccctcccccgacgtaccccttaccccgaacccgaaacggggtcccccaacgttcccgggttaccctttcccccccggtgggccccgtcccccgtcgg

SEQ ID NO: 22287 - DNA, 628 bp, Homo sapiens
  misc_feature: GYAE6OF01CQPW9.12.40.D07.1.454.CMB.1.raw
  modified_base (246)..(246): a, c, t, g, unknown or other
  misc_feature (246)..(246): n is a, c, g, or t
tcagatacgacgtacacgaccggtgctcgatttagtgatagagcgtaacaacagaggactcaccatggagtttgggctgagctgggttttcctcgttgcttcttttaagaggtgtccagtgtcaggggcacctggtggagtcgtgggggagccgtggtccagccgtgggccgtccctgacactcgcctgtgttgcctctggtacttttcccttactaattttctattccatgcacgtggggtcccnccaggcctccgaggcgaaggggctcggaggtggggtgctacttatgcacatgatggctacaaactaaattctaacgactaaaatttcccggtaggacgggggtccctaatttccaaccattcctaccaagacgaactaaacttacaaacgtaacctaccctttatctagaacaaatagacagcctagacgacagacgacacgctgtctatatgcgagagagacacacacgaacctactacggactaatacgtagtcggggtcttaggtcggtacgggaccgacggggtaccctggtcctacgtccgtccctaccccgacgccctaccgaacccgacgggccctacgtcccggtacccctcccccgcggcccgtcccgtccgg

SEQ ID NO: 22288 - DNA, 503 bp, Homo sapiens
  misc_feature: GYAE6OF01EB81Z.12.40.D07.1.454.CMB.1.raw
  modified_base (151)..(151): a, c, t, g, unknown or other
  misc_feature (151)..(151): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(270): a, c, t, g, unknown or other
  misc_feature (266)..(270): n is a, c, g, or t
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (501)..(501): a, c, t, g, unknown or other
  misc_feature (501)..(501): n is a, c, g, or t
tcagatacgacgtacacgaccggtgctcgattttagtgatagagcgtaacaacagagggctcaccatggagtttgggctgagctgggttttcctcgttgctctttttaagaggtgtccagtgtcaggggcacctggtggagtctggggganccgtggtccagcctgggcggtccctgacactcgcctgtgttgcctntggntttcccttnaatttcattccatgcactgggtccncagcncngcgaggcngngnggngcntntncnnnnngcncacatctnacagtcgngcggcgcncncntcncnananatacacactactancnanananacacncagacacacacacncnctntatatatcgtcgacganagacacgacgactactacgacacagtacgtacgtagtagtgtcgtcggacggacgacgtcgtcgtcgtcgtccgtaccgtcgcgaccgcgaccgtaccgtaccgtaccgtaccgtcccgtcgccgtcncg

SEQ ID NO: 22289 - DNA, 583 bp, Homo sapiens
  misc_feature: GYAE6OF01A4JMK.12.40.D07.1.454.CMB.1.raw
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
  modified_base (439)..(439): a, c, t, g, unknown or other
  misc_feature (439)..(439): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcggagtggggtggcacttattgcacatgatggctacaaactaaattcacgctaaattccgtgaggggccattccaccatctcaganaacaattacaagaactaccctttanctgacaaatgacagcctgacaccagacgacacggctgtctattatgacgcagagagacacaccgaacctacncgaccaatacgtagtacggggtcttggttcgtcggggccgacggggtaccctggtctacgtccgtcctccccgacgccctacccgaccgaaccgggcccctaacgttcccgggtcccttacccccgcgggtcccgccccgtcgg

SEQ ID NO: 22290 - DNA, 556 bp, Homo sapiens
  misc_feature: GYAE6OF01DOJM7.12.40.D07.1.454.CMB.1.raw
  modified_base (234)..(234): a, c, t, g, unknown or other
  misc_feature (234)..(234): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
  modified_base (543)..(543): a, c, t, g, unknown or other
  misc_feature (543)..(543): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtacaacaaattctacgctaaattccgtgaggggccattccacntctccaganacaattacaagtaactaccctttatctagactaaatgacagcctagacgacagacacacgctgtctattatgcgngagagagacacacaacctacncggacaatactagtacggggtcttgttcgtgggaccgagggtaccctggtccagtccgtccgaccccgtcgccctccgaccgacggcccacgtccggtacccttccccgngcccgccgtaccg

SEQ ID NO: 22291 - DNA, 570 bp, Homo sapiens
  misc_feature: GYAE6OF01DI6G2.12.40.D07.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
  modified_base (469)..(469): a, c, t, g, unknown or other
  misc_feature (469)..(469): n is a, c, g, or t
  modified_base (502)..(502): a, c, t, g, unknown or other
  misc_feature (502)..(502): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtctggggggagccgtggtccagcctgggcggtccctgacactcgcctgtgttgcctctggtatttcccttcaattttctattccatgcactgggtccncaggctccaggcaaggggctcggagtgggtgcacttatgcacatgatggcgtacaaacaaattcaagcaaattccgngaggggccattcaccatctacaganaacaattacaagaactacctttanctgacaaaatgacagcctgaagaccagacgacacggctgtctattattgcgcgagagagacaacacgaacctactcggacaatactaagtggggtcttggttcgnggggccacggggaccctggtcctagtccgtccnccccgtacgccctaccgaccgaaccggcccacgtccggtacccttcccccgtcggcccgtcccgtcgg

SEQ ID NO: 22292 - DNA, 568 bp, Homo sapiens
  misc_feature: GYAE6OF01A7C8O.12.40.D07.1.454.CMB.1.raw
  modified_base (236)..(236): a, c, t, g, unknown or other
  misc_feature (236)..(236): n is a, c, g, or t
  modified_base (436)..(436): a, c, t, g, unknown or other
  misc_feature (436)..(436): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaattttctattccatgcactgggtccnccaggctccaggcaaggggctcgagtgggtgcacttatgcacatgatggcgtacaacaaattcacgcaaattccgtgaggggccattcaccatctccagacgacaattacaagaactaccctttatctgacaaatagacagcctagagaccagacgacacgctgtctattattgcgcgagagagacacaccgaacctacngaccaatactagtcggggtcttggttcgtggggccgacggggtaccctggtctacgtccgtcctccccgcgccctaccgacccgacgggccccacgtccggttcccttacccccgtcggcccgtccccgtcg

SEQ ID NO: 22293 - DNA, 615 bp, Homo sapiens
  misc_feature: GYAE6OF01C8HH2.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggattttcccttcaatttctattccatgcactgggtccgccaggctccaggcaaggggctcgagtggggtgcacttatgcacatgatggcgtacaaacaaattctaacgactaaaatttccggtggaacgggggcccaatttccgaaccatcctaccgaagacgaactaaattacaaagtaacctaccccttttaatctagacaaaatacgacagcctagacgaccagacgacgacgctgtactattattgcgcgaagagagacacacgaacctacgtgaccaatacgtagtcggggtcttggttcgtcgggccgacggggtaccctggtcctacgtccgtcctccccgacgccctacccgacccgaaccgggccccacgttcccggttcccttacccccgtcggcccgtccccgtcg

SEQ ID NO: 22294 - DNA, 590 bp, Homo sapiens
  misc_feature: GYAE6OF01E2VCR.12.40.D07.1.454.CMB.1.raw
  modified_base (146)..(146): a, c, t, g, unknown or other
  misc_feature (146)..(146): n is a, c, g, or t
  modified_base (170)..(170): a, c, t, g, unknown or other
  misc_feature (170)..(170): n is a, c, g, or t
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (353)..(353): a, c, t, g, unknown or other
  misc_feature (353)..(353): n is a, c, g, or t
tcagatacgacgtacacgaccggtgctcgatttagtgatagagcgtaacaacagagggctcaccatggagttttgggctgagcgtggtttcgcgtagctctttaagaggtgtcagtgtcaggggcacctggtggagtctggggganccgtggtccagcctgggcgtcccngacactcgcctgtgttgcctctggattttccctnaatttctattccatgcactgggccncagctcgaggcgagggctgagtggngctattatgcacagtgagtcggactacaactaattctacgactaacgttccgagacggctatcaccatcacagacacaactaacaactacctaccttancgagaactaagacgacacgacgagacgacgacgacgacgacgtctcgtactattagtgacgacgagacgacgacgacgaacgaaccgtacgtacgtactaacgtacgtacggtcgggtcgttcggttacggtccgggtaccggtaccggtaccgtcgtaccgtaccgtcccgtcccgtcccgtaccgtccgtaccgacgaccgacccgacccgtaccgacgacgaccgcgcggccgg

SEQ ID NO: 22295 - DNA, 576 bp, Homo sapiens
  misc_feature: GYAE6OF01BAGSV.12.40.D07.1.454.CMB.1.raw
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
  modified_base (434)..(434): a, c, t, g, unknown or other
  misc_feature (434)..(434): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttccctcaatttctattccatgcactgggtccgacaggctccaggcaaggggctcgagtggggtgcacttatgcacatgatggcgtacaacaaattcacgcaaattccgtgacggggccattcaccatctccaganacaattacaagaactacctttanctagacaaatagacagacctagacaccagacgacacggctgtctattattgcgcgagagagacacacgaactacncgacaatacgtagtggggtcttggttcgtcggggccgacggggtaccctgggtcacgtccggtcctaccccgacgtcccctaccgaacccgaacggggtccctacgtcccggtcccttcccccggtcggcccgtccccgtcg

SEQ ID NO: 22296 - DNA, 863 bp, Homo sapiens
  misc_feature: GYAE6OF01BBC8S.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagccgtgggcggtcccgtgacactcgcctgtgttgcctctggtactttccctctaatttctattccatgctacgtgggtccgccaggcctccgaggccgaagggggcctcggaggtggggtgctacttattgcacatcgagtggacgtacaaactaaattccgaacgactaaagttccggtaggacggggccctattccaacctatcctaccaaggactaaactaaacttaaccaaacgtaaaccctaccccttttaatcctagaacctaaaatacgaacctacggtacctaggaaccgaacccgaaggaaccggaacgtaccggtacttacgttaccgttaagtttacgttacggtaccggacgaaggaacggaacgtttaaccgaaacccgtaaacccggtaaaaccccgttaccgtaaccgggtaaccctaaaacggttaaccggttaacgggttaacgggggttccggtttacggggtttacccggggttaccgggggtaccccgggttaaccggggggtacccccggttacgggtacccgttaaccgttaccccggttacccccgttaccccccggtacccggtacccccgttaaccccggaaaccccggtaaacccgggtacccccgtaacccggtttccccgggtttacccccgtttacccccccggtcccgggtcccccggtccccggttaccccgg

SEQ ID NO: 22297 - DNA, 686 bp, Homo sapiens
  misc_feature: GYAE6OF01BFSE1.12.40.D07.1.454.CMB.1.raw
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (467)..(467): a, c, t, g, unknown or other
  misc_feature (467)..(467): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctgggtggagtctggggggagccggtgggtcccagccctgggacggtcccgggtgtacggacctacgggccgtcgtagtttggcctctggtatttcccttnaatttctattccatgcactgggtccgccaggctccgaggcaagggctcgaggtgggtggcattattgcacatgatggcncaaacaattcacgcaaatttccggngaggggccattcaccatccgtacagganaactaattaccaanaacctaccccttttancgtagaccaaagtacaaccgagacccttggaagaacccgaggaacgacgtaccgggcttacgtccttaatttntcggcgacgagacgaacgacaacgaaccgaacctacgtacggtactaagttacgtaggtcggggtctttgggttcggtacgggaccggtaccgggtaccgtcggtacttacgtccggttaccctccccgacgtaccccgtaccccgaacccggtaccgggtacccctaccggttccccggtttaccccgttcccccggtccggtccccgtccccgtcgg

SEQ ID NO: 22298 - DNA, 608 bp, Homo sapiens
  misc_feature: GYAE6OF01CK1GJ.12.40.D07.1.454.CMB.1.raw
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttctaatttctattccatgcacgtgggtccgccaggctccaggcaaggggctcggagtggggtgcacttatgcacatgatggacgtacaaactaaattctacgcaaatttccgtggacggggccattccaaccatcctccaagagaactaattaacaagaacctaccctttaanctagacaaatagacagcctagaacgaccagacgacacggctgtctattatgcgngagagagacacacgaacctacgtcgacctaatacgtaggtcggggtcttagttcggtcggggtacgacggggaccctggtccacgtccgttaccctccccgacgtccccgtacccacccgaacgggcccctacgttcccggttccccttacccccgtcggtcccgccccgtccg

SEQ ID NO: 22299 - DNA, 605 bp, Homo sapiens
  misc_feature: GYAE6OF01BABIQ.12.40.D07.1.454.CMB.1.raw
  modified_base (236)..(236): a, c, t, g, unknown or other
  misc_feature (236)..(236): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggactttcccttcaattttctattccatgcactgggtccnccaggctccaggcaaggggctcggagtgggtgcacttattgcacatgatggcgtcaaacaaattcacgcaaattccgtagaggggccattcaccatctccaganacaattacaagaactaccctttanctagacaaaatagacagcctagacgaccagacgacacggctgtactattattgcgacgagagagacacacgaacctactggaccaatacgtagtggggtcttggttcgtcggggccgacgggggtaccctgggtaccacgttccgtacccgtaccccgagtcccctacccgaacccgaaccgggcccctaacgttcccgggttacccctttcccccgtacgggtcccgtccccgttaccgg

SEQ ID NO: 22300 - DNA, 649 bp, Homo sapiens
  misc_feature: GYAE6OF01B2QIR.12.40.D07.1.454.CMB.1.raw
  modified_base (109)..(109): a, c, t, g, unknown or other
  misc_feature (109)..(109): n is a, c, g, or t
  modified_base (150)..(150): a, c, t, g, unknown or other
  misc_feature (150)..(150): n is a, c, g, or t
  modified_base (178)..(178): a, c, t, g, unknown or other
  misc_feature (178)..(178): n is a, c, g, or t
  modified_base (208)..(208): a, c, t, g, unknown or other
  misc_feature (208)..(208): n is a, c, g, or t
tcagatacgacgtacacgaccggtgctcgatttagtgatagagcgtaacaacagagggctcaccatggagtttgggctgagctgggttttcctcgttgctcttttaagnggtgtccagtgtcaggggcacctggtggagtcgtggggganccgtggtccagcctgggcgtccctgacnctcgcctgtgttgcctctgtatttcccttntaatttctattccatgctacgtgggtccgcaggctccgaggcaaggggctcggagtggggtgctactttagttcgcacatgagtggcgtacaaactaaacttcgtaacgactaaacgttccggtaggacgggacctaattccaacctatccgtaccaagaacgtaactaaacttaacaaacgtaaccttaccctttaatcgtacgaactaaagtacggacacgaccctaggaacgtaacccgaagaccgacgaccggtactgttaccttagttacgttgacgacgagagaacacaacgaccgtaactcaggactaacgtacgtggtacgggtcttcgttcggtcgggaccgacgggtacccgtgtaccacgtccgcctacccgacgcctacccgacgaccggccctacgttcccgtacccttcccgcgtcccgtcccgtcg

SEQ ID NO: 22301 - DNA, 605 bp, Homo sapiens
  misc_feature: GYAE6OF01BHCJT.12.40.D07.1.454.CMB.1.raw
  modified_base (418)..(418): a, c, t, g, unknown or other
  misc_feature (418)..(418): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggctacaacaaattctacgcaaattccgtgacggggccattcaccatctccagagacaattacaagaactaccctttatctgacaaatacgacacgcctagacgaccagacgacacggctgtactattattgcgngagagagacacacgaacctactacggaccaaatacgtaagtcgggggtctttcggttacgtcggggaccgacgggggtaccctgggtcctacgtccgtccgtcccccgacgtccctcccgaacccgaacgggtccccgaacgttcccgggttaccccttaccccccggtcggtcccgccccgtccgg

SEQ ID NO: 22302 - DNA, 614 bp, Homo sapiens
  misc_feature: GYAE6OF01CZISL.12.40.D07.1.454.CMB.1.raw
  modified_base (237)..(237): a, c, t, g, unknown or other
  misc_feature (237)..(237): n is a, c, g, or t
  modified_base (322)..(322): a, c, t, g, unknown or other
  misc_feature (322)..(322): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggattttcccttcaatttctattccatgcactggggtccnccaggcctccgaggcaaggggctcggaggtggggtggctacttatgcacatgatggctacaaacaaattctaacgcaaattccgngacggggccattccacatctaccaagagaacaattacaaagtactaaccctttatctgacaaaatgacagcctagaacgaccaagacgacgacggctgtactattattgcgacgagagagacaacgaacgaacctacgtcggaccaagttacgtagtacgggggtctttggtccgtcggggccgaacggggtaccctagggtcctaacgtccgtacctccccgacgtccctacccgaaccgaccgggtccctacgttcccggtacccttcccccgtcggcccgtcccgtccg

SEQ ID NO: 22303 - DNA, 559 bp, Homo sapiens
  misc_feature: GYAE6OF01DXRM8.12.40.D07.1.454.CMB.1.raw
  modified_base (433)..(433): a, c, t, g, unknown or other
  misc_feature (433)..(433): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttatctagcaaatagacagcctgagaccagacgacacggctgtctattattgcgcgagagagacacacgaacctacnggaccaatactaagtggggtcttggttcgtggggccgaggggaccctggtcatccgtcctcccgacgtccctccgaccaacgggcccacgtcccggttcccttacccccgtcggccgtcccgtccg

SEQ ID NO: 22304 - DNA, 729 bp, Homo sapiens
  misc_feature: GYAE6OF01B3JNQ.12.40.D07.1.454.CMB.1.raw
  modified_base (241)..(241): a, c, t, g, unknown or other
  misc_feature (241)..(241): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggtactttcccttctaattttctattccatgcacgtgggtcccnccaggcctccgaggcgaaggggctcggaggtggggtggctacttattgcacatgatggcgtacaaactaattctacgactaaagttccggtaggacggggcctattaccacctatcctaccaaggacgaactaaacttaacaaacgtaaaccttacccttttaatccgtagaacctaaaagtacgaacacgaccctaggaacgaacccgaaggaaccgacgaaccggtcttagttacttaatttagttacggcgacgaagagaacgaacaaccgaaccgtaaccctacgtacgaacctaagttacgtagggtacgggggttacctttgggttaccgggtcgggggtacccgaacggggtacccgtggtccgtacgttcccgtcccgtacccccgacgtccccgtacccgtaacccggaaccgggtacccccgtacgttccccgggttacccctttaccccccggtcgggtccccgtcccccgtaccgg

SEQ ID NO: 22305 - DNA, 550 bp, Homo sapiens
  misc_feature: GYAE6OF01BGKU5.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactgaccaatactagtgggggcttggttcgtgggccgaggggaccctggtcagtccgtcctccccagccctccacccgaacgggcccacgtccggtcccttccccctcggccgcccgtcg

SEQ ID NO: 22306 - DNA, 572 bp, Homo sapiens
  misc_feature: GYAE6OF01D3ICZ.12.40.D07.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (359)..(359): a, c, t, g, unknown or other
  misc_feature (359)..(359): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
tcagatacgacgtacacgaccggtgctcgatttagtgatagagcgtaacaacagagggctcaccatggagtttgggctgagctgggtttcctcgttgctcttttaagaggtgtccagtgtcaggggcacctggtggagtctgggggagccgtggtccagcctgggcgtccctgacactcgcctgtgttgcctctggatttccctnaatttctattccatgcactgggtccnccaggctccaggcaagggctcgagtgggtgcacttatgcacatgatggcgtacaaacaaattctaacgcaaaattccgtgaggggcccattcaccatctcagagacaattacaagaacctacctttanctagactaaaatacgaacagcctagacgaccagacgacacggctagtctattattagcgtacgagaganaccganacgaacctactggaccaatacgtaagtacggggtcttgttaccgaggggtaccgacggggtaccctggtcaagtccgtcctaccccgtagaccctccgaacggacgcctacccgtcgacgacgcctaagcggacccgg

SEQ ID NO: 22307 - DNA, 585 bp, Homo sapiens
  misc_feature: GYAE6OF01DMDBK.12.40.D07.1.454.CMB.1.raw
  modified_base (358)..(358): a, c, t, g, unknown or other
  misc_feature (358)..(358): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtcgggtggcacttatgcacatgatggcgtcaacaaattctacgcaaattccgtgaggggccattcaccatctcagagacaattacaagaacacctttanctgacaaatagacagcctagagacccagacgacacggctgtctattattgcgcgagagagacacaacgaacctactcgaccaatactagtgggggtctttggttcgtcggggaccgacgggggtaccctgggtcctacgtccgtccgtcccccgacgtccctcccgaacccgaacgggtccccacgttcccggttacccttcccccgtcgggcccgtccccgtccgg

SEQ ID NO: 22308 - DNA, 659 bp, Homo sapiens
  misc_feature: GYAE6OF01DGYI0.12.40.D07.1.454.CMB.1.raw
  modified_base (589)..(589): a, c, t, g, unknown or other
  misc_feature (589)..(589): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggtactttccttctaatttctattccatgcacgtcgggtccgccaggctccgaggcgaaggggctcggaggtggggtggctacttattgcacatgatggcgtacaaacaaacttctaacgacaaaacttccggtggacggggtccgaattccaaccattcctacccaagacgaacaaactttaacaaaacgaaaccctacccgttttaatactcgacaaaatacgaacagccctagacgaaccagaaccgacacggtctgtactattatgcgagagagacgacacaaccgtaacctacgcggaacctaataacgtgtacgggggtcttttcggttacggtcggggacccgtaacggggtcccttggcctacgccgttccctacccccgtacncccgtacccgaccggaaccgggccccttacgtcccggttcccctcccccgttccggccgtccccgtccgg

SEQ ID NO: 22309 - DNA, 547 bp, Homo sapiens
  misc_feature: GYAE6OF01C7BF4.12.40.D07.1.454.CMB.1.raw
  modified_base (150)..(150): a, c, t, g, unknown or other
  misc_feature (150)..(150): n is a, c, g, or t
  modified_base (237)..(237): a, c, t, g, unknown or other
  misc_feature (237)..(237): n is a, c, g, or t
  modified_base (280)..(280): a, c, t, g, unknown or other
  misc_feature (280)..(280): n is a, c, g, or t
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggganccgtggtccagcctgggtgtccctgacactcgcctgtgttgcctctggtattttcccttcaattttctattccatgcactgggtccnccaggctccaggcaagggctcggagtgggtgcacttattgcanatgatggcgtcaacaaattctacgcaaattccgngagggccattcaccatctcaganaacaatacaanaactaccctttanctagacaaatgacagcctagacgaccagacgacacgctgtctattatgcgcgagagagacacacgactacacgacaatactagtgggtcttgttcgacgggccgacgggccgtggtcatccgtctccccgacgtccctaccgacccacgggcccacgtccggtccttccccgtcgcccgcccgtcg

SEQ ID NO: 22310 - DNA, 546 bp, Homo sapiens
  misc_feature: GYAE6OF01BT990.12.40.D07.1.454.CMB.1.raw
  modified_base (341)..(341): a, c, t, g, unknown or other
  misc_feature (341)..(341): n is a, c, g, or t
  modified_base (364)..(364): a, c, t, g, unknown or other
  misc_feature (364)..(364): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggattttcccttcaattttctattccatgcactgggtccgccaggctccaggcaaggggctcgagtgggtgcacttattgcacatgatggcgtacaacaaattctacgcaaattccgtgaggggccattccaccatctccaganacaattacaagaacaccctttanctgacaaatgacagcctgacgaccagacgacacgctgtctattatgcgcgagagagacacacgactactcgaccaatactagtggggcttgttcgtgggccgacggggacctggtcacgtcgtcctcccgacgccctccgaccacgggcccacgtccgtccttccccgcggcccgcccgtcg

SEQ ID NO: 22311 - DNA, 691 bp, Homo sapiens
  misc_feature: GYAE6OF01CC669.12.40.D07.1.454.CMB.1.raw
  modified_base (236)..(236): a, c, t, g, unknown or other
  misc_feature (236)..(236): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtcccggacactcgcctgtgttgcctctggtatttcccttcaatttctattccatgcactgggtccnccaggctccaggcaagggggctcggagtggggtggcacttattgcacatgatggcgtacaaactaaattctacgactaaactttccggtaggacggggccgtattccacctatcctaccgaagacgaacaattaacaagaacctaccctttatactgacaaaatacgacacgcctagaacgaccaaggacgacgacggctagtcttattatgcgagagagagacacgaaccgaacctacgtacggaccaagttacgtaggtcgggggtactttcggttccggtcggggacccggtacggggtaccccgttgggtacctaacggttcccgttaccccgtacccccacggtccccttaccccgaacccggtaacccggggccccccttaagggttcccccggtttacccccgtttccccccggtacgggtacccccgtcccccgtccggtaccccgg

SEQ ID NO: 22312 - DNA, 875 bp, Homo sapiens
  misc_feature: GYAE6OF01AWSNY.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagcctgggcggtccctgacactcgcctgtgttgcctctggtatttcccttcaatttctattccatgcactgggtccgccaggctccaggcgaaggggctcgaggtgggtgctacttatgcacatgatggcgtacaaactaaattctaacgactaaagttccggtggacggggtccgatttaccaacctattcctaccgaaggaacgtaacctaaactttaaccgaaacgtaaaccctaccccgttttaatccgtagaacctaaaagttacgaactaacggtccctaggaacgaacccgaggaaccgaccgaccgggtccttacggttacctttaagtttacgtttcggaccggtacggaaacggtaacggaacggaacccgaaccgtaaacccggtaaaccccgttaaccggtaaccgggtaaccctaaaacgtttaaccggttaacggggtttacggggggttacctttttaggggttacccgggttaccgggggggtaaccccggtaacgggggggttaacccccgttcggggttaacccgtaaccggtttccccggttacccccgtacccccggtacccgggtacccccgttaacccccggaaaccccgggtaaacccggggtaccccccttaaccgggtttcccccgggtttaccccccgtttacccccccgggtcccggggttacccccggttcccccggttacccggg

SEQ ID NO: 22313 - DNA, 728 bp, Homo sapiens
  misc_feature: GYAE6OF01AOZHR.12.40.D07.1.454.CMB.1.raw
  modified_base (239)..(239): a, c, t, g, unknown or other
  misc_feature (239)..(239): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtacttttcccttcaattttctattccatgcactgggtccnccaggctccgaggcaaggggctcggaggtggggtgcacttatgcacatgagtggctacaaactaaacttctacgacaaacgttccgaggacggggccattaccgaacctattcctaccgaagaacgaactaaattaaccaaacgtaaaccttaccctttaagtctagaactaaaagtacgacacgccctaggaacgaaccgaagaccgaaccgtacggtacttagtacttaattacgttacggcgagtaagacggaacgacaaccgtaaccgaaaccttacgtacggaacctaacgttaacgtaggtcgggggttctttacgggttccgggtacgggggaccgtaaccggggtacccttgggtacccgtaacgttcccgtacccgtaccccgtaccgtaccccgtaccccgaaccgggaaccggtccccctacggttaccccggttcccccgttaccccccggtcgggtcccccgtaccccggtcccgg

SEQ ID NO: 22314 - DNA, 584 bp, Homo sapiens
  misc_feature: GYAE6OF01BAFO2.12.40.D07.1.454.CMB.1.raw
  modified_base (363)..(363): a, c, t, g, unknown or other
  misc_feature (363)..(363): n is a, c, g, or t
  modified_base (566)..(566): a, c, t, g, unknown or other
  misc_feature (566)..(566): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaaccacccctttanctgacaaatagacagcctagagacccagacgacacggctgtctattattgcgtcgagagagacacaaccgaacctactacggccaatactagtgggggtcttggttccgtggggccaggggacccctgggtcctacgtccgtcctcccccgagtccctacccgacccgaaccgggccccaacgttccggtcccttccccccgnggtcccgtcccccgtcgg

SEQ ID NO: 22315 - DNA, 550 bp, Homo sapiens
  misc_feature: GYAE6OF01CK2HN.12.40.D07.1.454.CMB.1.raw
  modified_base (287)..(287): a, c, t, g, unknown or other
  misc_feature (287)..(287): n is a, c, g, or t
  modified_base (308)..(308): a, c, t, g, unknown or other
  misc_feature (308)..(308): n is a, c, g, or t
  modified_base (358)..(358): a, c, t, g, unknown or other
  misc_feature (358)..(358): n is a, c, g, or t
  modified_base (496)..(496): a, c, t, g, unknown or other
  misc_feature (496)..(496): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggattttcccttcaatttctattccatgcactgggtccgccaggctccaggcaaggggctcgagtggtgcacttatgcacatgatggcgtnaacaattcacgcaaattccgngaggggccattcaccatctccagagacaattacaagaacctaccctttanctgacaaatagacagcctagacgaccagacgacacggctgtctattatgcgcgagagagacacacgacctactcggaccaatactagtggggtcttggttcgtggggccaggggccctggtcagtccgtcctccccgngccctccgaccgacgggccctacgtccggtccttaccccagtcggccgtccccg

SEQ ID NO: 22316 - DNA, 937 bp, Homo sapiens
  misc_feature: GYAE6OF01BLCEK.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggccggtccctgacactcgcctgtgttgcctctggtactttcccttctaattttctattccatgcacgtgggtccgccaggctccaggcgaaggggctcggaggtggggtggcacttatgcacatgatgggctacaaactaaattctaacgactaaattcccggtaggacggggcccatttccaaccctattccctacccgaaggtaacgaaacctaaaatttaaccgaaaaggtaaacccttaacccctttttaataccgttacggaaaccctaaaaaagttaacgggaaacccaacgggtacccccgttaagggaaaaccggaaacccccgaaagggaaccccggaaaccgaaccggggtacctttacgggtttaaccttaagttttaacgtttacgggaccggtaccgggaaaggaacggaacgggtaaacccaaaccgaaacccggtaaaccccgttaaccgtaccgggtaaccctaaaacgtttaaccggttaacgggttaccggggggggttacccttttacggggtttacccgggtaccgggggggtaccccggtaaccgggggggtaacccccgttacgggggttacccgtaaccggttccccggttaccccgttacccccccggtaaccggtaccccccgtttaacccccggaaacccccgggtaaacccgggggtaccccccctaaaccggtttcccccggggtttacccccttttaccccccccgggtacggggtcccccggtccccccgttaccccggg

SEQ ID NO: 22317 - DNA, 546 bp, Homo sapiens
  misc_feature: GYAE6OF01E2IEC.12.40.D07.1.454.CMB.1.raw
  modified_base (364)..(364): a, c, t, g, unknown or other
  misc_feature (364)..(364): n is a, c, g, or t
  modified_base (435)..(435): a, c, t, g, unknown or other
  misc_feature (435)..(435): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtggggtggcacttattgcacatgatggcgtcaaacaaattctacgcaaaattcccgtgaggggccattcaccatctccagagacaattacaagaacaccctttanctgcaaaatgacagcctgagaccagacacacggctgtctattattgcgcgagagagacacacgaacctacnggccaatactagtggggctttgtctggggccaggggaccctggtcactcgtcctccccgagccctaccaccgacggacccacgtccggtccttccccctggcccgccctcg

SEQ ID NO: 22318 - DNA, 552 bp, Homo sapiens
  misc_feature: GYAE6OF01AWDC2.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgtctctggatttcccttcaatttctattccatgcactgggtccgccaggctccaggcaaggggctcgagtgggtgcacttattgcacatgatggcgtcaacaaattcacgcaaattccgtgaggggccattcaccatctccagagacaattacaagaaccaccctttatctgacaaatagacagcctagacgaccagacgacacggctgtctattattgcgcgagagagacacacgaacctactggaccaatactagtggggtcttgttcgtggggccgaggggaccctggtcagtccgtcctccccgcgccctccgaccgacgggcccacgtccggtcccttccccgcggcccgcccgtcg

SEQ ID NO: 22319 - DNA, 632 bp, Homo sapiens
  misc_feature: GYAE6OF01B9CN8.12.40.D07.1.454.CMB.1.raw
  modified_base (241)..(241): a, c, t, g, unknown or other
  misc_feature (241)..(241): n is a, c, g, or t
tcagatacgacgtacacgaccggtgctcgatttagtgatagagcgtaacaacagaggactcaccatggagtttgggctgagcttgggttttcctcgttgcttcttttaagaggtgtccagtgtcaggggcacctggtggagtcgtgggggagccgtggtccagccgtgggcggtccctgacactcgcctgtgttgcctctggactttcccttctaatttctattccatgcacgtgggtccnccaggctccaggcgaaggggctcgaggtggggtgctacttatgcacatgatggcgtacaaactaaattcaacgactaaagttcccggtaggacggggcctatttccaacctatcctaccaagaacgaactaaattacgaaacgtaacctaaccctttatctagacaaatagacagcctagaacgaccagaccgacgacgctgtactattatgcgacgagagacgacacacgaactacgacgacaatacgtagtgggtcttggttacgtcgggaccgacggggtttcccaggttccacgtccgtccctaccccgacgtacccctacccgaaccgaaccgggcccctacgttacccggttccccttacccccggtcggtccccgtcccgtccg

SEQ ID NO: 22320 - DNA, 643 bp, Homo sapiens
  misc_feature: GYAE6OF01C64M5.12.40.D07.1.454.CMB.1.raw
  modified_base (244)..(244): a, c, t, g, unknown or other
  misc_feature (244)..(244): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
tcagatacgacgtacacgaccggtgctcgatttagtgatagagcgtaacaacagagggctcaccatggagtttgggctgagcgtgggttttcctcgttgctcttttaagaggtgtccagtgtcgaggggcacctggtggagtcgtgggggagccgtggtccagccgtgggccggtccctgacactcgcctgtgttgcctctggtactttcccttctaattttctattccatgcacgtgggtccnccaggcctccgaggcaaggggctcggaggtggggtgctaactttagtcgcacagtgatgggcctacaaactaaatttcacgactaaattccggnggaacgggcctattccacatcacaganaactaataacaacgtaacctaccctttanctagaacaaaatacgacagacctagacgaaccagacgtacgacgcttagtacttattagtcgcgtacgaagagacacaacaccgaacctagtacgactaaattacgtagggtgggtccttggttaccggacgggccggtacggggtaccctggtacctcgttaccccggtccctcccgaaccgtccctaacccgaccggaccggtccctacggttcccgtccccgtccccgtcggcccgtccgtaccgg

SEQ ID NO: 22321 - DNA, 593 bp, Homo sapiens
  misc_feature: GYAE6OF01EBV66.12.40.D07.1.454.CMB.1.raw
  modified_base (584)..(584): a, c, t, g, unknown or other
  misc_feature (584)..(584): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaaacaaattctacgactaaattcccgtggacgggggccgattcaccatctccagacgacaattacaagaacaccctttatctagacaaatagacagcctagacgaccaagaccgacgacggctgtactattattgcgcgagagagacacaccgaactacacggaccaatacgagtggggacttcggttacgtcggggccacgggggtaccctggtaccacgttccgtccctccccgacgtcccctccgacccgaacgggccccaacgttccggtccccttacccccgtggtcccnccccgtcgg

SEQ ID NO: 22322 - DNA, 595 bp, Homo sapiens
  misc_feature: GYAE6OF01DA4Y1.12.40.D07.1.454.CMB.1.raw
  modified_base (295)..(295): a, c, t, g, unknown or other
  misc_feature (295)..(295): n is a, c, g, or t
  modified_base (382)..(382): a, c, t, g, unknown or other
  misc_feature (382)..(382): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctggtggagtctggggggagccgtggtccagcctgggcggtccctgacactcgcctgtgttgcctctggtatttcccttcaatttctattccatgcactgggtccgccaggctccgaggcaaggggctcgagtgggtgcacttatgcacatgatggctacaaanaaattctaacgctaaaattccggtggacggggccatttccaacctatcctaccaagagaacaattacaaacgtaacctaccctttanctagacaaaatacgacagcctagacgaccagacgacgacggctgtactatattgcgacgaagagagacacaacgaaactacgtgactaatactagtggggtcttggtcgtggggccgacggggaccctggtcagtccgtcctaccccgacgccctacccgaccgaaccgggcccacgtcccggttacccttcccccgtcggcccgtcccgtcg

SEQ ID NO: 22323 - DNA, 673 bp, Homo sapiens
  misc_feature: GYAE6OF01C6NOJ.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtactttcccttcaatttctattccatgcactgggtcccgccaggctccgaggcaaggggctcgagtggggtgctacttatgcacatgatggcgtacaaactaaattcctaacgactaaaacgtttccgtggacgggggccaatttccaaccatcctaccgaagaagaacctaaaattaacaaacgtaacctaaccccttttaatcctagaactaaaatacgaacacggcctaggaacgaacccaaggaccgacgaccgggtcttaggttaccttaatttacttggcgtacgaaggaagaacgaaccaaccgaaccgaaccctacgtacggaccaaatacgtaaggtgggggtcttggttcggtcggggccgacggggtaccctggtcctacgtccgtcctaccccgcgacccctcccgaacccgaccgggacccacgttcccggttccccttcccccgtcggcccgcccgtccg

SEQ ID NO: 22324 - DNA, 572 bp, Homo sapiens
  misc_feature: GYAE6OF01A9P1L.12.40.D07.1.454.CMB.1.raw
  modified_base (366)..(366): a, c, t, g, unknown or other
  misc_feature (366)..(366): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggccaagggggctcggaggtggggtggcacttattgcacatgatggcgtcaacaaattctacgcaaattccgtgaggggccattcacctatctccagagacaattacaagaacaccctttanctgacaaatagacagcctagacgaccagacgacacggctgtctattattgcgcgagagagacacacgaacctactaggaccaatactagtcggggtcttggtcgtgggccgtaggggaccctggcctagtccgtcctccccgacgccctaccgacccgacgggcccacgttcccggtacccttcccccggtcgcccgtccccgtcg

SEQ ID NO: 22325 - DNA, 724 bp, Homo sapiens
  misc_feature: GYAE6OF01CPBY1.12.40.D07.1.454.CMB.1.raw
  modified_base (149)..(149): a, c, t, g, unknown or other
  misc_feature (149)..(149): n is a, c, g, or t
  modified_base (195)..(195): a, c, t, g, unknown or other
  misc_feature (195)..(195): n is a, c, g, or t
  modified_base (239)..(239): a, c, t, g, unknown or other
  misc_feature (239)..(239): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
tcagatacgacgtacacgaccggtgctcgatttagtgatagagcgtaacaacagagggctcaccatggagtttgggctgagcgtggtttcgcgtagctctttaagaggtgtccagtgtcgaggggcacctggtggagtcgtgggggganccgtggtccagcctgggcggtccctgacactcgcctgtgttgcctntggtactttcccttctaattttctattccatcgcacgtgggccnccaggcctccgaggccgaaggggtctcggaggtggggtgactactttatgcacatgatggctacaaactaaattcacgactaaagtttccggtaggacgggggccctaatttcccaaacctacgttcctaccaagacgaaaacctaaaattaccgaaaacgtaacccttaaccccttttanccggtaacaactaaaanacggaactacgccgtaagaacgaaacccgtagaaccgtaacgacggtctgttacttaagtttacgtcgacgacggtaaggaacgaacgaacctaaccgaaccgtaaccgttacgtacggaacctaaagttacgtacgggtcgggttacgtttggtcgggtacgggaccggaacggggtccgtcggtacgtacgttcccgtacccgtaccccgacgtcccctaccgacccggaacccggtcccctacgttcccggttaccccttccccggtcggccccgtcccgtccg

SEQ ID NO: 22326 - DNA, 713 bp, Homo sapiens
  misc_feature: GYAE6OF01DUZVV.12.40.D07.1.454.CMB.1.raw
  modified_base (433)..(433): a, c, t, g, unknown or other
  misc_feature (433)..(433): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtcgtgggggagccgtggtccagcctgggcggtccctgacactcgcctgtgttcgcctctggtactttcccttctaatttctattccatgctacgtgggtccgccaggctccgaggcgaaggggctcggaggtcgggtgctacttatgacacatgatggactacaaactaaattccgtacgactaaagttccggtaggacggggtcctattaccgaaccctattcctaccaagggaacaactaaattaaccgaaacgtaaacccttaccccttttaatactacgaaacctaaanacgtaacacggtaccaggaaccgaaccaggaaccgaccgacggtcttcggttaacttagtttaacgttcggacgtacgaagacgaacgaccaaccgtaaccgaacccttaacgtcggaaccctaaagtacgtagggttacggggtcttagggtccggtcggggaccgacgggtacccgtggtacctacgttccgtccctacccgcgtacccctaccggacccgaaccgggtccctacggttccccggtcccttacccccggcggtccccgtcccgtccgg

SEQ ID NO: 22327 - DNA, 545 bp, Homo sapiens
  misc_feature: GYAE6OF01D3Z7O.12.40.D07.1.454.CMB.1.raw
  modified_base (361)..(361): a, c, t, g, unknown or other
  misc_feature (361)..(361): n is a, c, g, or t
  modified_base (495)..(495): a, c, t, g, unknown or other
  misc_feature (495)..(495): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttanctgacaaatagacagcctgagaccagaacgacacggctgtctattattgcgcgagagagacacacgaacctactggccaatactagtggggcttgttcgtggggccaggggaccctggtccatccgtctcccgngccctccgaccaacggcccacgtccggtccttcccccgtggccgccctcg

SEQ ID NO: 22328 - DNA, 564 bp, Homo sapiens
  misc_feature: GYAE6OF01CGHRN.12.40.D07.1.454.CMB.1.raw
  modified_base (234)..(234): a, c, t, g, unknown or other
  misc_feature (234)..(234): n is a, c, g, or t
  modified_base (390)..(390): a, c, t, g, unknown or other
  misc_feature (390)..(390): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaacaaattcacgcaaattccgtgaggggccattcaccatctccagacgacaattacaagaactaccctttatctgacaaatgacagcctgagacccagacganacggctgtctattatgcgcgagagagacaacaccgaacctacgtacggaccaatactagtagggggtctttggttcgtcggggccagggggaccctggtcagtcgtcctccccgagccctcccaccgaacgggcccacgttccggtaccttcccccgtcggcccgtcccgtacg

SEQ ID NO: 22329 - DNA, 560 bp, Homo sapiens
  misc_feature: GYAE6OF01EZ03G.12.40.D07.1.454.CMB.1.raw
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtatttcccttcaatttctattccatgcactgggtccgccaggctccaggcaaggggctcgagtgggtgcacttattgcacatgatggctcaacaaattctacgcaaattccgtgaggggccattcaccatctccagagacaattacaagaacaccctttanctgacaaatagacagcctgagaccagacgacacgctgtctattattgcgngagaganacacacgaacctacnggaccaatactagtggggcttggttcgtggggtccacggggaccctggtcacttccgtcctccccgagccctacccaccgaacgggccccacgttccggtcccttccccccgtcgggcccgtccctcgg

SEQ ID NO: 22330 - DNA, 811 bp, Homo sapiens
  misc_feature: GYAE6OF01ESPIY.12.40.D07.1.454.CMB.1.raw
  modified_base (222)..(222): a, c, t, g, unknown or other
  misc_feature (222)..(222): n is a, c, g, or t
tcagatacgacgtacacgaccggtgctcgatttagtgatagagcgtaacaacagaggactcaccatggagtttgggctgagctgggttttcctcgttgcttcttttaagaggtgtccagtgtcgaggggcaccgtgggtggaggtcgtggggggagccggtggtccagccgtgggccggtccctgacactcgcctgtgttcgcctcgtggtactttcccttntaatttctacttccatgccacgtcgggtccgcaggcctccgaggacgaagggctcggaggtgggtgctacttagtcgcacatgagtcggcgtacaaactaattcctacgactaaacgttccggtaggacggggcctattaccgacctactcctaccgaagtacgaaactaaattaaccgaaacgtaaacccttaccctttaatcttaacggaaacctaaaagtacgaaccgtaacgtacccgtaggaaaccgaacccgtaacggaaccgtaaccgacggtaccttacgttacttaagtttacgttacggacggtaacgaagtaacggaacgtaaccaaccgtaaacccgtaaacccgttaacgtacggtaaccctaaagttaaccggtaagggttcgggggttacctttacggggttaccggtaccgggggtaccggtaaccggggtacccgttgggtaccgtaaccgttcccgtacccgtaccccgtaccgtaccccgtacccggaaacccggtacccgggtacccctaacgggtttcccccggtacccccgtttacccccggccgggtcccccgtcccgttacccgg

SEQ ID NO: 22331 - DNA, 607 bp, Homo sapiens
  misc_feature: GYAE6OF01DKO3N.12.40.D07.1.454.CMB.1.raw
  modified_base (346)..(346): a, c, t, g, unknown or other
  misc_feature (346)..(346): n is a, c, g, or t
  modified_base (425)..(425): a, c, t, g, unknown or other
  misc_feature (425)..(425): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtctggggggagccgtggtccagcctgggcggtccctgacactcgcctgtgttgcctctggatttcccttcaatttctattccatgcacgtgggtccgccaggctccaggcaaggggctcgagtgggtgcacttatgcacatgatggctacaaactaaattcctaacgcaaaactttccggtggagggggcccgaatttccaacctntcctccaagagaaccaaattacaaagaacctaacccttttatactagacaaaatacgacagcctagacgaaccagacgnacggctgtctattatgcgcgagagagacacaacgaacctacgtggacctaatactagtggggactttggtcgtggggccaacggggtccctggtctacgtccgtacctcccccgagtcccctaccacccgaacggggcccctacggttcccgtacccttcccccggtcggcccgtcccgtcg

SEQ ID NO: 22332 - DNA, 660 bp, Homo sapiens
  misc_feature: GYAE6OF01DN58X.12.40.D07.1.454.CMB.1.raw
  modified_base (237)..(237): a, c, t, g, unknown or other
  misc_feature (237)..(237): n is a, c, g, or t
  modified_base (365)..(365): a, c, t, g, unknown or other
  misc_feature (365)..(365): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggatttcccttcaattttctattccatgcactgggtccnccaggctccaggcaaggggctcgagtgggtggcacttattgcacatgatggcgtcaacaaattctaacgcaaattccggtgaggggccattcaccatctccagagacaattacaagaacaccctttanctgacaaatagacagctgagaccagacgacacggctgtctattattgcgcgagagacgacacaacgaaacctacgtacggtaccaaattactaaggttcggggggtactttacgggtttccggtacgggggacccgtaacggggggtaccccgttggggtaccctaacgttccggtaccccgttcccccgaaccggtcccccttacccgaaacccggtaaaccggggccccctaacgttccccgggttacccgtttcccccccggtgggtccccggtcccccgttcggtaccccg

SEQ ID NO: 22333 - DNA, 677 bp, Homo sapiens
  misc_feature: GYAE6OF01AWMJ5.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcggagtggggtggcacttatgcacatgatgggcgtacaaactaaattcctaacgactaaaacgtttcccggtaggacgggggcccgtatttccgaaccctaattcctacccgaaggaacggaaacctaaaacgtttaaaccaaaacggtaaacctaaccccctttttaagtctacgacctaaaagtacgaacacggccttaggaacgaacccgaagaccgaacgaccggtacttagttacttagttagttcggcgacgaagagacgacaacaaccgaacctacgtacgaccaaatacgtacggtggggtcttggttcggtacgggccgacggggtaccctaggtctacgtccgtccgtacccgcgccctcgacccgacggacccacgttcccggttcccttccccgcggtcccgtcctccgg

SEQ ID NO: 22334 - DNA, 541 bp, Homo sapiens
  misc_feature: GYAE6OF01EVA43.12.40.D07.1.454.CMB.1.raw
  modified_base (498)..(498): a, c, t, g, unknown or other
  misc_feature (498)..(498): n is a, c, g, or t
  modified_base (531)..(531): a, c, t, g, unknown or other
  misc_feature (531)..(531): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttatctgacaaatagacagcctgagaccagacgacacggctgtctattattgcgcgagagagacacgacgaacctactcggaccaatactagtggggtcttgttcgtggggccgaggggaccctggtcacgtcgtcctcccncgcctccaccacggccacgtccgtcctccccgngccgccgtcg

SEQ ID NO: 22335 - DNA, 586 bp, Homo sapiens
  misc_feature: GYAE6OF01ES6C1.12.40.D07.1.454.CMB.1.raw
  modified_base (343)..(343): a, c, t, g, unknown or other
  misc_feature (343)..(343): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtacaacaaattctacgcaaagttccgtaggacggggccgtattcaccatctcaganaacaattacaagaacctaccctttatctagacaaaatacgacagcctgaacgaccagaccgaacacgctgtctattattgcgcgagagagacacacgaacctacgtcgaccaatactagtggggtcttcgggttcgtcggggacgacgggtacccgtggtccacgtccgtacctcccgacgtccctacccgaccgaaccggacccacgttccgttcccgttcccccgtcggccgtccccgtcg

SEQ ID NO: 22336 - DNA, 711 bp, Homo sapiens
  misc_feature: GYAE6OF01EE3LH.12.40.D07.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (290)..(290): a, c, t, g, unknown or other
  misc_feature (290)..(290): n is a, c, g, or t
  modified_base (398)..(398): a, c, t, g, unknown or other
  misc_feature (398)..(398): n is a, c, g, or t
tcagatacgacgtacacgaccggtgctcgatttagtgatagagcgtaacacagagggctcaccatggagtttgggctgagcgtgggttttcctcgttgctcttttaagaggtgtccagtgtcaggggcacctggtggagtcgtgggggagccgtggtccagccgtgggcggtccctgacactcgcctgtgttgcctntggatttccctntaatttctattccatgctacgtggggtccnccaggcctccgaggccgaaggggctcggaggtggggtgctacttatcgcanatgatggctacaaacaattctaacgactaaacgttccgtaggacggggcctattaccaacctattcctaccaagaacgaactaaattaacaaagtaacctacctttanacttcgaaactaaatacgacgaacgtccgtagaaccgaaccaacggaacgaaccgtacggtctagttacttaagttacgtgacgtaacgagacgtaacgacaacgtaaccgtaaccgtcgaccggacctaatacgtagggttacgggtctttacggttccggtacggggccgtaaccggggtacccttagggtacctaccggtcccgtaccctaccccgaccgtaccccgtacccggaacccgtaacccggggtaccctacggttcccggttacccccctttcccccgggccggtcccggtccccgttcccgg

SEQ ID NO: 22337 - DNA, 585 bp, Homo sapiens
  misc_feature: GYAE6OF01EQBBG.12.40.D07.1.454.CMB.1.raw
  modified_base (358)..(358): a, c, t, g, unknown or other
  misc_feature (358)..(358): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaagggctcgagtgggtgcacttatgcacatgatggcgtcaacaattctacgcaaattccgtgaggggccgattcaccatctccagagacaattacaagaaccaccctttanctgacaaatagacagcctgaacgaccagacgacacggctgtctattntgcgngagaagagacacaaccgaacctactacggaccaatactagtcgggggtcttggttcgtcggggaccgacggggtaccctggtacctacgtccgtccctccccgacgtccctacccgacccgaaccgggccccaacgtcccggtccctttccccccgcggtcccgccccgtcccgg

SEQ ID NO: 22338 - DNA, 601 bp, Homo sapiens
  misc_feature: GYAE6OF01C0ISH.12.40.D07.1.454.CMB.1.raw
  modified_base (379)..(379): a, c, t, g, unknown or other
  misc_feature (379)..(379): n is a, c, g, or t
  modified_base (460)..(460): a, c, t, g, unknown or other
  misc_feature (460)..(460): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtactttcccttcaattttctattcccatgcacgtcgggtcccgccaggcctccgaggcgaaggggcctcggaggtggggtgcaccttattgcacatgatggctcaaacaattctacgctaaattccgtggaggggccattcaccatctccagagacaattacaagaacctaccctttanctagacaaaatagacacgcctagaacgaccagaccgacacggctgtactattattgcgcgagagagacacacgaacctacnggaccaatactagtcggggtctttggttcgtggggcccgaggggaccctggtcctagtccgtcctcccccgtacgcccctccgaacccgaacgggcccctaacgtcccggtcccttcccccgtcggcccgtccccgtccgg

SEQ ID NO: 22339 - DNA, 584 bp, Homo sapiens
  misc_feature: GYAE6OF01B8TEF.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgcaggctccaggcaaggggctcggagtggggtgcacttattgcacatgatggcgtcaaacaaattctacgcaaattccgtgaggggccattcaccatctccagagaactaattacaaagtaactaccctttatctgacaaatagacagcctgacgaccagacgacacgctgtctattattgcgcgaagagagacacacgaacctacgtgaccaatactagtggggtcttgttcgtcggggaccgtacggggaccctgggtccagtccgtccgtccccgcgcccctaccgacccgaaccgggcccctaacgtcccggtcccgttacccccgtcgggtcccgtccccgtccgg

SEQ ID NO: 22340 - DNA, 594 bp, Homo sapiens
  misc_feature: GYAE6OF01DS3M5.12.40.D07.1.454.CMB.1.raw
  modified_base (109)..(109): a, c, t, g, unknown or other
  misc_feature (109)..(109): n is a, c, g, or t
  modified_base (237)..(237): a, c, t, g, unknown or other
  misc_feature (237)..(237): n is a, c, g, or t
  modified_base (371)..(371): a, c, t, g, unknown or other
  misc_feature (371)..(371): n is a, c, g, or t
  modified_base (433)..(433): a, c, t, g, unknown or other
  misc_feature (433)..(433): n is a, c, g, or t
tcagatacgacgtacacgaccggtgctcgatttagtgatagagcgtaacaacaggagggctcaccatggagtttgggctgagctgggtttcctcgttgctcttttaagnggtgtccagtgtcaggggcacctgggtggagtctggggggagccgtggtccagcctgggcggtccctgacactcgcctgtgttgcctctggactttcccttcaatttctattccatgcactgggtccncaggctccaggcaagggggctcggagtggggtgcacttattgcacatgatcggcgtacaacaaattctaacgcaaattccggtgacggggccattcacatctccagacgacaattaacaagactacccgtttanctagacaaaatgacagcctagacgaccagaaccgcacggctgtctatattgcgacgagaganacacacgacctacgacggacaagtacgtaagtcggggtacttgggttaccgtggggaccgacggggtaccctggtccacgtcggtaccctccccgacgtccctaccgacccgaacgggtcccacgtcccggtccttacccccgtgggcccgtcccgtccgg

SEQ ID NO: 22341 - DNA, 854 bp, Homo sapiens
  misc_feature: GYAE6OF01C52D7.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctctggtactttcccttctaattttctattccatgcacgtcggggtccgccaggcctccgagggcgaaggggctcggaggtggggtgctacttatgcacatgatggcgtacaaactaattcaacgactaaagttccggtaggaacggggccctattccaaccctatcctaccgaagaacgaacctaaagttaaccaaacgtaaaccctaccccttttaatccctaagaacctaaaaagtacgacctaacggtaccctaggaaacgaacccgaaaggaacccggaaccgtaaccggtaccttacggttacctttaagtttacgttacggaccggacggtaaaggtaacggaacgaacccaacccgtaaacccggtaaacccttaaccgtaacgggaaccctaaacgttaacggttaacgggttcggggggttaccttttacgggtttaccgggtacgggggaccccggttaaccgggggtaccccggttacgggttaaccctaacggttccccggttaccccgtaccccccgtaaccggtacccccgttaaccccggaaaccccgggtaaaccccggggtacccccgttaaccggtttcccccggggtttacccccgtttaccccccccggtcggggtcccccgtcccccggttacccggg

SEQ ID NO: 22342 - DNA, 610 bp, Homo sapiens
  misc_feature: GYAE6OF01CG13D.12.40.D07.1.454.CMB.1.raw
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
  modified_base (434)..(434): a, c, t, g, unknown or other
  misc_feature (434)..(434): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtacttttcccttctaattttctattccatgcacgtgggtccgccaggctccgaggcaaggggctcggaggtgggtgctacttattgcanatgatggctacaacaaattctaacgctaaagtttccggnggacggggcctatttccaacctatcctaccagacgaacaaattacaaacgtaacctaccccttttatcctagacaaaatgaacagccctagacgaccagaccgacncggctgtctattatgcgcganaganacacaccgaactacgtacggacctaatacgtagtcggggtcttggttcgtcggggcctacggggaccctggtcctacgtccgtccgtcccgacgtccctacccaccgaacggccctacgtcccggtacccttccccgcggcccgcccgtcg

SEQ ID NO: 22343 - DNA, 609 bp, Homo sapiens
  misc_feature: GYAE6OF01AFFNV.12.40.D07.1.454.CMB.1.raw
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
  modified_base (376)..(376): a, c, t, g, unknown or other
  misc_feature (376)..(376): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctgggtggagtctggggggagccgtggtccagcctgggcggtccctgacactcgcctgtgttgcctctggatttcccttnaatttctattccatgcactgggtccnccaggctccaggcaaggggctcgagtggggtgcacttatgcacatgatggcgtacaacaaattctacgctaaattccgtggacggggccgattccaccatcctccagacgacaattacaaacgaacctaccccttttanctagacaaaatacgacagccctagaactaccaggaccgacgacggctagtctattattgcgcgagagagacacaccgaacctactcggaccaatactaggtacgggggtctttcggttcgtcggggccgacggggaccctgggtctacgtccgtccctccccgacgtccctaccgacccgaaccgggccctacgttcccggttcccttcccccggtcggtcccgtcccgtcgg

SEQ ID NO: 22344 - DNA, 547 bp, Homo sapiens
  misc_feature: GYAE6OF01DQARF.12.40.D07.1.454.CMB.1.raw
  modified_base (356)..(356): a, c, t, g, unknown or other
  misc_feature (356)..(356): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggattttcccttcaatttctattccatgcactgggtccgccaggctccaggcaaggggctcgagtgggtgcacttattgcacatgatggcgtcaaacaaattctacgcaaattccgtgaggggccatcacatctcagagacaatacaagacaccctttanctgacaaaatagacagcctagacgaccagacgacacggctgtctattatgcgcgagagagacacacgaactactgaccaatacgtagtggggtcttgtcgtgggccgaggggtccctggtcacgtccgtcctccccgacgccctccgaccgacgggcccacgttccgtccctccccgtggcccgcccgtcg

SEQ ID NO: 22345 - DNA, 608 bp, Homo sapiens
  misc_feature: GYAE6OF01BLQKQ.12.40.D07.1.454.CMB.1.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (393)..(393): a, c, t, g, unknown or other
  misc_feature (393)..(393): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
  modified_base (554)..(554): a, c, t, g, unknown or other
  misc_feature (554)..(554): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggatttcccttnaatttctattccatgcactgggtccnccaggctccaggcaaggggctcggagtggggtgctacttatgcacatgatggctacaaactaaattccaacgactaaagttcccggtaggacggggtcccattccaccatcctaccaagacgaactaattaaccaaagtaaaccctacccttttaancctagaacaaaagtacgaacacgccctagaacgaccgaagaccgacgacggtctagtacttattagttgcgagagaganacacacacctacncgacaatactaggtgggtcttgtcgtgggccgacgggacctggtctacgtccgtcctcccgacgtcccncccgaccgacggcccctacgtcccggtcccttcccccgcggtcccgcccgtccg

SEQ ID NO: 22346 - DNA, 658 bp, Homo sapiens
  misc_feature: GYAE6OF01APY2M.12.40.D07.1.454.CMB.1.raw
  modified_base (398)..(398): a, c, t, g, unknown or other
  misc_feature (398)..(398): n is a, c, g, or t
tcagatacgacgtacacgaccggtgctcgatttagtgatagagcgtaacaacagagggctcaccatggagtttgggctgagcgtgggttttcctcgttgctcttttaagaggtgtccagtgtcaggggcacctgggtggagtcgtggggggagccgtggtccagcctgggcggtccctgacactcgcctgtgttgcctctggtatttcccttcaatttctattccatgcactgggtccgccaggctccaggcgaaggggctcggaggtggggtggctacttagtgcacatgatggcgtacaaactaaattctaacgactaaattccggtaggacggggtcctaattccaacctatcctaccaagaacgaacctaattaacaagaaccctacctttaanctagacaaatacgacacgcctagacgaccagacgacacgctgtactattagtgcgagaagagacgaacaccgacgaaccgtacgcggtaccaacgtacgtaggtcggggtctttaggttccggtcgggggaccgtacgggggtaccccttgggtacctacgttcccggtacctaccccgacggtccccctaccgaacccggaaccgggtcccccgagttccccggttccccgttacccccgcggccccgttcccgtccgg

SEQ ID NO: 22347 - DNA, 723 bp, Homo sapiens
  misc_feature: GYAE6OF01CZVWA.12.40.D07.1.454.CMB.1.raw
  modified_base (284)..(284): a, c, t, g, unknown or other
  misc_feature (284)..(284): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttcgcctctggtacttttcccttcaattttcattccatgcacgtgggtccgccaggctccgaggcgaaggggctcggaggtgggtggctaacttnttgacacatgatggcgtcaaaactaagttctacgacaaaatttccggagaggggccgattccaacctattcgtccaagagaactaattaacgaactaactaccctttatctagacctaaatacgacacgcctagaacgaccagaacgacgacggtactcgtacttacttagtcgacggacgaagaggaacgaacctaaccgaaccgaaccttacggtacgaccctaagttaccgtaaggttcggggtactttcgggttaccggcgggggtacccgaacgggggtccccttagggtccctaccgttcccgttacccgtacccccgtaacgtcccccgtaacccgtaaaccccgggaaccggggtccccccaaagggtttcccccgggttccccccgttttaccccccggtaaccggggtccccccgtccccggttcccgg

SEQ ID NO: 22348 - DNA, 592 bp, Homo sapiens
  misc_feature: GYAE6OF01EBGDN.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccgaggcaaggggctcgaggtgggtggctacttattgcacatgatggctacaaactaaattctacgactaaagttccggtggaggggcctattccaccatcctccagagaactaattacaaacgaacctaccctttatcctagacaaatagacagcctagacgaccagacgacacgctgtactattatgcgagagagagacacaacgaacctacgtacggaccaatacgtaagtggggtcttggttcgcggggccgacgggaccctggtctacgtccgtcctccccgacgtccctacccgaccgacggccccacgttcccggtcccttcccccgcgggcccgtcccgtccg

SEQ ID NO: 22349 - DNA, 576 bp, Homo sapiens
  misc_feature: GYAE6OF01BBI2U.12.40.D07.1.454.CMB.1.raw
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (438)..(438): a, c, t, g, unknown or other
  misc_feature (438)..(438): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggattttcccttcaattttctattccatgcactgggtccgccaggctccgaggcaaggggctcgagtgggtggcacttatgcacatgatggcgtcaacaaattcacgcaaattccgtgaggggccattcacatctcaganacaatacaagaacaccctttanctagacaaatacgacagcctagacgaccagacgacacgctagtctattatcgcgacgagagagaacacacgaacctacgngaccaatacgtagtcggggtcttcggtcgtcggggtacacggggtaccctggtcacgtccgtccgtccccgagtccctaccgaacccgacgggtaccccagttcccggtcccttacccccgtggcccgtcccgtccgg

SEQ ID NO: 22350 - DNA, 641 bp, Homo sapiens
  misc_feature: GYAE6OF01BC5K8.12.40.D07.1.454.CMB.1.raw
  modified_base (393)..(393): a, c, t, g, unknown or other
  misc_feature (393)..(393): n is a, c, g, or t
  modified_base (423)..(423): a, c, t, g, unknown or other
  misc_feature (423)..(423): n is a, c, g, or t
  modified_base (504)..(504): a, c, t, g, unknown or other
  misc_feature (504)..(504): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtcccagccctggggcgtcctcgacgacctacggcccttagttccgtttacggtcccttacttcgggtacgttttccccgttccggtaaactttttccggtacttaccggactcgactaacgtgggtccgccaggctccaggcaaggggctcgaggtgggtggcacttattgcacatgatggcgtacaaactaaatttctaacgcaaaatttccggtggacggggccattcaccatcnccagagacaattacaagaacctacctttanctgacaaatagacagcctagacgaccagaccgacgacgcgtgtactagttattcgcgacgagagagacacaccgactacgngacaatactgtacgggtcttgttcgtcgggccgacgggtaccctggtcactccgttccctacccgccgtccctacccgtacccgaacggcccctacgttccggttaccccgttcccccgtcggtcccggccctccgg

SEQ ID NO: 22351 - DNA, 630 bp, Homo sapiens
  misc_feature: GYAE6OF01DD3OB.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgcaggctccaggcaaggggctcgagtgggtggcacttattgcacatgatggcgtcaaactaaattctaacgctaaaacttccggtaggacgggggaccgattccaccactctcccaagagaactaattacaaagaacctaccctttatctgacaaaatagaacacgcctgacgaccaggacgacgacggctgtctatattgcgacgagagagacaccacgaacctacgtcgaccaatactagtggggtctttgggtcgtggggccgacggggtaccctggttacctacgtaccgtccctaccccgaccgtcccttacccgaacccgaaccggggtcccctaacggttcccgggttacccctttcccccccggtcgggtccccgtcccccgttcccgg

SEQ ID NO: 22352 - DNA, 596 bp, Homo sapiens
  misc_feature: GYAE6OF01ERRSD.12.40.D07.1.454.CMB.1.raw
  modified_base (454)..(454): a, c, t, g, unknown or other
  misc_feature (454)..(454): n is a, c, g, or t
  modified_base (574)..(574): a, c, t, g, unknown or other
  misc_feature (574)..(574): n is a, c, g, or t
  modified_base (590)..(590): a, c, t, g, unknown or other
  misc_feature (590)..(590): n is a, c, g, or t
tcagatacgacgtacacgaccggtgctcgatttagtgatagagcgtaacacagagggctcaccatggggtttgggtcgtgagctgggttttccgttccgttgtctcttttaagtaaggtggtccagtgtcaggggcgacctggtggagtctgggggaggccgtggtccagcctgggcggtccctcgacactcgcctgtgttgcctctggatttcccttcaatttctattccatgcactgggtccgccaggctccaggcaaggggctcgaggtgggtggcacttattgcacatgatggcgtcaacaaattctacgcaaattccgtggaggggccgattcaccatctccagagacaaattacaacgaacacccttttatctgactaaaatagacacgcctgacgaccagacgacacggctgtactattattgcgcgagagagacacacgaacctanggccaatactagtggggcttgtcgtcggggccgacgggacccgtgtcctagtccgttcccgcccctacggccctccgaacccgaacgggtcccccagttcccggttccctttccccccgngggccccgttccccgngtcccg

SEQ ID NO: 22353 - DNA, 743 bp, Homo sapiens
  misc_feature: GYAE6OF01ED53A.12.40.D07.1.454.CMB.1.raw
  modified_base (477)..(477): a, c, t, g, unknown or other
  misc_feature (477)..(477): n is a, c, g, or t
  modified_base (733)..(733): a, c, t, g, unknown or other
  misc_feature (733)..(733): n is a, c, g, or t
  modified_base (738)..(738): a, c, t, g, unknown or other
  misc_feature (738)..(738): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggacgcgtgtcagccgtgggccgtcctgacactcgctgtgtcgcctgtggtactttcccttactaactttcttacttcctagtcgcctacgttcggggtcccgaccgaggtcctaccgagggaccggaacggggtcctcggtagggttggggtcggacttaacttttagtcgacactagtgtagtcggccgtaacaaaacttaacttccgtaacggtaactaaaacgtttccgggtaggggaccgggggccttacttaccaacctattaccctaccgaaggaaacgtaacctaaagttaaaccgaaaacgtaaacccttaacccgttttancgtacgaactaaaagtacgaacacgtccgtaaggaccaaccgaacggacgaaccggaacgtcttcgtaacttagtttacgtcggacgacgaagagactaaccaacaaccgtacctagtacgaactaacgttacgtgggtacggggttcttcgggttcggtacggggtacccggtacgggtacccgtggtaccgtacgttccgtccctacccgcgtaccctaccgaccgacggcccacggttcccgtccttcccggngcccncgtcg

SEQ ID NO: 22354 - DNA, 598 bp, Homo sapiens
  misc_feature: GYAE6OF01ETWNY.12.40.D07.1.454.CMB.1.raw
  modified_base (263)..(263): a, c, t, g, unknown or other
  misc_feature (263)..(263): n is a, c, g, or t
  modified_base (371)..(371): a, c, t, g, unknown or other
  misc_feature (371)..(371): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggcctcaggcaagggctgagtgggngcacttatgcacatgatggcgtacaaactaaattcctaacgcaaaattccggtaggacggggccattcaccatctccagagtacaattacaacgaactaccctttaanctagacaaaatacgacagcctgaacaccagacgacacggctgtactattacttggcgacgagaagacgacaacacgaacctactggaccaatactaggtggggtcttgttcgcggggccgacggggtaccctggtacacgttcccgtccgtcccccgacgccctacccgaacccgaccgggacccctacgtcccggttcccttcccccgtcgggcccgtcccgtccg

SEQ ID NO: 22355 - DNA, 579 bp, Homo sapiens
  misc_feature: GYAE6OF01E2272.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaagggctcgagtgggtgcacttattgcacatgatggcgtcaacaaattctaacgcaaattccgtggacggggccgattccaccatctccgagagacaattacaagaaacctaccctttatctagacaaagtagacagcctagacgaccagacgacacgctgtctattatgcgcgagagagacacaccgaacctactgaccaatacgtagtggggtctttggtcgtacggggtccgacggggtaccctggtaccacgtccgtcctaccccgcgtccctacccacccgacggcccctacgtccggttcccttaccccggcggcccgcccgtccg

SEQ ID NO: 22356 - DNA, 695 bp, Homo sapiens
  misc_feature: GYAE6OF01BX8JI.12.40.D07.1.454.CMB.1.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (393)..(393): a, c, t, g, unknown or other
  misc_feature (393)..(393): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcactggtggagtctgggggagccgtggtccagcctgggcggtccctgacactcgactggtgttgcctactggatttccctnaatttctattccatgcactgggtccncaggctccaggcaaggggctcggaggtgggtgctacttatgcacatgatggctacaaactaattcacgactaaacgttcccggtaggacgggggtccgtatttaccaacctattcctaccgaagacgaacaaatttacaaaggtaacctacccttttanactacgaacgtaaagtacgaccgacgtacccgtaggaacgtacccaggaccgacgaccggtctacgtacttattacgtcggccgacgacggtacgacgaaccaaccgaccgtaacctacgtacgacctaacgtacgtaggtcggggtacttcgggttcggtcggggtcccggacggggtacccgtggtaccgacgttccgtacccgtccccgtacgtaccccgtaccccggaaccgaacccgggccccttaacggttcccgggttacccttccccccggtcgggccccgtcccggtacccgg

SEQ ID NO: 22357 - DNA, 664 bp, Homo sapiens
  misc_feature: GYAE6OF01ES2T0.12.40.D07.1.454.CMB.1.raw
  modified_base (92)..(92): a, c, t, g, unknown or other
  misc_feature (92)..(92): n is a, c, g, or t
  modified_base (149)..(149): a, c, t, g, unknown or other
  misc_feature (149)..(149): n is a, c, g, or t
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (382)..(382): a, c, t, g, unknown or other
  misc_feature (382)..(382): n is a, c, g, or t
tcagatacgacgtacacgaccggtgctcgatttagtgatagagcgtaacaacagagggctcaccatggagtttgggctgagcgtggtttccncgttgctcttttaagaggtgtccagtgtcaggggcacctggtggagtcgtggggganccgtggtccagcctgggcgtccctgacactcgctgtgttgcctctggtactttccctnaattttcctattccatgcacttggggtcccnccaggcctccgaggccgaaggggcctggagtggggtgctacttatgcacatgatggctacaaactaattctaacgctaaagttccggtggacggggcctattccacatcctacagagactaattacaaagtaacctacctttanactacgacaaagtagactaagcctagacgaccgaagacgacgacggtctgtactattagttgcgtacgagagaacgacaacgaccgtaactacgtacggaccaagttaccgtaggtacggggtctttcgggtacggttcggggacctacggggtacccgtaggtaccgtacgttaccggtcccctaccccgtaacggtccccttaacccgaacccgtaaccggggtcccctaacggttccccggttacccttaccccccgtcgggtccccgtacccgtccgg

SEQ ID NO: 22358 - DNA, 675 bp, Homo sapiens
  misc_feature: GYAE6OF01B4910.12.40.D07.1.454.CMB.1.raw
  modified_base (152)..(152): a, c, t, g, unknown or other
  misc_feature (152)..(152): n is a, c, g, or t
  modified_base (359)..(359): a, c, t, g, unknown or other
  misc_feature (359)..(359): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtgggggganccggtggtccagcctgggccggtccctgacactcgcctgtgttcgccctgtacttccttctattcttatactatgtcactcgggtccgccacggacgtccaggacgaggggtacgtcgaggtggggttggactactttattgccgacagtgagtaggcgtacaaacaaattctacgactaaagtccgtggagggccgattctaccanctacagaagacaatacaagaccacctttatntaganaaatacgacacgctacgagaacctagaacgacgacgtcgtgttactacgttatcgacgacggaagtaagacgaacaaccgtaacgaaccctaacgtcggacctaataaccgttaggtcggggtacttacggttcgtccgggggaacccggtagggccccgttacgtcgtaaccgtcgttaccccgtccccaaccggcccgttacccaaacccggtaccggggtcccctaacgttccccggttcccggttacccccctccggggctccccgtccgtacccg

SEQ ID NO: 22359 - DNA, 901 bp, Homo sapiens
  misc_feature: GYAE6OF01D42A8.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttatgcacatgatggcgtacaaacaaattctaacgactaaattcccggtaggacgggggccgtaatttccaaccgtattcctacccaaggaacggaacctaaatttaaccaaaacggtaaaccctaaccccgtttttaatccgttagaacctaaaaagttaacggaaccaacggcccctaggaaccgaaccccgaaggaaacccggaccgaaccgggtaccttacggttacctttaagttttaacgtttaggaccggtaccggtaacggaacggtaacggaacccgtaacccgtaaacccgtaaacccgttaacccgtacgggtaaccccgtaaaacgttaaccggttaacgggtttacggggggggttacccgtttttacggggtttacccgggtttaccggggggggtaccccggtaaccgggggggtacccccgttacggggttacccggttaaccgttccccggttaccccgttcccccccggtaaccggtacccccgttaccccccggtaaaccccgggaaaccccgggggtaccccccgttaaaccgggtttcccccggggttttaccccccgtttacccccccccgggttaccggggtccccccggttacccccggttcccccggg

SEQ ID NO: 22360 - DNA, 584 bp, Homo sapiens
  misc_feature: GYAE6OF01CFFQ7.12.40.D07.1.454.CMB.1.raw
  modified_base (236)..(236): a, c, t, g, unknown or other
  misc_feature (236)..(236): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcgtccctgacactcgcctgtgttgcctctggactttcccttcaatttctattccatgcactgggtccnccaggctccaggcgaaggggctcggagtgggtgcacttatgcacatgatggctacaaacaaattcaacgctaaacttccggtggacggggcccgattccaaccatcctccaagacgactaattaacaaacgaacctaccctttatctagacaaatagacagcctagacaccagacgacacgctgtactattatgcgcgagagagacacacgaacactcgacaatacgtagtggggtcttggtcgtcggggccgacggggtacctggtcacgtccgtcctccccgacgtccctacccgaccgaccgggtcccacgtcccggttcccttcccccgtcggcccgcccgtcg

SEQ ID NO: 22361 - DNA, 630 bp, Homo sapiens
  misc_feature: GYAE6OF01DLQIZ.12.40.D07.1.454.CMB.1.raw
  modified_base (240)..(240): a, c, t, g, unknown or other
  misc_feature (240)..(240): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtacttttcccttcaattttctattccatgcacgtgggtccnccaggctccaggcaaggggctcggagtgggtgctacttattgcacatgatggcgtacaaactaaattctacgactaaaattccggtggacggggccattcaccatcctaccaagacgaactaattaacaaagtaacctaacccctttatctagacaaaatacgacagcctagacgaaccagaacgacgacggtctacgtacttaattagttgcgacggaagagacgacaacaaccgaacctacgtcggacccaagtacgtagtcggggtactttggttcgtggggaccgacggggtccctggtacctacgtcccgtccaccccgacgcccctacccgaccggaaccgggcccctacgttcccggtcccttcccccgtggcccgcccgtcg

SEQ ID NO: 22362 - DNA, 645 bp, Homo sapiens
  misc_feature: GYAE6OF01CFWWR.12.40.D07.1.454.CMB.1.raw
  modified_base (338)..(338): a, c, t, g, unknown or other
  misc_feature (338)..(338): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctgggtggagtcgtgggggagccgtggtccagccgtgggcggtccctgacactcgcctgtgttcgccttctggtacttttcccttctaattttctattccagtgcctacgtcgggtccgccaggcctccgaggcgaaggggctcggaggtggggtgctacgttatgcacatgatggctacaaactaattctaacaactaattccggnggacgggcctattccacatctacagagtaacaattaacaacgtaaccttacctttanctanaactaaatcgactacgctagaacgaacagaccgaacgtcgtctagttactattcgtgacgtcgaagagacgaaccagaacccgtactacgcgtaactaagtacggtggtacgggttctttcgggttacggcgggtacgaccgggtactggtacctcgtcccgtccctacccgcgtaccccgtaccacggaacccggttccctaacgttccccggttccccttaccccggcggtcccgtccgttccg

SEQ ID NO: 22363 - DNA, 621 bp, Homo sapiens
  misc_feature: GYAE6OF01AD7VS.12.40.D07.1.454.CMB.1.raw
  modified_base (315)..(315): a, c, t, g, unknown or other
  misc_feature (315)..(315): n is a, c, g, or t
  modified_base (375)..(375): a, c, t, g, unknown or other
  misc_feature (375)..(375): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtactttcccttcaatttctattccatgcactgggtccgccaggctccaggcaaggggctcggagtgggtggcacttatgcacatgatggctacaacaattcacgctaaattccgngacgggccattccacctatcctaccaagacgaactaatacaaacgaacctaccctttaanctagacaaatagacagcctagacgaccaagaccgacgacggtctgtactattagttcgacgacgagagacgacaccaaccgaacctacgtacgaccaactacgtacggtacggggtctttcggttacgtcggggcgacggggtacccgtggtacctacgttccgtccgtaccccgacgtccctacccgacccgaaccgggccccgacgttcccgggtcccttacccccgtcggcccgtcccgtccg

SEQ ID NO: 22364 - DNA, 801 bp, Homo sapiens
  misc_feature: GYAE6OF01E0MIY.12.40.D07.1.454.CMB.1.raw
  modified_base (197)..(197): a, c, t, g, unknown or other
  misc_feature (197)..(197): n is a, c, g, or t
  modified_base (243)..(243): a, c, t, g, unknown or other
  misc_feature (243)..(243): n is a, c, g, or t
  modified_base (417)..(417): a, c, t, g, unknown or other
  misc_feature (417)..(417): n is a, c, g, or t
tcagatacgacgtacacgaccggtgctcgattttagtgatagagcgtaaacaacagagggctcaccatggagtttgggctgagcgtggttttcctcgtgctcttttaagaggtgtcagtgtcaggggcacctggtggagtcgtgggggagccgtggtccagccgtgggcggtccctgacactcgcctgtgttgcctntgtactttcccttctaattttctacttccatcgcacgtcgggtccnccgaggcctccgaggccgaaggggctcggaggtggggtgctacttattgcacgatgatcggactacaaactaattcacgactaaacgttccgagggaccgggcctacttaccgacctattcccaccgaagaactaacctaaattaacgaaacgtaacccttaaccccgttttanaccgttaagaacctaaaagttacgaccgtacgtacccgtagaaaccgaccggaacggaaccggaaccgtaccggtacgttacggtttaacttaacgtttacgttacgggacggtaacggaacggaacggaacgaacccgtaaaccgtaaaccgtaacccgtacgtaacggacccttaaagtaacgttacgggttaccggggttccgtttacgggttccggtaccgggggtacccgtaacccgggggtacccgttacggtaccgtccgttccccggtaccccgttaccccgaccgtaacccctacccggaaacccgggaacccggtccccgtaaccggttccccggttcccccgttacccccggtcggtccccgtcccggtaccg

SEQ ID NO: 22365 - DNA, 855 bp, Homo sapiens
  misc_feature: GYAE6OF01CQCK7.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcgaggggcacctggtggagtcgtgggggagccgtggtccagccgtgggccggtccctgacactcgcctgtgttgcctctggtactttcccttcaatttctattccatgcacgtgggtccgccaggcctccgaggcgaaggggctcggaggtggggtgctacttattgcacatgagtggcgtacaaactaaattcctaacgactaaaacgtttcccgggtaggacgggggaccctatttaccaacccgtactccctccgaaaggaacgaaactaaacttaacgaaacgtaaacccttacccttttaatacgttagaacctaaaagtaacggaaccaagtccctaaggaaacgaacccgaacggacccgaaccgaccgggtacttacgttacctttaagtttacgttacggtaccgtacggaaggtaacgaacgaaccgaacctaaaccgaaaccctaaccgtacggaacccgtaaacgttaacgttaacggttcggggggtaccgttttaacgggttccggggtttccgggggaacccgggttaaccggggggtacccccgttacggggttaccctaccggttaccccggttaccccgttacccccgtaccggtaccccccgtaaccccggttaaaccccgaaacccgggggtacccccgttaaccggttaccccccgggtttccccttttacccccccgggtcccgggtcccggttcccccccggttacccggg

SEQ ID NO: 22366 - DNA, 585 bp, Homo sapiens
  misc_feature: GYAE6OF01CRTTT.12.40.D07.1.454.CMB.1.raw
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (481)..(481): a, c, t, g, unknown or other
  misc_feature (481)..(481): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctgggtggagtctggggggagccgtggtccagcctgggcgtccctgacactcgcctgtgttgcctctggatttccctcaatttctattccatgcacgtggggtcccgccaggcctccgagggcaaagggggctcggaggtggggtggcacgttatgcacatgatggctacaaacaattcagacaaattcgngagggccattcacatcncagagaacattacaanactacctttanctgacaaatagacacgcctagacgaccaggacgacgacggtctgtacttattatgacgcggaagagacgacacgaaccgacctacgcgaccaagtactaggtgggtcttggtcgnggggaccgacgggtcctacggtctacgtccgtccaccccgacgtccctaccgacccgaacggccctacggttcccgtcccgtttccccgcggcccgtcccgtcg

SEQ ID NO: 22367 - DNA, 569 bp, Homo sapiens
  misc_feature: GYAE6OF01DXD1C.12.40.D07.1.454.CMB.1.raw
  modified_base (234)..(234): a, c, t, g, unknown or other
  misc_feature (234)..(234): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
tcagatacgacgtacacgaccggtgctcgatttagtgatagagcgtaacaacagagggctcaccatggagtatgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttattgcacatgatggcgtcaaacaaaattctaacgcaaaatttccgtggaggggccgaattcacatctccagagacaaattacaaagaactaccctttanctgacaaaatagacancctagagaccagacgacacggctgtctattatgcgcgagagagacacacgaaacctactaggacaaactaactatggggtcttgttcgtcgggaccgacggggaccctggtccagtcgtcctccccagccctcccacccgaacgggcccctaacgtccggtaccttcccccgtggcccgtcccg

SEQ ID NO: 22368 - DNA, 728 bp, Homo sapiens
  misc_feature: GYAE6OF01AD50Y.12.40.D07.1.454.CMB.1.raw
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtatttccctnaatttctattccatgcacgtgggtccnccaggctccaggcgaaggggcctcggaggtgggtggctacttatgcacatgagtggcctacaaactaaacttcaacgactaaacgttccggtggacggggcctattccacctatcctaccgaagtacgaactaaattaaccgaaacgtaacccttaccctttatcgtacgaactaaaatacgactacgcccgtagaacgaccaacgaccgtaacgaccggtacttacgttaccttattaacgttcggacgacggtaaggaagtaacgaaccaaccgtaaccgaaccctacgtacggaacctaagttaccgtaggtacggggtactttcggttccggtacggggaccgtaccggggtccctgggttacctaccggttacccgtacccgtacccccggtacggtacccctaccccggaacccgggtacccgggtcccccgtaccgttccccgggttacccccgttacccccggtcggtccccgtcccgtacccgg

SEQ ID NO: 22369 - DNA, 631 bp, Homo sapiens
  misc_feature: GYAE6OF01B3P1X.12.40.D07.1.454.CMB.1.raw
  modified_base (238)..(238): a, c, t, g, unknown or other
  misc_feature (238)..(238): n is a, c, g, or t
  modified_base (283)..(283): a, c, t, g, unknown or other
  misc_feature (283)..(283): n is a, c, g, or t
  modified_base (501)..(501): a, c, t, g, unknown or other
  misc_feature (501)..(501): n is a, c, g, or t
tcagatacgacgtacacgaccggtgctcgatttagtgatagagcgtaacaacagaggactcaccatggagtttgggctgagcgtggtttcgtcgttgctcttttaagaggtgtccagtgtcaggggcacctggtggagtcgtggggggagccgtggtccagcctgggcggtccctgacactcgctgtgttgcctctggtatttcccttctaattttctattccatgcacgtgggtccnccaggctccgaggcaaggggctcggaggtgggtgcacttatgcanatgatggctacaaataattctacgactaaagttccgtggaacggggtccaattccaacctatcccgtacgagaacaactaaacttaacaaacgaaccctaccctttaatcgtagaaccaaaataacggactaacgacctagaacgaaaccgagaaccgtacgaacggtcttagttacttagttagttcgcggacgagagacgacacgaccgaactacncgactaatactaggtgggtacttggtcgcgggtacgacgggtacctggtctactccgtcctcccgacgccctacccgacccgaccggtccctacgtcccggtacccttccccgcggtcccgtcccgtccg

SEQ ID NO: 22370 - DNA, 812 bp, Homo sapiens
  misc_feature: GYAE6OF01A70A7.12.40.D07.1.454.CMB.1.raw
  modified_base (242)..(242): a, c, t, g, unknown or other
  misc_feature (242)..(242): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcacctgggtggagtcgtggggggagccgtggtccagccgtgggcggtcctgacactcgcctgtgttgcctcgtggtactttcccttctaatttctattccatgcactgggtccncaggcctccgaggcgaaggggctcggaggtggggtggctacttagttgcaacatggatcggcgtacaaactaaattcctaacggactaaaactttcccggtagggaacggggggtaccctaattttccgaacccaattccgtacccgaaggaacgaacctaaatttaaccaaacgtaaaaccttaccccttttaatcctagaacctaaaatacggaacaacggtcctaggaacgaaccaaggaccgaacgaaccgggtcttacggtaccttagttaacgttcgtacggacgtaaggaacgaacgaaccacgaaacccgtaacccgttaaccgtacgggaacccaaacgttaacgtaaggttccgggggttacgttttacgggtaccggttacggggggacccgtaacgggggtaccccgttcgggttacctaacggttaccgtacccgttaccccccggacgttaccccgttaaccccggaaacccggtaacccggggccccttaaccggttaccccgggttccccttttaccccccgggtccgggtacccccggtccccgtaccccggg

SEQ ID NO: 22371 - DNA, 615 bp, Homo sapiens
  misc_feature: GYAE6OF01CW44Q.12.40.D07.1.454.CMB.1.raw
  modified_base (215)..(215): a, c, t, g, unknown or other
  misc_feature (215)..(215): n is a, c, g, or t
  modified_base (355)..(355): a, c, t, g, unknown or other
  misc_feature (355)..(355): n is a, c, g, or t
  modified_base (480)..(480): a, c, t, g, unknown or other
  misc_feature (480)..(480): n is a, c, g, or t
tcagatacgacgtacacgaccggtgctcgatttagtgatagagcgtaacacagagggctcaccatggagtttgggctgagctgggttttcctcgttgcttcttttaagaggtgtccagtgtcgaggggcacctgggtggagtcgtggggggagccgtggtccagccgtgggcggtccctgacactcgcctgtgttgcctctggtactttcccttntaatttctattccatgcacgtgggtcccgccaggctccgaggcgaaggggctcggaggtgggtgcacttatgcacatgatggctacaaactaaattcaacgcaaaattccgtagaggggccattcaccatcctccaaganaacaattaacaaacgtaacctaacccttttaatctagacaaaatacgacagcctagaacgaaccaagaaccgacgaacggtctgttacttattattgcgcgaagagagaacacaaccgaactacncgacaatacgtagtcgggtcttggtcgtcggggccgagggaccctggtcctacgtccgtcctccccgcgtcccctaccgacccgaacgggcccacggttcccgttaccccttccccgtcggccccgtcccgtccg

SEQ ID NO: 22372 - DNA, 783 bp, Homo sapiens
  misc_feature: GYAE6OF01EH07G.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtatttcccttctaatttctattccatgctacgtcgggtccgccaggcctccgagggcgaagggggctcggaggtggggtggctacttatgcacatgatggcgtacaaacaaattctacgactaaaagttcccggtaggacgggggtcctaatttaccgaacccattcctacccgaagaacgtaactaaacttaaacaaacgtaaaccctaccccttttaatcctagaacctaaaaattacgaaccagtacccgtaggaaccgtaaaccgaacgaccgaacgaaccgggtacttacggttacttaagtttaacgttcggaccggtacggaaagggaacgtaacgaacccaccgaaaccgtaaacctacgtacggacctaaacgttaacgtaggttacggggggttcctttacgggttacggttccgggggtacccgtaacggggggtaccccttgggtaccgacgttccccggttacccttaccccgaccggtccccgtaacccgaaccccgggaaccgggtccccctaacggttccccgggttccccgtttaccccccggtcggggcccctccccgtacccggg

SEQ ID NO: 22373 - DNA, 589 bp, Homo sapiens
  misc_feature: GYAE6OF01B4WZG.12.40.D07.1.454.CMB.1.raw
  modified_base (358)..(358): a, c, t, g, unknown or other
  misc_feature (358)..(358): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctcagagacaattacaacgacacctttanctgacaaatagacagcctagacgaccaagacgacacggctgtactattattgcgcgagagagacacaccgaacctactcgaccaatacgtagtcggggtcttgttcgtcggggtaccgacggggtacccgtcggtacctacgtccgtcccgtccccgacgtccctacccgaacccgacgggacccctaacgtccggttaccccgttcccccgtccggtcccgcccgtccgg

SEQ ID NO: 22374 - DNA, 723 bp, Homo sapiens
  misc_feature: GYAE6OF01DC3BU.12.40.D07.1.454.CMB.1.raw
  modified_base (153)..(153): a, c, t, g, unknown or other
  misc_feature (153)..(153): n is a, c, g, or t
  modified_base (245)..(245): a, c, t, g, unknown or other
  misc_feature (245)..(245): n is a, c, g, or t
  modified_base (363)..(363): a, c, t, g, unknown or other
  misc_feature (363)..(363): n is a, c, g, or t
  modified_base (411)..(411): a, c, t, g, unknown or other
  misc_feature (411)..(411): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctgggtggagtcgtgggggganccgtggtccaggcctgggcgtccctgacactcgcctgtgttgcctctggtactttccctcaattttctattccattgacacgtcggggtccnccagggcctccgaagggcgaagggggcctcggaggtggggtcgctacttatgcacatgatcggctacaaactaattctaacactaaattccggtaggacggggcctattccaaccgtntcctaccaagacgaactaaacttaacaacgtaacccttacccgtttanactagaacaaaagttcgacacgtcctagacgtaccagacgacgacgctgtctattacgtgacgtagaagagaacgacacgaacgtaacctacgcggactaaacgtacgttaggtcggggtacctttcgggtaccggtcggggacccgtaacgggggtccctagggttaccaaccggttcccggtacccttaccccccggtaacggtccccccttaaacccggaaccccgggttaacccggggtaccccctaaccggttccccgggtttaccccctttccccccgggcggtaccccccgtcccgttacccggg

SEQ ID NO: 22375 - DNA, 620 bp, Homo sapiens
  misc_feature: GYAE6OF01EGYGW.12.40.D07.1.454.CMB.1.raw
  modified_base (248)..(248): a, c, t, g, unknown or other
  misc_feature (248)..(248): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
  modified_base (522)..(522): a, c, t, g, unknown or other
  misc_feature (522)..(522): n is a, c, g, or t
  modified_base (608)..(608): a, c, t, g, unknown or other
  misc_feature (608)..(608): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcaggggcacctggtggagtcgtggggggagccgtggtccagccgtgggcggtccctgacactcgcctgtgttgcctctggtactttcccttctaattttctattccatcgcacgttcgggtcccnccgaggcctccgagggccgaagggggctcggaggtggggtgctacttattgcacatgatggactacaaactaaattcctaacgactaaacgttccggtaggacggggcctattccacctatcctccaaganaactaattaccaaagtaacctaccctttanctagaacaaagtagaacagacctagaacgaaccagaccgacacggtctgtactattatgcgagagagacgacacacgtaacctactcgacaatacgtagtgggtacttgtcgngggaccgagggtaccctggtacacgtccgtaccgtcccgtacgccctaccgacccgaacggccctacgtcccgtcccttaccccgnggccctccgtcg

SEQ ID NO: 22376 - DNA, 635 bp, Homo sapiens
  misc_feature: GYAE6OF01CMXD9.12.40.D07.1.454.CMB.1.raw
  modified_base (153)..(153): a, c, t, g, unknown or other
  misc_feature (153)..(153): n is a, c, g, or t
  modified_base (213)..(213): a, c, t, g, unknown or other
  misc_feature (213)..(213): n is a, c, g, or t
  modified_base (291)..(291): a, c, t, g, unknown or other
  misc_feature (291)..(291): n is a, c, g, or t
  modified_base (397)..(397): a, c, t, g, unknown or other
  misc_feature (397)..(397): n is a, c, g, or t
  modified_base (456)..(456): a, c, t, g, unknown or other
  misc_feature (456)..(456): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcgaggggcacctggtggagtcgtgggggganccgtggtccagcctgggcgtccctgacactcgcctgtgttcgcctctggtactttccctntaattttctattccatcgctacgtgggtccgccaggctccgaggcgaaggggctcggagtggggtgctacttatgcanatgatggctacaactaattctacgactaaacttccggtaggacggggcctattacacctatcctaccaagacgaactaaacttacaaacgtaacctaccctttaanctagaacctaaagtacgacacgaccctagaacgaccaaggaccacgacggctgtctatntgcgagagagagacacgacactagtcgacaagtacgtagtgggtctttaggtcgtacggggaccgtacggggtaccctgggtacctacgtcccggttaccctaccccgtacggtccctaccggtaacgggacctacccgtacccgtaccggaacgtacgaccgaccgaccgggtcccgg

SEQ ID NO: 22377 - DNA, 660 bp, Homo sapiens
  misc_feature: GYAE6OF01B2KOT.12.40.D07.1.454.CMB.1.raw
  modified_base (152)..(152): a, c, t, g, unknown or other
  misc_feature (152)..(152): n is a, c, g, or t
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
  modified_base (377)..(377): a, c, t, g, unknown or other
  misc_feature (377)..(377): n is a, c, g, or t
tcagatacgacgtacacgaccggtgctcgatttagtgatagagcgtaacaacagagggctcaccatggagtttgggctgagcttgggttttcctcgttgctcttttaagaggtgtccagtgtcaggggcacctggtggagtcgtgggggganccgtggtccagcctggggcgtccctgacactcgcctgtgttgcctctggatttcccttcaattttctattccatgcactgggtccnccaggctccgaggcaaggggctggaggtggggngctactttatgcacatgatggctacaacaattcagactaaagttccgtggacgggccattcaccatcctcagacacaaattacaaagtacctacctttaatcctanaactaaaatcgaacagaccctagaacgaccagaaccgaccgacggctacgttacttaagtttacttggacgtaggaagagacgaaccaacgaaccgaacctacgtacggaccaaatacgtaggtcggggtacgttcgttacggtcgggggacctacgggggacccttgggtacctagttccccgtacctaccccgacggtaccccaccgtaaccccgaaaccgggcccctaaccggtttccccggtcccctttacccccggccgggtcccgcccccgttacgg

SEQ ID NO: 22378 - DNA, 665 bp, Homo sapiens
  misc_feature: GYAE6OF01CXBSA.12.40.D07.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (276)..(276): a, c, t, g, unknown or other
  misc_feature (276)..(276): n is a, c, g, or t
  modified_base (437)..(437): a, c, t, g, unknown or other
  misc_feature (437)..(437): n is a, c, g, or t
tcagatacgacgtacacgaccggtgctcgatttagtgatagagcgtaacaacagagggctcaccatggagtttgggctgagctgggttttcctcgttgcttctttttaagaggtgtccagtgtcagggggcacctgggtggagtcgtggggggagccggtggtccagcctgggcggtccctgacactcgctgtgttgcctntggtattttccctnaatttctattccatgcacgtggggtccnccaggcctccgagggcaaggggctcgagtgggnggcacttattgcacatgatggtcgtacaaactaattactacgacgtaaacgttaccggtacggacggggaccgtacgttaccgaaccgactcctccgaacgacgaactaattaacaaacgaacctaacctttaactctacgacaaataaccccccccgaanacgacgtagacgaccaacgacgacgacggtactacgttactattagttagacgacgagagacgacacaaccgaactacgtacgactaactaacgtagtacgggtcgttcgttcggtacgggccggacgggacccgtcggtacgtacgtccgtcctacccgaccgtcccacccgaccgaaccggtcccgacgtcccggttacccgttccccgtccggcccgtcccgtcg

SEQ ID NO: 22379 - DNA, 573 bp, Homo sapiens
  misc_feature: GYAE6OF01EEF95.12.40.D07.1.454.CMB.1.raw
  modified_base (234)..(234): a, c, t, g, unknown or other
  misc_feature (234)..(234): n is a, c, g, or t
  modified_base (437)..(437): a, c, t, g, unknown or other
  misc_feature (437)..(437): n is a, c, g, or t
  modified_base (557)..(557): a, c, t, g, unknown or other
  misc_feature (557)..(557): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttatgcacatgatggcgtcaacaattctacgcaaattccgtgaggggccattccaccatctccagagacaattacaagaacctaccctttatctagacaaaatagacagccctagagaccagacacacggctgtctattattgcgcgagagagacacacgaacctacngaccaatactagtggggtcttggttcgtggggcctacggggaccctgggtccacgttccgtcctccccgagtccctacccgacccgaacgggccccacgttcccggtacccttcccccgnggtcccgtcccctcgg

SEQ ID NO: 22380 - DNA, 609 bp, Homo sapiens
  misc_feature: GYAE6OF01ASV36.12.40.D07.1.454.CMB.1.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (338)..(338): a, c, t, g, unknown or other
  misc_feature (338)..(338): n is a, c, g, or t
  modified_base (375)..(375): a, c, t, g, unknown or other
  misc_feature (375)..(375): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttnaatttctattccatgcactgggtccncaggctccaggcaaggggctcgagtgggtggcacttatgcacatgatggcgtacaaacaaattctacgcaaattccgaggagggccattcaccatctccaganacaattacaaagaactaccctttatctagactaaaangacagcctagacaccagacgacacggctgtctattatgacgcgagagagacaacgaaccgaacctacgtacgaccaaactacgtagtgggggtccttcggttacgtcggggacgacgggggtacccgtcgggtcgacgttccgtccgtacccccgtacgtaccctcccacccgaacgggtccccctaagttccccgggttcccttccccccggtcggtcccgtcccccgtccgg

SEQ ID NO: 22381 - DNA, 850 bp, Homo sapiens
  misc_feature: GYAE6OF01ECKPC.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggtactttcccttctaatttctattccatcgcacgtcgggtcccgccaggctccgaggccgaagggggctcggaggtggggtggctacttatcgcacatgatggcgtacaaactaattctacgactaaacgttccgtaggacggggccagtttccaacctattcctaccgaagaacgtaacctaaaatttaaccaaaacgtaaaccctaaccccttttaacgacccgtaactaaaaagtacggaaccacggtaccctacggaaacgaaacccgaaggaaacccgaccgtaaccgggtactttacgttaccctttaagtttaacgtttcgggacccggaacggtaaacggaacggaaaccgtaacccgaaacccgaaacccggtaaaccccttacggtaccggtaaaccctaaagttaaccgttaacggggtcgggggtttacctttacgggttacccggttacggggggacccgttaacggggggtacccccttagggttaccctaaccggttcccggtaccccgttaaccccccgacggttaccccccttacccggaaacccccggtaaaccggggaccccccttaaggttccccccgggtttacccttccccccccggttagggccccgttcccccgttccggtacccccg

SEQ ID NO: 22382 - DNA, 812 bp, Homo sapiens
  misc_feature: GYAE6OF01CFS73.12.40.D07.1.454.CMB.1.raw
  modified_base (150)..(150): a, c, t, g, unknown or other
  misc_feature (150)..(150): n is a, c, g, or t
  modified_base (241)..(241): a, c, t, g, unknown or other
  misc_feature (241)..(241): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtcgtgggggganccgtggtccagccgtgggccggtccctgacactcgcctgtgttgcctctggtactttccctctaattttctattccatgcacgtgggtccnccaggcctcgaggcgaaggggctcggaggtggggtcgactacttatgcacatgagtcggcgtacaaactaattcctaacgactaaaagttcccggtaggacggggtacctaatttcccaacctattaccctaccgaagtacgaaacctaaaacttaacgaaacgaaacccttaccccgtttaatccgtaagaacctaaaaagttcggaaccaagtccctaggaaacgaaccccgaagggaacccaaccgtaaccggtcgttacgttacgttaactttacgttcggaccggaggtaaacggaacggtaaccggaacaaaccgtaaccgtaaacccttaacgtaccgggtaacctaaacgttaacgtacgggttacgggggttaccgttttacgggtacccgggttaccggggggacccgttaacccggggggtaccccttacggggtacctaaccggttcccggttacccgtacccccgaccggtaccccgtacccgaccggaaccgggtccccttaacggttccccgggttcccctttaccccccgggcgtcccccggtccccgtaccggg

SEQ ID NO: 22383 - DNA, 571 bp, Homo sapiens
  misc_feature: GYAE6OF01AS6XT.12.40.D07.1.454.CMB.1.raw
  modified_base (371)..(371): a, c, t, g, unknown or other
  misc_feature (371)..(371): n is a, c, g, or t
  modified_base (500)..(500): a, c, t, g, unknown or other
  misc_feature (500)..(500): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtactttcccttcaattttctattccatgcactgggtccgccaggctccaggcaaggggctcgagtggggtgcacttattgcacatgatggcgtcaaacaattctacgcaaattccggtagacggggccagttccactatctccagacgacaattacaagaactaccctttanctagacaaatagacagcctagaacaccagacgacgacgctgtctattatgcgacgagagagacacgacgtaacctatacgactaatacgtagtggggtcttcgtcgtcgggccgtacgggccgtggtcnctccgtcctacccgacgtcccaccaccgtaacggccctacgtccgtccctaccccgtcgcccgtcccgtcg

SEQ ID NO: 22384 - DNA, 749 bp, Homo sapiens
  misc_feature: GYAE6OF01DW5RR.12.40.D07.1.454.CMB.1.raw
  modified_base (243)..(243): a, c, t, g, unknown or other
  misc_feature (243)..(243): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagccgtgggcggtccctgacactcgcctgtgttcgcctctggtactttcccttcaatttctattccatcgcacgtgggtcccncaggcctccgaggcgaaggggctcggaggtgggtgctacttatcgacacatgagtggacgtacaaactaaattctaacgactaaaacgttccggagggacggggtccaattccacctattcctaccaaggacaaactaattaacaaacgtaacctacctttatctagacaaaatacgacacgcctagaacgaacccagaaccgacgacggtcttaggttacttaatttacgttcggaccgtacgaagtaacgacgaaccaaccgtaaaccgtaaaccgttaccgtacgggtaaccctaaagttaaccgtaacgggttcgggggtacctttcgggttaccggtacgggggacccggtaacgggggtaccccgttgggttaccgtaacgttcccgttaccccgtaccccgtaccgtaccccgtaacccggaacccggtaaacccgggtcccctaaccggttccccgggttacccccttcccccgggtcggtccccgtcccccgtccgg

SEQ ID NO: 22385 - DNA, 569 bp, Homo sapiens
  misc_feature: GYAE6OF01B5UZ6.12.40.D07.1.454.CMB.1.raw
  modified_base (362)..(362): a, c, t, g, unknown or other
  misc_feature (362)..(362): n is a, c, g, or t
  modified_base (427)..(427): a, c, t, g, unknown or other
  misc_feature (427)..(427): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttctaatttctattccatgcactgggtccgccaggctccaggcaaggggctcggagtggggtgcacttatgcacatgatggcgtcaacaaattcacgcaaattccgtgacggggccattcaccatctccagagacaattacaagaactaccctttanctagacaaaatagacacgcctagacgaccaggacgacgacgctgtactattattgcgcgagaganacacaccgaacctacgtacgacctaatactaggtggggtcttggttcgtcggggaccgacggggtacccgtggtcctacgtccgtcctccccgcgcccgtaccgacgggacgccaccgtccgagacgcacgacggtcccggg

SEQ ID NO: 22386 - DNA, 711 bp, Homo sapiens
  misc_feature: GYAE6OF01C4XL6.12.40.D07.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (243)..(243): a, c, t, g, unknown or other
  misc_feature (243)..(243): n is a, c, g, or t
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
  modified_base (399)..(399): a, c, t, g, unknown or other
  misc_feature (399)..(399): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggacgccgtggtccagcctgggcgtccctgacactcgcctgtgttcgcctntggtactttccctntaatttctattccatgcctactcgggtccnccaggtctccgaggcgaagggctggaggtggggtgactacttagtcgcaacgatgatggactanaaactaatcaacgactaaatccggtggacgggcctataccaaccnttccacgagacgaactaattaacgaacgtaaacctacccgttttaanactacgaactaaagtacgacacgtaccgtagaaccgaaccaggaacccgtacgacgtacttacgtacttagttacgtacggacgaacgaacgaagacgaaccaaccgaaccgtaaccgtacgtaccgaactaacgttacggtacgggttacgggtcgttacggtacggtaccggggtaccggtaccgggtaccgtcggttaccgtacgttcccgtacccgaccccgtcggtaccccgtaaccggacccggtaacccgggtcccttacggtaccccggttccccgtaccccggccggtccccgtaccggtccg

SEQ ID NO: 22387 - DNA, 621 bp, Homo sapiens
  misc_feature: GYAE6OF01B41GD.12.40.D07.1.454.CMB.1.raw
  modified_base (152)..(152): a, c, t, g, unknown or other
  misc_feature (152)..(152): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (395)..(395): a, c, t, g, unknown or other
  misc_feature (395)..(395): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtcgtgggggganccgtggtccagcctgggcgtccctgacactcgctgtgttgcctctggtactttcccttnaattttctattccatgcactgggtcccncaggctccaggcaaggggctcgagtgggtgctacttatgcacatgatgggctacaaactaaattcgaacgactaaaagtttcccggtaggacgggggcctatttccgacctattcctccaagacgaactaaattaacaagtaacctaccctttaancctagacaaaatcgacacgcctagacgaccagacgacacgctgtactattatgacgacgaagagagaacacaaccgaacctacgtacggacctaactacgtagtggggtcttggttcgtcgggaccgacggggcctgggtcatccgtacctcccgacgtccctaccgaaccgaccgggacccctacgttcccggttccccttccccggtcggcccgtccccgtcgg

SEQ ID NO: 22388 - DNA, 627 bp, Homo sapiens
  misc_feature: GYAE6OF01CFQO7.12.40.D07.1.454.CMB.1.raw
  modified_base (152)..(152): a, c, t, g, unknown or other
  misc_feature (152)..(152): n is a, c, g, or t
  modified_base (213)..(213): a, c, t, g, unknown or other
  misc_feature (213)..(213): n is a, c, g, or t
  modified_base (472)..(472): a, c, t, g, unknown or other
  misc_feature (472)..(472): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtggtggagtcgtgggggganccgtggtccagccgtgggcgtccctgacactcgcctgtgttgcctctggtacttttccctntaattttctattccatgcacgtcgggtccgcaggcctccgaggcgaaggggctcggaggtggggtcgactacgttatcgccatagtgatgggcttacaaactaattcaacgactaaagtttccggaggacggggcctattaccacctatcctaccgaagacgaactaaattacgaaacgtaaccttaccctttaatctagaaccaaagtacgacagcctagacgaccagacacgacgctagtctattagtgcgagaganacgacacaccgtaacctacgtacgactaagtctaggtgggtcttggttcgcgggacgacgggtctcggtctacgtccgtcctcccgacgtaccctaccgaaccgaccggtccctacggtccgtaccccgttcccccggcggtcccgccgtaccgg

SEQ ID NO: 22389 - DNA, 575 bp, Homo sapiens
  misc_feature: GYAE6OF01A3X27.12.40.D07.1.454.CMB.1.raw
  modified_base (333)..(333): a, c, t, g, unknown or other
  misc_feature (333)..(333): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttattgcacatgatggctacaaacaaattctacgcaaattccgtgaggggccattcaccatcncagagacaattacaagtaactaccctttatctgacaaatagacagcctagaacgaccagacgacacgctgtctattatgcgcgagagagacacacgaactactcgaccaatactagtcggggtcttggttcgtcggggccgacggggtaccctggtctacgtccgtacctccccgacgtccctacccgacccgaacgggccccacgtcccggttacccttcccccgtcggcccgtcccgtcg

SEQ ID NO: 22390 - DNA, 870 bp, Homo sapiens
  misc_feature: GYAE6OF01B30UI.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggatttcccttcaatttctattccatgcacgtgggtcccgccaggcctccgaggcgaaggggctcggaggtgggtgctacttattgcacagtgatggccgtacaaactaaattccaacgactaaagttcccggtgggacggggccctatttccaacctattcctacccgaaggtaacgaacctaaaactttaaccaaaacgtaaaccctaaccccttttaatccgtagaactaaaaactagaacctacggaccctaggaacgtaaccccgaagggaacccgtaaccgaccgggtacttacggtacgttaattttacgttacggaccggacggaacggaacgtacgaaccgtaaaccgaacccgtaaacccgttaccggtacggaacccgtaaacgttaacgttaacgggtttacgggggggtaccttttacggggtttaccgggttaccggggggtaccccgggtaacccgggggggtaccccggttaccggggttaccgtaccggtttaccccggttacccccgttaccccccggtacggttaccccccgtaacccccggtaaacccccgggtaaacccggggtaccccccgtaaccggttttcccccggggttaccccccgttttacccccccccggttcggggtccccccggttccccccggttacccgg

SEQ ID NO: 22391 - DNA, 772 bp, Homo sapiens
  misc_feature: GYAE6OF01DHITA.12.40.D07.1.454.CMB.1.raw
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtacttttcccttctaattttctattccatgcactggggtccnccaggcctccgaggcaaggggctcggaggtggggtgctacttatgcanatgatggcgtacaaactaaattcctaacggactaaaagtttcccgggagggtacgggggccctagttacctacccaccttaccgtacccaaggacgaaacctaaacgttaacaaacgtaaccttaaaccccttttacgttactagaacctaaataacgactaacgccgttagaacgaaccgaacgaaccgacgaccggtcttacgttacttaactttagttacgtcggacggtaacggaggaagaccaaaccgtaaccgtaaccgttaaccgtacggaccctaaataacgtaacggttcgggggtaccgtttcggtttccggtacggggaccggtaccggggtacccggtcggttaccgtacgttcccggttcccgtacccccgtaccggtaccccgttaccccgaacccggtaacccgggaccctacccggttcccggttacccccgttccccccgttccgggccccggtcccccgtaccgg

SEQ ID NO: 22392 - DNA, 637 bp, Homo sapiens
  misc_feature: GYAE6OF01CLFG6.12.40.D07.1.454.CMB.1.raw
  modified_base (149)..(149): a, c, t, g, unknown or other
  misc_feature (149)..(149): n is a, c, g, or t
  modified_base (206)..(206): a, c, t, g, unknown or other
  misc_feature (206)..(206): n is a, c, g, or t
  modified_base (299)..(299): a, c, t, g, unknown or other
  misc_feature (299)..(299): n is a, c, g, or t
tcagatacgacgtacacgaccggtgctcgatttagtgatagagcgtaacaacagagggctcaccatggagtttgggctgagctgggttttcctcgttgctctttaagaggtgtccagtgtcaggggcacctggtggagtcgtggggganccgtggtccagcctgggcgtccctgacactcgcctgtgtgcctctggactttccctnaatttctattccatcgcaccgtgggtcccgccaggcctccgagggcgaaggggctcggaggtggggtcggctacttatgcacatgatggctanaaacaaattctaacgactaaattccgtggacggggccatttccaaccgatcaccgagagaacaattacaacgtaaccacctttagctagacaaaagtgactagcctagaacgaccgagacacgacgctagtctattagtgcgacgaagagacgaaccacaaccgtaacctacacgtacaacgtacgtagtcggggtcctttcggtccggtacggggacccgtaacggggtccccgtagggtccgtacgttccgtccctccccgaccgtaccccgtacccgaaccgaacccgggccctacgttcccggttcccttacccccgtcggcccgtcccgtccg

SEQ ID NO: 22393 - DNA, 755 bp, Homo sapiens
  misc_feature: GYAE6OF01EOH8R.12.40.D07.1.454.CMB.1.raw
tcagatacgacgtacacgaccggtgctcgatttagtgatagagcgtaacaacagagggctcaccatggagtttgggctgagcttgggttttcctcgttgctcttttaagaggtgtccagtgtcaggggcacctggtggagtcgtggggggagccggtggtccagcctgggcggtccctgacactcgcctgtgttgcctctggtactttcccttctaattttctattcccatgctacgtgggtccgccaggcctccgaggcgaaggggctcggaggtgggtcgctacttagtgctacatgatggccgtacaaactaaattcctaacgactaaacgttccggtaggacggggacccgtattccaacctatcctaccgaaggtaacgaaactaaaattaccaaacgtaaacctaacccttttatccttagacctaaaatacgaacgtacgtaccctggaacgaaccgaaggaaccgaacgacggtacttacgttacttaattacgttggaccgtacggaagaacgaacgaccgaaaccgaaccgtaacccgtacgtacggacctaaacgttaacgttacggttacggggttcgtttacgggttacgtcgggggacccgtaacgggggtacccttacgggtcctacggttccgtacccgttaccccgaccgtaccccgtaacccgaacccggtaaccgggtacccctaaccggttcccggttccccgttccccccggtacggtccccgtcccgtaccgg

SEQ ID NO: 22394 - DNA, 666 bp, Homo sapiens
  misc_feature: GYAE6OF01CBTVP.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggatttcccttcaattttctattccatgcactgggtccgccaggctccaggcgaaggggctcggaggtggggtgctacttatgcacatgatcggctacaacaaattcacgactaaacgttccggtggacggggccattccacatcctaccgaagagaacctaattaacaaacgtaaacctaacctttatcgtaagactaaatacgaccacgacctaggaacgaccagaaccgacgacgtcttacgtacttatttacgtggacgacgaagagacgaacaacgacgaacccgtacgacggacctaaagttcgtaaggtcggggtcctttagggttccggcggggtacccgaggggtacccgttaggtccgtacgtcccgtacccgtaccccgtacgccccttaaccgacccggaaccgggccctaccgttcccgggtccccttacccccggcgggtcccctccccggtacg

SEQ ID NO: 22395 - DNA, 670 bp, Homo sapiens
  misc_feature: GYAE6OF01EKB9R.12.40.D07.1.454.CMB.1.raw
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccggtggtccagccgtgggcggtccctgacactcgcctgtgttgcctctggatttcccttcaatttctattccatgcactgggtccgccaggctccaggcaaggggctcggagtgggtgcacttatgcacatgatggcgtacaaacaaattctaacgctaaagttccgtaggaggggcctattcaccatctccaganacaattacaagtaacctacctttaancctagacaaaatagacagtaccctagaacgaacccagaaccgacgacggcttagtactaatttacgttagccgacgtaagacgaagaaccacaaccgtaaacctaccgtacgggaaccctaagttaaccgttaggtacgggggttctttacgggtttccggtacgggggacccgtacggggtacccgttcgggtactacgtcccgtacccgtaccccgacgtccccgtacccgacccgaaaccgggcccctacggttcccgttacccgttcccccggtcggtcccgtccccgtccgg

SEQ ID NO: 22396 - DNA, 923 bp, Homo sapiens
  misc_feature: GYAE6OF01CID8T.12.40.D07.1.454.CMB.1.raw
tcagatacgacgtacacgaccggtgctcgatttagtgatagagcgtaacaacagagggctcaccatggagtttgggctgagcgtggtttcgcgtagctctttaagaggtgtcagtgcgagggcacgtggtggagtcgtgggggagccgtggccagccgtgggccgtccctgacactcgcctgtgttcgcctgtggtactttcccttactaattttctacttccagttcgacctacgttcggggtcccgaccaggtcctcccggaagggaccggtaaacgggggtccttcgggaaggttcggggtgacttaaccgtttaagttacgccaacgtaattggaacgttcggggaccgttaaccaaaaaccttaaagtttccgaaacggtaacccgttaaaacgttttcccgggaggggaaacggggtcccctaaacgttttcccgaaaccgtactttccccggtaaaccaaagggttaaaccgtaaaccgttaaaactttaaaccggaaaaccgttaaacccttaacccgtttttaagtaacgtaacgtaaaacgtaaaacgtaacgaaccgttaaccggtccgtaacggaaaccgtaccgaacggtaaccgaaccgtaccggttacgttacgtttacgttaacgttacgttacggtacggtaacggaagtaacggaaccgtaaccgtaaccggtaaacccgtaaaccgttaaccggtaaccggttaaccgttaaacggttaacggttacgggttacggggttacgttacgggttaccgggtaaccgggtacccgggtaccgggtacccgttacggttaccgtccgttaccgtacccgtacccgtaccgtacccggtaacccgaccgtaacccggtaccgtacccggttcccgttaccccgttccccgtccggtcccgtcccggtcg

SEQ ID NO: 22397 - DNA, 577 bp, Homo sapiens
  misc_feature: GYAE6OF01B1JS4.12.40.D07.1.454.CMB.1.raw
  modified_base (357)..(357): a, c, t, g, unknown or other
  misc_feature (357)..(357): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttatgcacatgatggcgtcaacaaattctacgcaaattccgtgaggggccattcaccatctcagagacaattacaagaacaccctttanctgacaaatgacagcctagagaccagacgacacggctgtctattattgcgcgagagagacacacgaacctactcggaccaatactagtcgggggtctttcggttcgtcggggccgtacggggacccctgggtccagtccggtccctccccgacgcccctacccgacccgaacgggccccacgttcccggttcccttccccccgtcggcccgtccccgtcg

SEQ ID NO: 22398 - DNA, 642 bp, Homo sapiens
  misc_feature: GYAE6OF01DEWA1.12.40.D07.1.454.CMB.1.raw
  modified_base (394)..(394): a, c, t, g, unknown or other
  misc_feature (394)..(394): n is a, c, g, or t
  modified_base (451)..(451): a, c, t, g, unknown or other
  misc_feature (451)..(451): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggattttcccttcaatttctattccatgcactggggtccgccaggctccgaggcaaggggctcgagtgggtggcacttatgcacatgatggcgtacaaacaaattctacgtacaaaatttccggtaggaggggcccgtaattccaaccacttcctacccgaagacgaacaaattaccaaagaaacctacccttttanctagacaaatagacacgcctagacgaccaagaccgacgacgctgtactattatgcgngaagagagacacgaacgactacgtacgacaagtacgtaacgtgggggtcctttagggttcgtcggggcccgtacggggacccgttggtacctacgtaccgttcccgtccccgaacggccccttaccgaacccgtaaccgggacccctacgttcccggttaccccttcccccgtccggcccgtccccgtccg

SEQ ID NO: 22399 - DNA, 692 bp, Homo sapiens
  misc_feature: GYAE6OF01BIJYW.12.40.D07.1.454.CMB.1.raw
  modified_base (242)..(242): a, c, t, g, unknown or other
  misc_feature (242)..(242): n is a, c, g, or t
  modified_base (289)..(289): a, c, t, g, unknown or other
  misc_feature (289)..(289): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcaccgtgggtggagtcgtggggggagccgtggtccagcctgggccggtccctgacactcgcctgtgttgcctctgtactttccctataatttctatccatgcacgtcgggtcccnccaggcctccgaggcgaagggctcggaggtgggtgctattatgacanatgagtcggactacaaactaattccaacgactaacgttccggagggacgggacctattaccacctacttcctacgaagaacgtaacctaaattaacgaaacgtaaccctacctttatacgtagaaactaaatacgacacgtctagaacgaccgagaaccgacgacgtcttagttacttagttacgtcggccgtagaacggacacgaacaacgaccgtaacctacgacggaacctaagtaacggtcgggtacgggttacttcgggttacggtccggggacggtaaccgggtaccgttggtaccgtaccgtccgtacccctaccccgtacgtaccccgtacccgaaccggaccggtccccgaacgtttcccggtaccccttaccccggtcgcccgtcccgtacgg

SEQ ID NO: 22400 - DNA, 651 bp, Homo sapiens
  misc_feature: GYAE6OF01C0L5L.12.40.D07.1.454.CMB.1.raw
  modified_base (282)..(282): a, c, t, g, unknown or other
  misc_feature (282)..(282): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
tcagatacgacgtacacgaccggtgctcgatttagtgatagagcgtaacaacgaggagggctcaccatggtaggtttgggctggagcgtgggttttcctcgttgcttcttttaagaggtgtccagtgtcgaggggcaccgtgggtggagtcgtgggggactccggtggccagccgtgggccgtcctgacactcgcctgtgttgcctgtggtactttccctataatttcattccatgcacgtcgggccacgaggtcacgaggcgaaggggtcctggagtgggngactattagtgcatagtgagtggactacaaataagttctaacgntaaacgttccggngaacggggtccattccaccagttccacgagataactaagttacaagaacctacctttaagctaagacctaaaancgaatcgacngaacgaccagacgactcggntagtactattactgacgacgagagacgaacacgaaccgttaacacgacggaactaagtaacggtggtcggggtaccgttagggttaccggacggggtaccggaacggggtacccctgggtactcgttacccggccctaccccgaagtccctacccgacgaacccgggtcctaccgttccggtaccctccccgtcgggcctccctccgg

SEQ ID NO: 22401 - DNA, 738 bp, Homo sapiens
  misc_feature: GYAE6OF01AISD6.12.40.D07.1.454.CMB.1.raw
  modified_base (319)..(319): a, c, t, g, unknown or other
  misc_feature (319)..(319): n is a, c, g, or t
tcagatacgacgtacacgaccggtgctcgatttagtgatagagcgtaacaacagagggctcaccatggagtttgggctgagcttgggttttcctcgttgctcttttaagaggtgtccagtgtcaggggcacctggtggagtcgtggggggagccgtggtccagcctgggcggtccctgacactcgcctgtgttgcctctggactttccctcaatttcattccatgcactgggtccgccaggcctccgaggcgaaggggctcggaggtgggtgcacttatgcacatgatggctacaactaatctaacgctaaagttccgnggacggggccattccaccgatcccgtaccaaggtacgaactaattaacaaacgtaaacctaccccgttttaatctacgaactaaaagtgaaccacggcctaaggaccgaccgaaggtcccgaacgaccggtactacggtacttaagttacgttcggacgtacgaagacggtaacgaccaacgaaccgaacctaccgtacggacctaaacgtaacgtaacggtacgggggtccgtttacgggttccggtaccgggggtaccgtaaccggggggtaccccgttcgggtaccgtacgttacccgttcccgtacccccgaccggttacccctaacccggtacccccgaaaccgggtacccccgaaacgttccccgggttaccccgtttaccccccgggcgggtccccgtcccgttaccccggg

SEQ ID NO: 22402 - DNA, 581 bp, Homo sapiens
  misc_feature: GYAE6OF01AKMMB.12.40.D07.1.454.CMB.1.raw
  modified_base (208)..(208): a, c, t, g, unknown or other
  misc_feature (208)..(208): n is a, c, g, or t
  modified_base (359)..(359): a, c, t, g, unknown or other
  misc_feature (359)..(359): n is a, c, g, or t
  modified_base (413)..(413): a, c, t, g, unknown or other
  misc_feature (413)..(413): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttnaatttctattccatgcactgggtccgccaggctccaggcaaggggctcgagtggggtgcacttattgcacatgatggcgtcaacaaattctacgcaaattccgtgaggggccattcacatctccagagacaattacaagaacaccctttanctgacaaaatagacagccctgagacccagacgacacggctgtctattattgcgngagagagacacacgaacctacgtggaccaatactaagtggggtactttggttcgtggggccaggggtaccctggtccagtccgtcctccccgacgtccctacccgaccgaacgggccccctacgttcccgggtcctttccccccgaggtcccgtccccgtgtaccccg

SEQ ID NO: 22403 - DNA, 647 bp, Homo sapiens
  misc_feature: GYAE6OF01DV7BC.12.40.D07.1.454.CMB.1.raw
  modified_base (310)..(310): a, c, t, g, unknown or other
  misc_feature (310)..(310): n is a, c, g, or t
  modified_base (408)..(408): a, c, t, g, unknown or other
  misc_feature (408)..(408): n is a, c, g, or t
  modified_base (576)..(576): a, c, t, g, unknown or other
  misc_feature (576)..(576): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctgggtggagtcgtggggggagccgtggtccagcctgggcggtccctgacactcgcctgtgttgcctctggtacttttcccttctaattttctattccatgcacgtgggtcccgccaggcctccgaggccgaaggggctcggagtggggtggcactttagtgcacatgatggctacaaanaaattctaacgactaaaacttccggtaggacggggccgtaatttccgaccctattcctaccaagacgaactaattaacaaagaacctacccctttaanctagaactaaaatacgaccacgccgttagaacgaaccgagaaccgacgacggtctgtacttattagttgcgacgagacgtacgacaaccaacgaacctacgtacgacctaagtacgtagtggggtctttggttcgtcggggcgacggggtccctggtctgtccgtccncccgcgtacccgtaccgaacccgaccgggtcccaccggttccgttcccttccccgtcggcccgtcccgtcg

SEQ ID NO: 22404 - DNA, 722 bp, Homo sapiens
  misc_feature: GYAE6OF01EORRS.12.40.D07.1.454.CMB.1.raw
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgaggggcaccgtgggtggaggtcgtggggggagccggtggtccagccgtggggccggtccctgacactcgcctgtgttcgcctcgtgtacttttcccttctaattttctacttccatcgcacgtcgggtccnccaggcctcgaggacgaacggggctcggaggtggggngactacttatgcacatgatggcgtacaaactaattctacgactaaaacgttccggaggacgggggcctattaccacctattcctacccgtaaaggacgtaaactaaaacgttaaccgaaaataaacccgttacctttatacgtagaactaaaagacgaaccacgtccctaagaaccgaaccgaagaaccgacgtacggtcttcgttattagtttacgttagccgagaaggagaacgaaccacgaaccgtaacctcgacgtaaccaagtaacgtagggtcggggtactttcgggtacggttcggggaccgacggggtacccttggtaccgacgttcccgtacccgcccccgaactccccgtaccgaaacccgggaccggccctacggtttccccgtccccgtttacccccgcggtccctccccggtacgg

SEQ ID NO: 22405 - DNA, 912 bp, Homo sapiens
  misc_feature: GYAE6OF01C2KOR.12.40.D07.1.454.CMB.1.raw
  modified_base (367)..(367): a, c, t, g, unknown or other
  misc_feature (367)..(367): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcacctgggtggagtcgtgggggagccggtggtccagccgtgggcggtccctgacactcgcctgtgttgcctctggtactttcccttcaattttctattcccatgacacgtgggtcccaccgaggcctccgaggcgaaggggctcggaggtgggtcggactacgttatcgcactagtgtatggctacaacgtaaattcacgacaaacgtttccggaggacgggcctaacttccaaccgtnttaccaccgaagtacgaaactaaagttaacaaacgtaaccttaaccctttagaccttagaaaccgtaaaaagtaccgtaaccgaacggtacccttaggaaacccggacctaaacggaaccggaaccgtaaccgggttccttacgggttactttaacgtttaagttccgggaaccggtaaccggtaaagggtaaccgaacggtaaacccgtaaaaccgtaacccggtaaacccgttaaccggtacgggtaaaccccttaaaggtttaaccccgttaaaggggggttccggggggttaccttttaggggtttacccgggttaccgggggaaccccggttaacggggggtacccccttggggttaaccccgtccggttacccgggttaaccccctaccccccggtaaaccgggtaccccccttaacccccggtaaaacccgggtaaccccgggggtaaccccccctttacggggtttcccccccggtttaacccccggttacccccccgggttccggtaccccccgggttacccccgttaacccgggg

SEQ ID NO: 22406 - DNA, 537 bp, Homo sapiens
  misc_feature: GYAE6OF01B9FMQ.12.40.D07.1.454.CMB.1.raw
  modified_base (365)..(365): a, c, t, g, unknown or other
  misc_feature (365)..(365): n is a, c, g, or t
  modified_base (422)..(422): a, c, t, g, unknown or other
  misc_feature (422)..(422): n is a, c, g, or t
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
  modified_base (507)..(507): a, c, t, g, unknown or other
  misc_feature (507)..(507): n is a, c, g, or t
  modified_base (527)..(527): a, c, t, g, unknown or other
  misc_feature (527)..(527): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccgaggcaaggggctcgagtgggtgcacttattgcacatgatggcgtcaaacaaattctacgcaaattccgtggagggccattcaccatcctccagacgacaattacaagaacctaccctttanctagactaaatcgacagcctagagaccagacgacacgctgtctattatgcgagaganacgacacacgaaccatcgacatacagtcgggnttgtcgtgggccagggcccnggtcatcgcctcccagccctccaccgacgcccntccggtcctaccccgcgccncccgtgcccg

SEQ ID NO: 22407 - DNA, 658 bp, Homo sapiens
  misc_feature: GYAE6OF01EYRM5.12.40.D07.1.454.CMB.1.raw
  modified_base (425)..(425): a, c, t, g, unknown or other
  misc_feature (425)..(425): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctgggtggagtcgtggggggagccggtggtccagccgtgggcggtccctgacactcgcctgtgttgcctctggtactttcccttctaattttctattccatgcacgtcggggtcccgccaggcctccgagggaccgaaggggctcggaggtggggtcggactacttagttcgacacagtgatggacgtacaaaactaaacttcgtaacgactaaacgttccggtagggacggggtccctattaccaacctatcctaccgaagacgaactaattaacaaagtaacctaccctttanactagaactaaagtacgacagtcctagaacacgagaccgacacggtctgtactattatcggacgagagagacgacacgaccgtaactacgtcgacctaatacgtaggtcgggtctttggtcggcgggaccgacgggtaccgttggctacgtccgtaccctaccccgcgtacccctaccgacccggaccggtccctaccggttcccgtaccctccccgtcggccctcccgtacg

SEQ ID NO: 22408 - DNA, 864 bp, Homo sapiens
  misc_feature: GYAE6OF01CD4AD.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcgtccctgacactcgcctgtgttgcctctggtatttcccttcaattttctattccatgcacgtcggggtccgccaggcctccgaggcgaaggggctcggaggtgggtgctacttatgcacatgatggcgtacaactaaattcacgtactaaagtttcccggtaggacggggtcctatttccaccgtattccgtaccgaaggtacgaactaaatttaaccgaaacgtaacccttaaccccttttaatccgtagaacctaaaaagtacgaacgtacggtaccctagggaaccgtaacccggaacggaaccggtaaccgtaccgggtcgtttacggtttaacctttaagtttacgttacgggaccggtaacggtaaacggaacggtaacgaaacccgtaaacccgtaaaccccggtaaaacccgttaccgggtaaccggtaaacccttaaaacggttaacccggtttaagggggttaccggggggtttaccgttttaccggggttaccggggtaccggggggtaccccgggtaaccgggggttaccccgttacggggttacctaaccggtttccccgttacccgttaccccccgacgttacccccgtaacccggaaaccccggtaaccgggtacccccttaccggtttaccccggttcccccgtttacccccggccggggtcccctccccggttacccgg

SEQ ID NO: 22409 - DNA, 657 bp, Homo sapiens
  misc_feature: GYAE6OF01B8BNS.12.40.D07.1.454.CMB.1.raw
  modified_base (211)..(211): a, c, t, g, unknown or other
  misc_feature (211)..(211): n is a, c, g, or t
  modified_base (410)..(410): a, c, t, g, unknown or other
  misc_feature (410)..(410): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtcccgtgacactcgcctgtgttgcctctggtactttccctnaatttctattccatgcacgtcgggtcccgccgaggcctccgaggacgaacggggctcggaggtggggtcgctacgtttatgcactatgagtggactacaaacgtaaatttccgaacgactaaacgtttccggaggacggggcctattccaacctatcctaccgagaacactaaattacaaacgtaaccttacctttaanctagacaaaatcgacagccagaacgaccagaccgacgacgtctgtacttattatgcgacgagagacaccacgaaccgacctacgtcgacctaatacgtagtacggggtctttagggtccggtacggggaccgtacggggtacccttcgggtcctacgttccgtaccccgtccccgaccgtcccctacccggaacccgacgggtcccctacgtcccggttacccttccccgacggcccgtcccgtacg

SEQ ID NO: 22410 - DNA, 760 bp, Homo sapiens
  misc_feature: GYAE6OF01DOJ2X.12.40.D07.1.454.CMB.1.raw
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtcgtggggggagccgtggtccagcctgggcgtccctgacactcgcctgtgttgcctctggtacttttcccttctaattttctattccatgcacgtggggtcccgccaggctccgaggcgaaggggctcggaggtgggtggctacttattgcacatgatggcgtacaaactaaattcctaacgactaaacgtttccggtggacgggggcctatttccacctatcctccaagtacgaacctaatttaacaaacgtaaccttaaccccgttttatacttacggactaaaaatacgaacacgtcccgtagaacgaacccaaggaacccgacgaccgggtacttacggttaccttaagtttaagttcggtacgacggaagacgaacgtacaaccgaaccgtaaacccgttacgtacggaacctaaacttaccggttaaggttggggggtccttttcgggttccggttaccggggggacccggtaacgggggtccccttagggtccttaacgtcccggttacctccccccgaaggtcccccttaccccggaaaccggaacccgggtccccaaccggtttcccgggttaccccctttaccccccggtcggcccccgtcccgtcccgg

SEQ ID NO: 22411 - DNA, 570 bp, Homo sapiens
  misc_feature: GYAE6OF01A1217.12.40.D07.1.454.CMB.1.raw
  modified_base (379)..(379): a, c, t, g, unknown or other
  misc_feature (379)..(379): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (460)..(460): a, c, t, g, unknown or other
  misc_feature (460)..(460): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggatttcccttcaatttctattccatgcactgggtccgccaggcctccgaggcaaggggctcggaggtggggtggctacttattgcacatgatggcgtacaacaaattcaacgcaaattccgtggaggggccgattccaccatctaccagacacaattacaaagtaaacctaccctttaanctagacaaatagaacagccctagaacgaaccagaccgaacacggctgtactattattgcgaganaganacacacaactacngacaatacgtagtagggtcttggttcgcgggcgacggggcctggtcagtccgtcctcccgacgccctaccgacacggccctacgtccgtaccctccccgcgccgccgtcg

SEQ ID NO: 22412 - DNA, 621 bp, Homo sapiens
  misc_feature: GYAE6OF01E1O6E.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtggggtggcacttatgcacatgatggcgtacaacaattctacgacaaacttccggtaggacggggccgtaattccaacccatccctacgaaggactaactaactaaaccgaacgtaaacccttacctttactcgtacgaactaaagtacacgactacgtagaccgacaacggacgacgtcgtactacgtacttattgtcgacgacgagacacgacacgaacctacctagacaactagtacgtgggtcgggtcttggtcggcggacgtaccgggtactggcctcgttcccgtccacccgacgtcccgaccgacgaccggacccttaccggtacccgttccctaccccgcgtcccgtccgtcg

SEQ ID NO: 22413 - DNA, 727 bp, Homo sapiens
  misc_feature: GYAE6OF01C9KGN.12.40.D07.1.454.CMB.1.raw
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (454)..(454): a, c, t, g, unknown or other
  misc_feature (454)..(454): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgaggggcacctggtggagtcgtggggggagccgtgactccagccgtgggccggtccctgacactcgcctgtgttcgcctctggtactttcccttataatttctattccatgctacgtcgggtcccgccaggcctccgaggcgaaggggctggaggtgggtgctacttatgcaanagtgagtcggctacaaagtaattcaacgataattccggnggaacgggcctattccaccagtcctcgaagagaactaagtaacaaaacgtaacctacctttatctagaacaaaatacggaactacgcctagaacgaacccaggaacctacgaccggnttcgtacttattagttcgacgtacggaagtacggaacaacgtaacgaaccgtaaaccctataccggaaacttaaacgttacggttaaacgggttcggggtaccgtttacggttaccgggtccggggaacccgggtaaccggggtacccgttagggtccttaccgggttcccgtaccccgtacccgaccgtacccctaacccgaacccggaacccgggttaccccgaacggtttccccggtccccctttcccccggtccggtccccgtcccccg

SEQ ID NO: 22414 - DNA, 769 bp, Homo sapiens
  misc_feature: GYAE6OF01E3F8N.12.40.D07.1.454.CMB.1.raw
  modified_base (179)..(179): a, c, t, g, unknown or other
  misc_feature (179)..(179): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcacctgggtggagtcgtggggggagccgtggtccagccgtgggccgtcccngacactcgcctgtgttgcctctggtactttcccttactaatttctacttccatcgcacgtcgggtcccgccgaggcctccgaggcgaacggggctcggaggtggggtggactacttattcgacacatgatcgggctacaaactaattctaacgactaaacgttccggtaggacggggcctattccgacctatcctaccagacgtaactaaattaacaacgtaaacccttccctttaatccgtagaactaaaagtcgaacacgtcccgtaaggaaccgaaccgaaggaacccggacgacggtcttacgttacttaagtttacgttcggacggacggaagaacggtaacgaaccgtaaaccgaacccgtaaaccgtaccgtacggaaccctaagtaacgttacgggtcggggttaccttcgggttacggtccgggggtacccggaaccggggttacccgttagggtacctacgttacccggtacccctaccccgtacgtacccccgtaacccggaaccccgggtaacccgggcccgttaccggttccccggttcccttaccccccgggtcggaccccgtccccggttacccg

SEQ ID NO: 22415 - DNA, 1011 bp, Homo sapiens
  misc_feature: GYAE6OF01CJURG.12.40.D07.1.454.CMB.1.raw
  modified_base (155)..(155): a, c, t, g, unknown or other
  misc_feature (155)..(155): n is a, c, g, or t
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgaggggcaccgtggtggagtcgtgggggganccgtggtccagccgtgggccgtccctgacactcgcctgtgtcgcctctggtactttcccttntaatttctacttccatgcctacgtggggtcccnccgaggcctccgagggacgaacgggggctcggaggtggggtcggactacgtttagttgacacagtgatggccgtaacaaactaaatttcctaacaacctaaaacttttccggaggacgggggtaccctagtttaccaaccctaacttccgtacccgaagaacgtaaacctaaaactttaaccgaaacgtaaaaccccttacccctttttaaagtacccttaacggaaacctaaaaaacgttacggaaacccgtaacgggtacccccttaagggaaaaccggtaaacccccgaaaggggaaaccccggtaacccgtaaccccggggtaccgtttaccggtttaaccgtttaaacggttttacggttaccgggtaccggtaaccggggtaaaacgggtaacgggaaaccgtaaaaccccgtaaacccgtaaaacccccgggtaaaacccccgtttaaacccggtaacccggggtaaaccctaaaaacggttttaacccgggttaaccgggtttacggggggggtttaccttttaccgggggttttaacccggggttacggggggtaaccccgggtaacccggggggtaccccggtttacgggttacccgttacccggttacccgggtttacccctaccccccgtaaccggtccccccgttaaccccgaaaccccggtaacccggggtacccccttacccggtttcccccgggttacccccgtttaccccccggtccgggtcccccggtcccccggttacccgg

SEQ ID NO: 22416 - DNA, 701 bp, Homo sapiens
  misc_feature: GYAE6OF01CBIYE.12.40.D07.1.454.CMB.1.raw
  modified_base (188)..(188): a, c, t, g, unknown or other
  misc_feature (188)..(188): n is a, c, g, or t
  modified_base (304)..(304): a, c, t, g, unknown or other
  misc_feature (304)..(304): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcgaggggccaccgtgggtggagtcgtggggggagccggtggtccagccgtgggccggtccctgacnctcgcctgtgttgcctctggtactttcccttctaattttctattccattcgcacgtcgggtccgccaggcctaccgaggcgaaggggcctggaggtgggtgctactttgtcgacanagtgattcgggctacaaactaaactttccaacgtactaaagtttcccggaggacgggggtcctatttccaacctattccctaccgaaggaacaacctaattacaaacgtacctacctttatctagacaaataggaccagtaccctgaagaccacggtaaccgcgacggtctagtctttaacgttagtcggaccgagaagacgagaaccaccgaaaccgaaccgtcgtacgacccttaaagtccgttaggtcggggtctttcgtacggtcgggaccgtaaggggtccctgggtccacgttccggaccccttccaacggcccctacccgaaacccggtacccggaccccctttaggtcccccgttacccgttcccccgacggccccgtcccgttaccgg

SEQ ID NO: 22417 - DNA, 723 bp, Homo sapiens
  misc_feature: GYAE6OF01DE7XX.12.40.D07.1.454.CMB.1.raw
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcaggggcacctggtggagtcgtggggggagccgtggtccagcctgggcgtccctgacactcgcctgtgttgcctctggtactttccctntaatttctattccatgcacgtgggtccncaggctccgaggcgaaggggctcggaggtgggtcgctacttatgcacatgagtggctacagtactaaattcaacgactaaacgttccggtaggacggggtccctatttcccaacctatttacctaccgaagtaaacgaactaaaattaaccgaaaacgtaaacccttaacccttttaagccttagaaacctaaaagtacgaacctacgtcctaagaaccgaaccgaacgaacgacgaccggtcttacgtacttaagttagtgaccgacggtaagagaacgaccaacaaccgaacctacgtacggaacctaaagttacgtaaggtcggggttactttcgttcgggtacgggtcccggtaacggggtacccttaggtactaccgttcccgtacccgtaccccgacgtcccctacccgaaacccggtaccggtaccccgttacggttaccccggtaccccgtttccccggcggtccccgtccccgg

SEQ ID NO: 22418 - DNA, 673 bp, Homo sapiens
  misc_feature: GYAE6OF01C3TOU.12.40.D07.1.454.CMB.1.raw
  modified_base (152)..(152): a, c, t, g, unknown or other
  misc_feature (152)..(152): n is a, c, g, or t
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (346)..(346): a, c, t, g, unknown or other
  misc_feature (346)..(346): n is a, c, g, or t
  modified_base (512)..(512): a, c, t, g, unknown or other
  misc_feature (512)..(512): n is a, c, g, or t
tcagatacgacgtacacgaccggtgctcgatttagtgatagagcgtaacaacagagggctcaccatggagtttgggctgagcgtggtttcgtcgttagctcttttaagaggtgtccagtgtcaggggcacctgggtggagtcgtgggggganccgtggtccagccgtgggcggtcctgacactcgctgtgtgcctntggtactttccctctaatttctattccatnctacgtcggggtcccnccaggcctccgagggcgaagggggctcggaggtggggtggctatttattgccaagatggatgggactacaaaactaaattccgaacgtactaaaactttccggnggtaggggaccctattaccaactatccgtaccaaggacaaactaaaagttacaaacgtaaccttaccctttaagtcctaggaacctaaaaatcggaacctacggccctagggacgaaaccgagtaacccgacgacgtacctgttacttagttaattggcgcgaagngagaacacgtaacgactacgtacgactaagtacgttagtgggggttacttgggttcgtcggggcgtacggggtcctggtaccgtcgtccgtctccccgtacgccctaccgaaccgtccgggccttaccgtccggtcccttaccccgtggcccgtcccgtcg

SEQ ID NO: 22419 - DNA, 747 bp, Homo sapiens
  misc_feature: GYAE6OF01EMPJT.12.40.D07.1.454.CMB.1.raw
tcagatacgacgtacacgaccggtgctcgatttagtgatagagcgtaaacaacagaggactcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggtactttcccttctaatttctattccatgctactcgggtccgccaggcctccgaggcgaagggggctcggaggtggggtggctacgttatgcacatgatggcgtacaactaaattcctacgactaaagttccggtggacgggggacctagttccaacccgatcctacccaaggacgaactaattaacaagtaacctaccgtttaatctagacaaatacggactacgcctagaacgaaccaaggaccggtaaccgaccgggtcttacggtaccttagtttacgttcggaccggtacgaaggtaacgaacgtaacccgaaaccgtaaccgaaacccgttacgtccggaaccctaaagttaacccggttagggttacgggggttctttaggtcccgggttaggggaccccgacggggggtacccttgggacctacgttcccggtacccctacccccgtagtccccttaccccggaacccgtaaacccgggccctaacccggttcccggttccccttaccccccgggcgggtacccccgtccccgtaccggg

SEQ ID NO: 22420 - DNA, 821 bp, Homo sapiens
  misc_feature: GYAE6OF01B9HZT.12.40.D07.1.454.CMB.1.raw
  modified_base (153)..(153): a, c, t, g, unknown or other
  misc_feature (153)..(153): n is a, c, g, or t
  modified_base (217)..(217): a, c, t, g, unknown or other
  misc_feature (217)..(217): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcacctgggtggagtcgtgggggganccggtggtccagccgtgggccggtccctgacactcgcctgtgttgcctctggtactttcccttntaatttctattccatgctacgtgggtccgccaggcctccgaggcgaaggggctcggaggtggggtggctacttatgcacatgagtggacgtacaaactaaattccgtaacgactaaacgttcccggtaggaacggggccctaatttccaacctactccgtaccgaaggaacaactaaacttaacgaaacgtaaccttacccctttaatctagaactaaagtacgaacgacgtaccaggaacaaccccgaaggacccgtaacggaccggtaccttagttaccgttaattaacgttcggaccgaacggaaggaacgaacgtaaccgaaccgtaaacccgaaccttacgtaaccggtactaaacgtacgttacggtacgggggttacctttacgggtttaccggtacgggggaccggtaacccgggggttacccgtaccggggttactaaccggttccccggttaccccgtaccccccggtaacggtaccccccgtaaccccggtaaaccccgggtaaaccccggggtaccccctaaccgggttcccccgggtttacccccgtaacccccccgggttcggtacccccggttccccccgttacccggg

SEQ ID NO: 22421 - DNA, 656 bp, Homo sapiens
  misc_feature: GYAE6OF01CSFFO.12.40.D07.1.454.CMB.1.raw
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (437)..(437): a, c, t, g, unknown or other
  misc_feature (437)..(437): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctggggggagccggtggtccagcctgggcggtccctgacactcgcctgtgttgcctctggacttttcccttnaattttctaattccatgcacgtggggtccnccaggcctccgaggccaagggggctcggaggtggggtgctacttattgcacatgatggcgtacaaactaaattctacgactaaattccggtaggacggggcctatccacctatcctaccagagaactaattacaaacgtaacctaccctttaatactagaaaaatgaacagcctagacaaccaacgaccgtaacncggtctgtacttattacgttgacggagtaggacgaacgtaccacaacgaacctacgtcgaacctaatacgtaggtcggggtctttcggtcggtacggggtaccgacggggtacccttggactacgtccgtcctccccgagtaccccgtccgaaccggacgggcccctacgttccccggtcccgttccccgtacggcccgccccgtcgtcccgtacccgg

SEQ ID NO: 22422 - DNA, 696 bp, Homo sapiens
  misc_feature: GYAE6OF01C4B8U.12.40.D07.1.454.CMB.1.raw
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (484)..(484): a, c, t, g, unknown or other
  misc_feature (484)..(484): n is a, c, g, or t
tcagatacgacgtacacgaccggtgctcgatttagtgatagagcgtaacaaacagagggctcaccatggagtttgggctgagctgggttttcctcgttgctcttttaagaggtgtccagtgtcaggggcacctgggtggagtctggggggagccgtggtccagcctgggcggtccctgacactcgcctgtgttgcctctggacttttccctnaattttcattccatgcacgtgggtccncaggctccgagcgaagggctcgagtgggtgctacttatgcacatgaatggacgtacaaactaaaacttctaaccaactaaaactttcccggtaggaagggggcccgaatttaccaccaattccgtaccaaagagtaaccaaattacaaaagaacctaaccctttatacagacaaaaagtnaacngacctaggaacgaaccaagacgtacaacggtctggtactattatagcgtacgaagacgaanaacgaccaacgtaacctacgtagacccaaattaacgtaaggtcgggggttactttagggttccggtaggggaacccgtacgggggtaccccttagggttaccaacgtccgttacctaccccgaacggtaacccttcccgaaaaccgaaaccgggtcccctaaacggttcccggttaccccttccccccgttagggtcccctcccggtaccgg

SEQ ID NO: 22423 - DNA, 722 bp, Homo sapiens
  misc_feature: GYAE6OF01CTFTG.12.40.D07.1.454.CMB.1.raw
  modified_base (249)..(249): a, c, t, g, unknown or other
  misc_feature (249)..(249): n is a, c, g, or t
  modified_base (285)..(285): a, c, t, g, unknown or other
  misc_feature (285)..(285): n is a, c, g, or t
  modified_base (658)..(658): a, c, t, g, unknown or other
  misc_feature (658)..(658): n is a, c, g, or t
tcagatacgacgtacacgaccggtgctcgatttagtgatagagcgtaaacaacagagggctcaccatggagtttgggctgagcttgggttttcctcgttgcttcttttaagaggtgtccagtgtcgaggggcaccgtgggtggagtcgtgggggagccgtggtccagccgtgggccgtccctgacactcgctgtgttcgcctctggtactttcccttataatttcctattccatgctacgtcgggtccncgaggctccgaggacgaacgggctcggaggtggggngactaacgttattgacacatgatcggcgtacaaactaaattctaacgactaaacgttccggtaggacggggcctaacgtttccaacgtactcctaccgaagaacgtacaaacttacaaacgtaacctacccctttatacagtaacaaatacgacacgtcctagaacacgacgaacgaccgacgggtcttacgttattaacgttagttacgaccggtacgtaaaggacgtaacgaacccgtaacggtaaacccgtaaacccttacgggtaccggtaaccctaaacgtttaaccggttaagggtaccggggttcttttaaccgggtccgtacgggggacccgtacggggtacctacggtactacgtccgtacccnccccgagtcccctacgaccgtacccggccttcgtcccggttcccttcccggcgcccgtccgtcg

SEQ ID NO: 22424 - DNA, 564 bp, Homo sapiens
  misc_feature: GYAE6OF01BAIXN.12.40.D07.1.454.CMB.1.raw
  modified_base (209)..(209): a, c, t, g, unknown or other
  misc_feature (209)..(209): n is a, c, g, or t
  modified_base (266)..(266): a, c, t, g, unknown or other
  misc_feature (266)..(266): n is a, c, g, or t
tcagatacgacgtacacgaccggtgctcgatttagtgatagagcgtaacaacagaggactcaccatggagtttgggctgagctgggtttcctcgttgctcttttaagaggtgtccagtgtcaggggcacctggtggagtctggggggagccgtggtccagcctggggcggtccctgacactcgcctgtgttgcctctggatttcccttnaatttctattccatgcactgggtccgccaggctccaggcaaggggctcgagtggggngcacttatgcacatgatggctacaactaaattctaacgcaaattccgtgaggggccattccacatctccgagagaaccaattacaaagaacctaccctttatctgacaaaatacaacagcctagacgaccaagacgaacacgctgtctattatgcgcgagagagacacacgaactactcggacaactacgtagtcggggtcttggttcgtcgggacgtacgggaccgtaggtcacgtccgtcctcccgcgtcccaccgaccgacggcccacgtccgtcctccccgtcgccgcccgtcg

SEQ ID NO: 22425 - DNA, 576 bp, Homo sapiens
  misc_feature: GYAE6OF01DVQU2.12.40.D07.1.454.CMB.1.raw
  modified_base (209)..(209): a, c, t, g, unknown or other
  misc_feature (209)..(209): n is a, c, g, or t
  modified_base (278)..(278): a, c, t, g, unknown or other
  misc_feature (278)..(278): n is a, c, g, or t
  modified_base (316)..(316): a, c, t, g, unknown or other
  misc_feature (316)..(316): n is a, c, g, or t
  modified_base (468)..(468): a, c, t, g, unknown or other
  misc_feature (468)..(468): n is a, c, g, or t
  modified_base (521)..(521): a, c, t, g, unknown or other
  misc_feature (521)..(521): n is a, c, g, or t
  modified_base (563)..(563): a, c, t, g, unknown or other
  misc_feature (563)..(563): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttnaatttctattccatgcactgggtccgccaggctccaggcaaggggctcgagtgggtgcacttattgcanatgatggcgtacaaactaaattctacgctaaattccgngacggggccaattcaccatcctccaagacgaacaaattacaaacgtaacctaccccttttaatactagacctaaaattaggaaccaagccctaggacgaaccaggaacgacacggctgtcttattattgcgcgagagagacacacgactacngacaatactagtggggcttgtcgtgggccgaggggccctggtcagtccgtccnccccagccctaccaccgacggcccactccggtccttccccgnggcccgtccctcg

SEQ ID NO: 22426 - DNA, 600 bp, Homo sapiens
  misc_feature: GYAE6OF01BIOLV.12.40.D07.1.454.CMB.1.raw
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
  modified_base (414)..(414): a, c, t, g, unknown or other
  misc_feature (414)..(414): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtactttcccttctaatttctattccatgcactgggtccnccaggctccgaggcgaaggggctcggaggtggggtggctacttattgcacatgatggcgtacaacaaattctacgnaaagttccgtggacggggccattcaccatctcaganacaattacaacgaactacctttanctagacaaatagacagcctagaagaccagacgacacggntgtctattatgacgacgagagagacacacgaacctacgtacggacctaatacgtagtcgggggtcctttggttaccgtcggggacccgtacggggaccctcggtcacgtccgtcctccccgacgtccctacccgacccgaccgggcccctaacgtccggtacccttccccgcggtcccgcccctcg

SEQ ID NO: 22427 - DNA, 638 bp, Homo sapiens
  misc_feature: GYAE6OF01AXFQ5.12.40.D07.1.454.CMB.1.raw
  modified_base (111)..(111): a, c, t, g, unknown or other
  misc_feature (111)..(111): n is a, c, g, or t
  modified_base (207)..(207): a, c, t, g, unknown or other
  misc_feature (207)..(207): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
tcagatacgacgtacacgaccggtgctcgatttagtgatagagcgtaacaacaggggactcaccatggagtttgggctgagcgtggtttcgtcgtagctctttaagaggtntcagtgtcaggggcacctggtggagtctggggggagccgtggtccagcctgggcggtccctgacactcgcctgtgttgcctctggtatttcccttnaatttctattccatgcactgggtccgccaggctcccgaggccgaagggggtcctacggaggtggggttggactactttattgcaactatgatgggctacaaactaaatttcaacgctaaaatttccggnggacggggcctattccgaccatccncagganaacaattaacgaacgtaacctacctttancctagacaaatacgaacagaccctagaacgaccaggaaccacgacggcttgtacttatatgcgtacgagagacacacacaacctagacgacaatacgtaggtacgggtcttacggttccgtcggggaccgcggggtaacccttgggtacacgttccgtcctcccgacgtccctacccgaaccggtaccggacccctagttcccggttaccccttcccccggaggcccctcccgtcgtacccg

SEQ ID NO: 22428 - DNA, 697 bp, Homo sapiens
  misc_feature: GYAE6OF01DYMCU.12.40.D07.1.454.CMB.1.raw
  modified_base (151)..(151): a, c, t, g, unknown or other
  misc_feature (151)..(151): n is a, c, g, or t
  modified_base (179)..(179): a, c, t, g, unknown or other
  misc_feature (179)..(179): n is a, c, g, or t
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtctgggggganccggtggtccagccctgggcggtcccgngacgactacggcctagtgttgctctgattcctnatttctatccgatgcacgtggccnccaggcctcaggcgaagggctcgaggtggngcacttatgacanattgagtcggctacaaacaaatttccaacgcaaacgttccggngaacggggccattacacctatcgcccaggacctaanaattcgaaacgtaccctaccgtttaanctagaacaagacgaacacgcctaggactaaccgacgaaccggacgtacggtcttacgttacgttaacgtttacgtcggacggacgacggtaagacgaaccgtaacgaaccgtaaccgtacgacgtaacctaacgttacggtacgggttcgggtacgtttcggggtaccggtacggggacccgggttaacgggtccgtacggtcgtaccggttccgtaccccgtccccgaacccgtccctacccggaacccggtacccgtacccgtaccggtccccggttaccccgttaccccggtccggcccgtaccgtccg

SEQ ID NO: 22429 - DNA, 713 bp, Homo sapiens
  misc_feature: GYAE6OF01D7XD1.12.40.D07.1.454.CMB.1.raw
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
  modified_base (699)..(699): a, c, t, g, unknown or other
  misc_feature (699)..(699): n is a, c, g, or t
tcagatacgacgtacacgaccggtgctcgatttagtgatagagcgtaacaacagagggctcaccatgggagtttgggctgagcttgggttttcctcgttgcttcttttaagaggtgtccagtgtcgaggggccacctgggtggagtcgtggggggagccgtgatccagccgtggggccgtccctgacactcgcctgtgttcgcctgtggtactttcccttataatttctattccatgctacgtcgggtcccncgaggcctaccgaggacgaaggggctcggaggtggggtcgactattagtcgacanagtgagtcggctacaaactaattcaacgactaacgttccggagggacgggcctattccactatccacaganaactaataacaacgaccttaccttanactacgaacaaatacgatacgcctagacaccgagacgacgtacgtcttgtaccttagttacgtacggaccgtaggaagtaacgaacgaaccaaccgtaacccgtaactaccgtacggaacctaagttacggttaaggggttcggggttacctttggttaccgggacgggggtacccgtaacgggggtacccttggtaccgaccgttccctccccggtaccctacggtaccccctaccggaacccggtacccgggaccccttaccgggttccccggttacccctttcccccggggngcccccggttcccg

SEQ ID NO: 22430 - DNA, 606 bp, Homo sapiens
  misc_feature: GYAE6OF01EYJ25.12.40.D07.1.454.CMB.1.raw
  modified_base (150)..(150): a, c, t, g, unknown or other
  misc_feature (150)..(150): n is a, c, g, or t
  modified_base (234)..(234): a, c, t, g, unknown or other
  misc_feature (234)..(234): n is a, c, g, or t
  modified_base (363)..(363): a, c, t, g, unknown or other
  misc_feature (363)..(363): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccgtggtccagcctgggcggtccctgacactcgcctgtgttgcctctggatttccctcaatttctattccatgcactgggtccnccaggctccaggcaagggctcgagtgggtgcacttattgcacatgatggcgtacaacaaattctaacgcaaattccgtaggaggggccattcaccatctccagagacaattacaagtaacaccctttanctgacaaatacgacagcctagacgaccaagacgaacacggctgtctattattgcgtacgagagagacacacgaacctacgtcggacctaagtacgtagtagggggtcttggttccggtggggacccgacggggtacccctgggtccacttcccgtacctcccccgtacgtcccctacccgaacccgaaccggggcccctacgtcccggtcccgttacccccgtcgggtcccgccccgtaccgg

SEQ ID NO: 22431 - DNA, 649 bp, Homo sapiens
  misc_feature: GYAE6OF01EECO5.12.40.D07.1.454.CMB.1.raw
  modified_base (237)..(237): a, c, t, g, unknown or other
  misc_feature (237)..(237): n is a, c, g, or t
  modified_base (408)..(408): a, c, t, g, unknown or other
  misc_feature (408)..(408): n is a, c, g, or t
  modified_base (579)..(579): a, c, t, g, unknown or other
  misc_feature (579)..(579): n is a, c, g, or t
tcagatacgacgtacacgaccggtgctcgatttagtgatagagcgtaacaacaggagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggtatttcccttcaatttctattccatgcactgggtccnccaggctccaggcaaggggctcggaggtgggtgctacttatgcacatgatggctacaaactaattcgtaacgactaaaacgttcccggtagggacgggggccctatttaccaacctagttccctaccgaagaacgtaacctaaattaccgaaagtaaccctacccttttancgtagaactaaagtacgacacgtcctagaacgaacctaagaccgtacgacggcttgtacttattagtcgacgacgagagacgacacaccgactacgtcgactaatacgtggtagggtcttgtcggcggggacctacggggtaccctgaccgtacgttccgtacctccccgngtacccctaccgaccggaaccggccctacgttcccggttaccccttccccggcgtccccgtcccgtccgg

SEQ ID NO: 22432 - DNA, 857 bp, Homo sapiens
  misc_feature: GYAE6OF01BO044.12.40.D07.1.454.CMB.1.raw
  modified_base (394)..(394): a, c, t, g, unknown or other
  misc_feature (394)..(394): n is a, c, g, or t
  modified_base (576)..(576): a, c, t, g, unknown or other
  misc_feature (576)..(576): n is a, c, g, or t
tcagatacgacgtacacgaccggtgctcgatttagtgatagagcgtaacaacaggaggactcaccatggagtttgggctgagtcttgggttttcctcgttgcttcttttaaggaggtgtccagtgtcgaggggccacctgggtggaggtcggtggggggacgtccggttcgggtcccgtacggtcccggttcgggggtcccggttccccttagggaaccaccgtccgtccgttggttcggttcgtcccgtcgttagggtaccttttcccgttacgtaacttttcctaactttcccagtcggtccgtaccggttccggggtcccgccgacgggtccctccgacggggacgggaacgggggcctacgggtagggtcggggtcgaccttaacgtttnttacggcctaactagtggtacgtcggacgttaaccgaaaacttaaacttccaaccggtaacgtaaagttcccgggaggaacggggtacctaagtttccaaccttatccgtacaagggtactaacctaaaattaaccgaaacgtaaaccctttaccttaagtacctacggaattaaaaccggnaaccgacggtaccaggaacaccgaggacctaacgcgtactgtacttagtactaggcgaccgtagacacgactaccaacgtaccgttacgacgacctaataaccgggtagttaccgggtacgtttcggtcgggtccggtaacgggtaccccggtacgttcggtactaccggttccgacccgttaaccccgcgtaccccgtaccggtaaacccgacccgggtaccctaccggtttccccggggtacccccttccccgggaacggtccccgtccccggttaccg

SEQ ID NO: 22433 - DNA, 846 bp, Homo sapiens
  misc_feature: GYAE6OF01BWUNW.12.40.D07.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagccgtgggccggtccctgacactcgcctgtgttgcctntggactttccctntaatttctattccatgcacgtcgggtccgcaggctccgaggcgaaggggctacggaggtgggtcggactactttagtcgcactatggtagtcggaccgtacaaacctaaatttcctaacgactaaaagtttcccggtaggacggggacctagttccaacctaatcctaccgaaggtaacgtaactaaagtttaaccaaacggtaaacccttaacccctttaagtaccgtacgaaactaaaacgtaacgggaacaaccggtaccgtaacgaacggaaacccgaacgggaacccggtaaccgaccgggttacttacggtttaactttaacgtttacggttacggaccgaccgggtaaagtacggaacgaacccgtaaaccgtaacccgtaaaccgttaaccggtacggaaccctaaaacgtttaccggtaacggggttacgggggtttccctttacgggtttaccggggtaccgggggtaacccgggtaaccgggggtacccgttacgggtaccgttaaccggtcccgttcccgttaccccggaccttaccccgaccgtaaaccccggaacgggtccccctaacggttcccccggttacccgttaccccccggtcggtccccgtccccgtaacccgg

SEQ ID NO: 22434 - DNA, 644 bp, Homo sapiens
  misc_feature: GYAE6OF01B565G.12.40.D07.1.454.CMB.1.raw
  modified_base (239)..(239): a, c, t, g, unknown or other
  misc_feature (239)..(239): n is a, c, g, or t
  modified_base (517)..(517): a, c, t, g, unknown or other
  misc_feature (517)..(517): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtacttttcccttctaatttctattccatgcacttgggtccnccaggctccgaggcgaaggggctcgaggtggggtgcacttatgcacatgatggcgtacaaacaaattccaacgacaaatttccgtggacggggcccgatttccaccgtatcctacccgaagaacgtacaaaacttaaccgaaaagaaaccctaccccttttaatcttagaacctaaaaagttacggacaacggcccttaggaacgaacccaaggaccgaacgaccggctcgtacttaatttacgttgacgacgaagacgagacacaaccgaacctacncgacaatactagtcggggtcttggtcgcgggcgacgggaccgtggtcagtccgtacctcccgacgtccctacccaccgaccgggacccaggttcccgtcccttacccccgtcggcccgtccccgtcg

SEQ ID NO: 22435 - DNA, 786 bp, Homo sapiens
  misc_feature: GYAE6OF01CLTML.12.40.D07.1.454.CMB.1.raw
  modified_base (247)..(247): a, c, t, g, unknown or other
  misc_feature (247)..(247): n is a, c, g, or t
  modified_base (401)..(401): a, c, t, g, unknown or other
  misc_feature (401)..(401): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagccgtgggcggtccctgacactcgcctgtgttgcctctggtacttttcccttactaattttctattccatcgcacgtcgggtcccncaggcctccgaggcgaaggggctcggaggtggggtgctacttatgcacatgatcggctacaaactaattcatgactaaagttccggtaggacgggcctattaccacctatcctacagaacgactaattaaccaacgtaaccttaacccgtttanaccgtagaactaaaacgtacgaacctacgtacccgttaggaaaccgtaacccgaaggaacccggaaccgtaaccggtccgttacggttaacctttaacgtttacgtttacggacggtaaccggtaaggaacggaaccggaaccctaaacccgaaacccggttaaaccccgttaacggtaccgggtaaaccctaaagttaaccggttaacgggttcgggggttacctttcgggttccggtaccggggacccgggtacggggtaccccgttggtacctaccggttcccgtacccgtaccccgtaccgtaccccgtacccgaacccggtacccgggccccttccgggttacccgttcccccgtcccccgtcgggtccccgtaccccgg

SEQ ID NO: 22436 - DNA, 685 bp, Homo sapiens
  misc_feature: GYAE6OF01DW1XE.12.40.D07.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (385)..(385): a, c, t, g, unknown or other
  misc_feature (385)..(385): n is a, c, g, or t
tcagatacgacgtacacgaccggtgctcgatttagtgatagagcgtaacaacaggggactcaccatggagtttgggctgagctgggttttcctcgttgcttcttttaagaggttgtccagtgtcaggggcacctggtggagtcgtgggggagccgtggtccagccgtgggccggtcctgacactcgctgtgttgcctntgatttcctnaatttcattccatgcacgtgggtccncaggctcaggcgaaggggctgaggtgggtgctacgttatcgacacatgatggactacaaactaaattctaacgactaaacgtttccggaggacggggacctattccacctatcctacgagagactaattacgaaacgtacctaccgtttanactaggactaaatagactacgacctagaacgacgacgtaccgactacggtctagtacttattacgttcgacgtcgaagtaagacgaacaaccgaaccggtaaacctacgtaccggaactaacgttacgtacggttcgggggtactttccggtacgggtcggggaccggtaccggggtacccgttgggtactacggtacccgtccctaccccgtaggtcccccttaccggaaccgaccgggtacccctgtttaccccgggttcccttacccccggtagggtccccctccgtccggtccccg

SEQ ID NO: 22437 - DNA, 859 bp, Homo sapiens
  misc_feature: GYAE6OF01B0IZO.12.40.D07.1.454.CMB.1.raw
  modified_base (150)..(150): a, c, t, g, unknown or other
  misc_feature (150)..(150): n is a, c, g, or t
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccgtggtccagcctgggcgtcctgacactcgcctgtgttgcctntggactttccctnaatttctattccatgccactgggtccnccaggctcgaggcaagggctcggaggtgggtgcctacttattgacacagtgatggctacaactaaattcctacggactaaagtttcccggtaggacgggggtccctagtttccaaccgtacttaccgtacccgaaggacgtaaccttaaatttaccgaaacggtaaacccttaccccttttaagtaccttacggaacctaaaaagtaccgggtaacctacggggtaccccttaagggaacgtaaaccccgtaaacgggtaaccggtaaccggtaaccgggtaccgttacggtttaaccgttaacgttttaaccgttagggtaccggtaaccgggtaacggtaacggtaacggaacccgtaaaccgtaaccccgggtaaacccgttaacccggtacgggtaaccctaaacggttaaccgttaacgggttaccggggggttaccgttttcgggtttaccgggtaccggggtaccgggtaaccgggggtacccgttcgggttacccggtacgttcccgttacccgtcccccgtaccggtaccccgtacccggtacccggaaccgggtaccccgtaaccgttcccgggttaccccttaccccccggtcggtccccgttccccggtccgg

SEQ ID NO: 22438 - DNA, 665 bp, Homo sapiens
  misc_feature: GYAE6OF01BSN2Y.12.40.D07.1.454.CMB.1.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtatttccctnaatttctattccatgcacgtcgggtcccnccaggctccgaggcgaaggggctcggaggtggggtgctacttattcgcacatgatggacgtacaaactaaattctaacgctaaacgttccggtaggacggggcccgtaattccacctattcctaccgaagtaacgaactaaaactttaacaaacggtaacccttaacccctttaatacctacgaactaaaactacgaacacgtacctaggacgaaccaacgaccgacgaccggtcttacgtacttattatggacgacgacgaagacgaacaccgaacgaacctacgtcgaacctaatacgtaggtcgggtacttgtcggtacgggccgtacgggtacctggtacctacgttccgtccgttaccccgcgtcccaaccaccggaccggtccctacgtcccggttccctccccgcggtccgtcccgtcg

SEQ ID NO: 22439 - DNA, 616 bp, Homo sapiens
  misc_feature: GYAE6OF01A1PSG.12.40.D07.1.454.CMB.1.raw
  modified_base (390)..(390): a, c, t, g, unknown or other
  misc_feature (390)..(390): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccggtggtccagccgtgggcggtccctgacactcgcctgtgttgcctctggtactttcccttctaatttctattccatgcacgtcgggtccgccaggcctccgaggcgaagggggctcggaggtggggtggctacttattgcacatgatggctacaactaattcaacactaaattccgaggacggggcctattccaccatcctaccaagagaacaattaacaacgaacctaccctttanctagacaaatacgacagtacctagaacgaccagacgacgacggctgtactattagtgcgacgagagagacaacacgaacctacgtacgactaatacgtaggtagggtcttggtccggtgggaccgacgggtcccgtggtaccacgtccgtaccgtccccgtacgtcccacccgaccgacgggtccctacggttcccgttcccctaccccggtcgcccgtcccgtcg

SEQ ID NO: 22440 - DNA, 763 bp, Homo sapiens
  misc_feature: GYAE6OF01CUH65.12.40.D07.1.454.CMB.1.raw
  modified_base (153)..(153): a, c, t, g, unknown or other
  misc_feature (153)..(153): n is a, c, g, or t
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctgggtggagtcgtgggggganccgtggtccagcctgggcgtccctgacactcgcctgtgttcgcctctggtacttttcccctnaattttctattccatcgctacgtcgggtcccnccaggcctccgaggcgaaggggctcggaggtgggtcgactacttattgccactatggtagtggccgtacaaaactaaatttcctaacgacctaaaacgtttcccggtggacgggggtaccctaatttcccaaccgtactccgtacccgaaagacgtaactaaaacgttaacaaaacgtaaaccctaacccctttaatcctaacgtaacaaaaagttacgaacacgtaccgtagaaccgaaccacgaacgaccgaccggtacctgttacttattacgttacggcgtacgaagagacgaaccaccgaaccgaacctacgtacggaacctaacttacgtaaggttcgggggttcttacggttcggtcggggacccgtaaccggggtcccgtacggtcccgtacgtcccggttcccctacccccggacgtcccccgtaacccgaacccggaacccgggtaccccgtacccgttcccggttacccccttccccccggccggtccccggtccccgtacccgg

SEQ ID NO: 22441 - DNA, 1009 bp, Homo sapiens
  misc_feature: GYAE6OF01C4C8G.12.40.D07.1.454.CMB.1.raw
  modified_base (151)..(151): a, c, t, g, unknown or other
  misc_feature (151)..(151): n is a, c, g, or t
  modified_base (240)..(240): a, c, t, g, unknown or other
  misc_feature (240)..(240): n is a, c, g, or t
  modified_base (421)..(421): a, c, t, g, unknown or other
  misc_feature (421)..(421): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtctgggggganccgtggtccagcctgggcggtccctgacactcgcctgtgttgcctctggtattttcccttcaattttctattccatgcacgtgggtccnccaggcctccgaggcaaggggctcgagtgggtgcacttatgacacatgatggctacaaacaattcctaacaactaaaatttcccggtaggaacgggggtcccaatttcccgaacctaattcctaccccaaggaacgtaacctaaaattaacgaaaacgtaacccttaaccccctttttaanccgttacgaacctaaaaaagttacggaaccctaacgggtaccccttaagggaaccgtaaacccccgaaaggaaacccgggtaacgtaacccggggtacccgtttacgggtttaaccctttaaagtttttaacgtttacgggtaacccgggtaacccgggtaaaagggaacggtaaccgggaaaccctaaaccccgaaaaaccccgggttaaaaccccgttaaccccggtttaaccgggaaacccccgttaaaacgtttaaacccgtttaaacggggtttaccgggggggggtttacccctttttacggggttttaacccgggttccgggggggggttaaccccccggtaaacggggggggttaccccccggtttacgggggtacccgtaaacccggtttccccgggttacccccgttaccccccccggtaaaccgggttacccccccgttaacccccggaaaaccccccgggtaaaaccccgggggtacccccccgttaaacgggtttaccccccggggtttccccccgtttttaaccccccccccgggttcggggtcccccccgggtcccccccgtttaccccgggg

SEQ ID NO: 22442 - DNA, 738 bp, Homo sapiens
  misc_feature: GYAE6OF01D8ZZS.12.40.D07.1.454.CMB.1.raw
  modified_base (236)..(236): a, c, t, g, unknown or other
  misc_feature (236)..(236): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggactttcccttcaatttctattccatgcactgggtccnccaggctccaggcaaggggctcgagtgggtgcacttattgcacatgatggcgtacaaactaaattcctaacgactaaaagtttcccggtagggaacggggggccctaactttccgaacccaattccctacccaaggtaacgaactaaaacttaacaaaacgtaaccctaacccttttaatctacgactaaaatacgacacgtccctagaacgaaccaaggaaccgaacaccgggtcttacgtactaatttagttacggcgacggtaagaaggacgtaaccaaccaaccgtaacctacgtacggaacctaaagtacgtagggtacggggtctttcgggttaccggtcggggacccgtagggggtacccctgggtacctaacgttcccgttaccccgtaccccgtaccgtacccctacccggaacccggtaaaccggggcccccttaacggttccccggtttaccccttaccccccggtcgggtaccccgtccccggttaccgg

SEQ ID NO: 22443 - DNA, 591 bp, Homo sapiens
  misc_feature: GYAE6OF01CJJ64.12.40.D07.1.454.CMB.1.raw
  modified_base (240)..(240): a, c, t, g, unknown or other
  misc_feature (240)..(240): n is a, c, g, or t
  modified_base (463)..(463): a, c, t, g, unknown or other
  misc_feature (463)..(463): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggacttttcccttcaattttctattccatgcactgggtcccnccaggctccaggcgaaggggctcggagtggggtggcacttattgcacatgatggcgtacaaactaaattcacgcaaattccgtggacggggccatttccacctatcctaccagagaactaattaacaaacgaacctaaccctttatcctagacaaaatagacagcctagacgaccagacgacacggctgtctattatgcgcgagagacgacacgacacctacncgacaatactagtggggtcttggtcgtcggggaccgaggggaccctgggtcacgtccgtccctcccgcgccctaccacccgaacggccctacgtcccggttcccttcccccgtcggcccgtcccgtcg

SEQ ID NO: 22444 - DNA, 605 bp, Homo sapiens
  misc_feature: GYAE6OF01AWDMY.12.40.D07.1.454.CMB.1.raw
  modified_base (150)..(150): a, c, t, g, unknown or other
  misc_feature (150)..(150): n is a, c, g, or t
  modified_base (235)..(235): a, c, t, g, unknown or other
  misc_feature (235)..(235): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccgtggtccagcctgggcggtccctgacactcgcctgtgttgcctctggatttccctcaattttctattccatgcactgggtccnccaggcctccaggcaaggggctcgagtgggtgcacttatgcacatgatggctcaacaagttcacgcaaattccgtgacggggccattcaccatcctcagagacaattaacaagaactaccctttactnacaaatagacagccngaacgaccagaccgacgacggctgtactattagttcggcgacgagagacgacacaaccgaacctacgacgacaagtacgtagtcggggtcttcggttcggtacggggaccgtacggggtacccgtggtaccgtacgttccgtcccgtaccccgtacgtcccctaccgacccgaccgggacccgtacgttcccggtacccgttcccccggtcggtccccgtcccgtcg

SEQ ID NO: 22445 - DNA, 687 bp, Homo sapiens
  misc_feature: GYAE6OF01BIKP0.12.40.D07.1.454.CMB.1.raw
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagccgtgggcggtccctgacactcgcctgtgttgcctctggtactttccctctaattttctattccatgccacgtcgggtccgccgaggcctccgagggcgaagggggctcggaggtggggtggcactttatgcacatgatggcgtacaactaaattctacgactaaacgtttccggaggacggggccctattccacctatcctaccaggacgactaaattacaaacgaactaccctttanctagaactaaaagtcgaacngtaccctagaacgaccaaggaccgaaccgacggtcttacgttacttatttagttggcgacgagacgacgacaacaaccgtaacctacgtcggacctaaacgtacgtaaggtcggggtctttacgggttaccggtcgggggtaccacggggtaccctgggtcctacgtaccgtcccgtaccccgcgtacccctacccgaccgtaaccgggtcccctaacggttccccggttaccccttcccccggtcggtccccgtcccgtcccggg

SEQ ID NO: 22446 - DNA, 783 bp, Homo sapiens
  misc_feature: GYAE6OF01B3CYF.12.40.D07.1.454.CMB.1.raw
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (431)..(431): a, c, t, g, unknown or other
  misc_feature (431)..(431): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcgaggggcaccgtgggtggaggtcgtggggggagccgtggtccagccgtgggccggtccctgacactcgcctgtgttgcctcgtggtactttcccttntaatttctattccatcgctacgtcgggtcccncacggcctccgaggccgaaggggctcggaggtgggtgctacttatgacacagtgagtcggactaacaaacctaaattccaaccgactaaacgtttcccgggaggacggggaccctattacccacctactcctaccgaggaacgtaactaaattaccgaaacgtaaccttaccctttaanctacgaactaaagtacgactacgtaccgtagaactaccgaagaccgaaccgacggtcttagtacttaagttacgttcggaccgtaacggaaggaacgaacgaaccaaccgtaaacccgtaaccgttacgtacggtaactaaacttacgggttagggttacggggttccgtttacgggttaccgggtaccggggtacccggtaaccggggttacccgtacgggttactaccggttacccggtacccgtaccccggtaccgtaccccgtaaccccgaacccggaacccggtccccgtaccggtttaccccggttaccccgttccccccggttcggccccggtccccgtacccgg

SEQ ID NO: 22447 - DNA, 802 bp, Homo sapiens
  misc_feature: GYAE6OF01ED8VT.12.40.D07.1.454.CMB.1.raw
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtcgtggggggagccggtggtccagccgtgggcggtccctgacactcgcctgtgttgcctctggtactttcccttctaatttctattccatgctacgtcgggtcccgccaggcctccgaggacgaaggggctcggaggtggggtgctacttatacactatgatggctacaaactaaattcctacgactaaagttccggtaggacgggggtccctattacccgaacctactacctaccgaagaacgactaaaattaaccaaacgtaaacctaccctttatacctagaactaaagtacgaactacgcctaaggacgaaccgaacggaaccgtacgacgtctagttaccttaattacgttgaccggacgaaggacgaacgaaccaaccgtaaccgaacccttacgtaccggaaccctaaagttaccggtaagggtttccgggggttaccttttcgggttaccggggtacgggggtaccccggtaacggggggttaccccttaggggttacctaaccggttccccggtttaccccaccccccggtaccgtaccccccgttaaccccgaaccccgggttaaacccggggcccccttaacccggttcccccgggttcccccgtttacccccccggtacggggcccccttcccccggttcggtacccccg

SEQ ID NO: 22448 - DNA, 778 bp, Homo sapiens
  misc_feature: GYAE6OF01DEFFL.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccggtggtccagcctgggcggtccctgacactcgcctgtgttgcctctggtactttcccttctaattttctattcccattgccacgtcgggtcccgccaggcctccgagggccgaaggggctcggaggtgggtggcacttatgcacatgatggcgtacaaactaattctaacgacaaactttccggtaggacggggccgtattcaacctatcctaccagaacgaactaattaacaagtaaaccctaccgtttaatcgtacgtaactaaaagtacgaaccaggtccctagaaccgaccgaacggaaccgaaccgaaccggtcttacggttacctttaattcgtttacggacggacgtaaaggacgaacgaaccgaacccaacccgtaaacccttaccgacggtacctaaacttacggtacgggttacgggtcgttttacggggtaccggtacgggggtacccaacccgggggttaccgtacggttacctaaccgggtcccgtttccctaaccccccggtacgggttaccccctaccccgggtaaccccggaaacccggtccccttacccgggttaccccgttccccccgtttacccccggtccgggtcccccgtccccggttacccgg

SEQ ID NO: 22449 - DNA, 778 bp, Homo sapiens
  misc_feature: GYAE6OF01ALK80.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtgggggagccgtggtccagcctgggccggtccctgacactcgcctgtgttgcctctggtacttttcccttctaatttcctattccatcgcacgtcgggtccgccaggcctccgaggcgaaggggctcggaggtggggtgcctacttatgcacatgatggcgtacaactaaagttctacgactaaacttccggtgacgggggcctagtttaccaaccctattaccctacccaggaacgtaacctaaaagtttaaccaaaacggaaaccctaaccccgtttttaaatccgtacggaacctaaaaagtacgaacgtaacgtcccgtagaacggaacccaacggaccgaacccgacgggtacctcggttaccttaatttacgttcggacggtacgaacggtacggaacgaacaaccgtaaccggaaacccttacgtaccggacccaaagttaaccgtaggttacgggggtccttttcgggttaccgggtcggggacccggtaacggggtaccccgtgggtaccgtacgttacccgtccccgtacccccgtacggtcccccttaccgaaccccggtaaccggggtacccctaccggttcccggttaccccttccccccgtcgggccccgtaccccgttcgg

SEQ ID NO: 22450 - DNA, 733 bp, Homo sapiens
  misc_feature: GYAE6OF01D8D97.12.40.D07.1.454.CMB.1.raw
  modified_base (149)..(149): a, c, t, g, unknown or other
  misc_feature (149)..(149): n is a, c, g, or t
  modified_base (197)..(197): a, c, t, g, unknown or other
  misc_feature (197)..(197): n is a, c, g, or t
  modified_base (239)..(239): a, c, t, g, unknown or other
  misc_feature (239)..(239): n is a, c, g, or t
  modified_base (398)..(398): a, c, t, g, unknown or other
  misc_feature (398)..(398): n is a, c, g, or t
tcagatacgacgtacacgaccggtgctcgatttagtgatagagcgtaacacagagggctcaccatggagtttgggctgagctgggtttcctcgttgctcttttaagaggtgtccagtgtcaggggcacctggtggagtcgtgggggganccgtggtccagccgtgggccggtccctgacactcgcctgtgttgcctntggtatttccctctaatttctattccatgctacgtgggtccncctaggctccgaggcgaagggctcggagtggggtgctacttattgcacatcgatcggctacaactaacttctacgactaaacgttccggaggacgggggtccagttccaccattccaccgagtacgaactaacttaacaaacgtaacctacccgtttanacgtcgaacctaaaagtaacgtaccacgtacctaggaacaacccgtagaaccgactacgggtcttacgtacttaattagttggacgtacgaaggtaacgacgtactaaccgaaccggtacccttaacggcgtaacctaaagttacgtaacgggttcggggtacctttacgggtcgggtaacggggtccgggtaaccggggtacccttacgggtctaaccgggttccgtaccccgttcccccgaacgttccccgaacccgtacccgggaaacccgggcccttaacccggttcccggtttccccccttaccccgggttcggccccgttccccggtcg

SEQ ID NO: 22451 - DNA, 818 bp, Homo sapiens
  misc_feature: GYAE6OF01C4EOF.12.40.D07.1.454.CMB.1.raw
  modified_base (153)..(153): a, c, t, g, unknown or other
  misc_feature (153)..(153): n is a, c, g, or t
  modified_base (248)..(248): a, c, t, g, unknown or other
  misc_feature (248)..(248): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtgggtggagtctggggggacnccgtggtccagccgtgggccgtcctgacactccgctgtgtcgcctctggtactttcccttataactttctacttccatgcctacgtcgggtcccnccgaggtcctaccgagggcgaacggggtcctaggagggttggggtcgctaacgtttagtcgccaactagttagaacgttgggtacctaacaaaactaaacgtttaccaaccggtaaacgtaaacgttccggtagggaccgggggtaccctagttaccaaccgtactcccgtaccgaaggaacgtaaaccttaaagttaaccgaaacgtaaacccgtttaacccttttacgtacgttaacgaaacctaaaagacgaaccgtacgtacccgtaaaggaaacccggtaaacccaacggaaacccggtaaccgtaccggttaccgtaagtttaccttaagtttacgtacggtacgacgtaaaggacgacgtaaccacgtaaacccgtactaacgcgtaacaatacggtaggtacgggtcgttagtccgggtacgggacccgtacggggttaccctggtccctaaccgtcccgtacccgtacccgaccgtaccctaacccggaccccggtaaccggtccccgttaacgggtcccccttaccccgttcccccggacggtcccccgtccgttacccg

SEQ ID NO: 22452 - DNA, 592 bp, Homo sapiens
  misc_feature: GYAE6OF01BESXN.12.40.D07.1.454.CMB.1.raw
  modified_base (516)..(516): a, c, t, g, unknown or other
  misc_feature (516)..(516): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtactttcccttcaatttctattccatgcactcgggtccgccaggcctccaggcgaaggggctcggagtgggtggcacttatgcacatgatggctacaacaaattcacgcaaattccgtgacggggccattccaccatctccagagacaattacaagtaacctaccctttatcctagacaaaagtacgacacgccctagaacgaccaaggacgacgacgctgtctattattgcgcgagagagacaacaccgaactacgtacgacaatacgtagtcggggtactttggttcggtcggggccgacggggtaccctggtcncgttccgtcctacccgacgccctaccgacccgaacggccctacgtcccggtcccttccccgcggcccgcccgtccg

SEQ ID NO: 22453 - DNA, 675 bp, Homo sapiens
  misc_feature: GYAE6OF01CPLNO.12.40.D07.1.454.CMB.1.raw
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcaccgtggtggagtcgtgggggagccgtggtccagcctgggcgtccctgacactcgcctgtgttgcctctggtactttcccttctaattttctattccatcgcacgtgggtcccgccaggcctcgaggcgaaggggctcggaggtgggngacacgttatgcanatganggcgtacaataattcacgtctaaagttccgtaggacgggcctagttcaccgtattcctaccgaagacgaacaagtttaaccgaaaacgtacccttaaaccctttaatcgtaacgaactaaaatacgaacgtacggcccttaggaacgaccgaagaccgacaacggtctaggtacttattgtcgcgacgaagagacgaccaacgaccgaacccgtacgcggaacctaaagtacgtaaggtggggttactttcggttcggcggggtacccgaacggggtcctgggtcctacgtccgtacccgtccccgacgtccctacccgtaacccggaaccggtccctaccgttccggttaccccttcccgccggcccgtcccgtcccg

SEQ ID NO: 22454 - DNA, 616 bp, Homo sapiens
  misc_feature: GYAE6OF01CU4JL.12.40.D07.1.454.CMB.1.raw
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
  modified_base (393)..(393): a, c, t, g, unknown or other
  misc_feature (393)..(393): n is a, c, g, or t
  modified_base (542)..(542): a, c, t, g, unknown or other
  misc_feature (542)..(542): n is a, c, g, or t
  modified_base (601)..(601): a, c, t, g, unknown or other
  misc_feature (601)..(601): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtctggggggagccgtggtccagcctgggcggtccctgacactcgcctgtgttgcctctggtacttttcccttnaattttctattccatgcactgggtcccncaggcctccgaggcgaaggggctcgagtgggtgcacttatgcanatgatggctacaaactaattctaacgctaaatttccggaggacggggtccaatttccgacctattcctaccgaagacgaactaaattacaaacgacctaaccctttancgtagacaaaagtcgaacagtcctagaacgaccctaagacgacacggctagtctattactgcgacgaagagacgaacaccaacgaacctacgcgacctaaagtacgtagtacggggtctttggtcgtcgggcgacggggtcctggtacncgtccgtcctccccgagtcccctaccgaccgacggtcccctagtcccgtaccttccccngggccctcccgtcgg

SEQ ID NO: 22455 - DNA, 654 bp, Homo sapiens
  misc_feature: GYAE6OF01BLHFI.12.40.D07.1.454.CMB.1.raw
  modified_base (381)..(381): a, c, t, g, unknown or other
  misc_feature (381)..(381): n is a, c, g, or t
tcagatacgacgtacacgaccggtgctcgatttagtgatagagcgtaacaacagagggctcaccatggattttgggctgagctgggttttcctcgttgctcttttaagaggtgtccagtgtcaggggcacctggtggagtctggggggagccgtggtcaagcctgggcggtccctgacactcgcctgtgttgcctctggatttcccttctaatttctattccatgcacgtgggtccgccaggcctccaggcgaaggggctcgaggtgggtggctacttattgcacatgatggcgtacaaactaaattctacgacaaattccgtggacggggccgattccaccatcctccagagacaattaacaaagtaacctaccctttanctacgactaaatacgacacgacctagaacgaccgaacgacacgacggctcgttctaattagttcgcgacgaacgagacgaacaacaaccgtaacctacgtacggacctaacgttacgtaggtcgggggttctttcggttcggtcggggacccgtaacggggtaccccgtagggtcctacggttcccgtcccgtacccgacgtccctacccgacccggaaccggtccccgtacgttcccggttccccttacccccggcggtccccgccccgtcg

SEQ ID NO: 22456 - DNA, 639 bp, Homo sapiens
  misc_feature: GYAE6OF01CJJQO.12.40.D07.1.454.CMB.1.raw
  modified_base (393)..(393): a, c, t, g, unknown or other
  misc_feature (393)..(393): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtatttcccttcaatttctattccatgcactgggtccgccaggctccaggcaaggggctcgagtgggtggcacttattgcacatgatggcgtacaaacaaatttcctacgactaaaacgtttccggtaggacggggccgtaacttccaccgtaatcctccgaagacgaacaaattaacaagtaacctaccctttanctagactaaatacgacagcctgaacgaccagacgacacggctgtactattatcgcgcgagagagacacacgaacctactacgacaatactaggtggggtacttggttccgtcggggaccgtacggggtacccgtggtacctacgttccgtacccgtaccccgacgtccccgtacccgaacccgaaccgggcccctaacgttacccggttcccttacccccggtcggccccgtcccgtcgtaccccg

SEQ ID NO: 22457 - DNA, 1038 bp, Homo sapiens
  misc_feature: GYAE6OF01DGKPC.12.40.D07.1.454.CMB.1.raw
  modified_base (112)..(112): a, c, t, g, unknown or other
  misc_feature (112)..(112): n is a, c, g, or t
  modified_base (158)..(158): a, c, t, g, unknown or other
  misc_feature (158)..(158): n is a, c, g, or t
  modified_base (269)..(269): a, c, t, g, unknown or other
  misc_feature (269)..(269): n is a, c, g, or t
tcagatacgacgtacacgaccggtgctcgatttagtgatagagcgtaacaacagaggactcaccatgggagtttgggctgagcttgggttttcctcgttgcttcttttaagnggtgtccagtgtcgaggggcaccgtgggtggagtcgtggggggacnccggtggtccagccgtggggccggtccctgaccacgtcgccttgttgttcgcctcgtggtactttttcccctataacttttcacttccagtcgacctacgtcggggtcccncgagggcctaccggaggaccgaagggggtccttggagggtcggggtcgaccttaacgtttgttacggacctaactagtcggtacggttcgggtacctaaaccaaaaacgttaaactttccgtaaaccgtaaaccgttaaaaccggttttcccggggaacgggggtaccgggggtaccccttaaactttcccgaaaccttaacgttcccgtaaccgaaaacgggtaacgtaaaaaccgttaaaacttttaaaccgaaaaaccggttaaccctttaaacccctttaattacccgttaaacgggaaaccctaaaaaggttaaacccggaaccgtaacggtcccccggtaaaggaaaccccggaaacccgtaaacggaaacccggtaccggtaaaccgggttaccgtttaccggtttaacgtttaaacgtttacggttacgggtacccggtaacggaaacggtaacggaaaccgaaaccgtaaaccccggtaaacccggtaaacccgttacccgggtaaccggaacccttaaacggtaaccggttaagggtttccggggggttacgttttaccggggtttcccgggggaccgggggtaaccccgggtaaccggggttcccggttaacgggtacccttacggttaccccggttcccctacccccggtacgtccccgtaaaccccggtaacccggaaccccgggttaccccgttaacggttccccgggtttaccccctacccccgggttcgggtcccccgttcccgtaacccggg

SEQ ID NO: 22458 - DNA, 785 bp, Homo sapiens
  misc_feature: GYAE6OF01BNQNW.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctctggactttccctctaatttctattccatgcacgtgggtcccgcaggcctccgaggcgaagggctcggaggtggggtgcctacttattgcaacagtgagtcggaccgtacaaacgtaaattctaaccgacttaaaacgttccggtaggacgggggccctatttccgaaccgtacttcctaaccgaagaacgtaaactaaacttaaccgaaaggtaaccctaaccctttaagtacctaaggaaacctaaaagttacgaacctacgtaccctaggaaaccgaaaccgacggaacccgaacgtaacggtccgttacgttacgttaacgtttaacgttacgacggtaccgtaaagaacggaacgaaccctaaccgaaacccgtaaacccgtacgtacggtaccctaaagttacccgtaagggttccgggggtacctttacgggttcccggttacgggggacccgttaacgggggtaccccttagggcctaaccggttcccgttcccgtaccccgtacggtcccctacgggaacccggacgtaccccaaccccggtacgacggtaaccgacgtaccggtaccgggtaccccggg

SEQ ID NO: 22459 - DNA, 197 bp, Homo sapiens
  misc_feature: GYAE6OF01ERB3S.12.40.D07.1.454.CMB.1.raw
  modified_base (189)..(189): a, c, t, g, unknown or other
  misc_feature (189)..(189): n is a, c, g, or t
  modified_base (195)..(197): a, c, t, g, unknown or other
  misc_feature (195)..(197): n is a, c, g, or t
tcagatacgacgtacacgaccggtgctcgatttagtgatagagcgtaacaacagaggactcaccatggagtttgggctgagctgggttttcctcgttgctccaggagcacctccgagagcacagcggccctagggctgcctgggtcaaggactacttcctacgtcgtatctgagcgggctggcaaggcncatagnnn

SEQ ID NO: 22460 - DNA, 672 bp, Homo sapiens
  misc_feature: GYAE6OF01BVYCD.12.40.D07.1.454.CMB.1.raw
  modified_base (150)..(150): a, c, t, g, unknown or other
  misc_feature (150)..(150): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccgtggtccagcctgggcggtccctgacactcgcctgtgttgcctctggatttccctnaatttctattccatgcactgggtccncaggctccaggcaaggggctcgagtgggtgcacttatgcacatgatggctacaaactaattcacgacaaattccggtaggacgggggcctattccacctatcctccaaggagaactaattaacaaagaacctaccctttatcctgaactaaatacgaacacgtcctagaacgaccagacgacgacggtctgtactattattggccgacgaggaagacgaccaaccgaaccgtaacctacgtacggaccctaaagtacgtaggtggggtcctttgggttaccggtcggggacccgacggggtacccctgggtaccgtacgtccgttaccccgtccccgacggtcccccgtacccgaaaccccggaaccgggtcccccgtaacggttccccgggttccccctttaccccccgggcgggtccccgtcccccgttacccggg

SEQ ID NO: 22461 - DNA, 591 bp, Homo sapiens
  misc_feature: GYAE6OF01B1V2Y.12.40.D07.1.454.CMB.1.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (574)..(574): a, c, t, g, unknown or other
  misc_feature (574)..(574): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcgtccctgacactcgcctgtgttgcctctggactttcccttnaattttctattccatgcacgtgggtcccnccaggcctccaggcgaaggggctcggaggtgggtggcacttattgcacatgatggcgtcaaactaaattctacgcaaaattccgtgacggggccattcacatctccaganacaattacaagacacctttanctagacaaatgacagcctaganaccagacgacgacgctagtctattagtgcgngagaganacacacgaacctacgtcgacctaatactagtggggtcttggtcggtcgggaccgtaggggacccgtaggtccagttcccgtcctaccccgagtccccgtacccgacccgaacgggcccctacggttccggtcccttacccccgnggccccgtcccgtccgg

SEQ ID NO: 22462 - DNA, 680 bp, Homo sapiens
  misc_feature: GYAE6OF01E1UOQ.12.40.D07.1.454.CMB.1.raw
  modified_base (362)..(362): a, c, t, g, unknown or other
  misc_feature (362)..(362): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagatacgacgtacacgaccggtgctcgatttagtgatagagcgtaacaacagaggactcaccatggagtttgggctgagcttgggttttcctcgttgcttcttttaagaggtgtccagtgtcaggggcaccgtggtggagtcgtgggggagccgtggtccacgccgtgggcggtccctgacactcgcttgtcgttcgcctctggtactttcccttactaattttcttattccatcgctaccgtcgggtccgccaggcctaccgagggacgaacggggtctcggaggttggggtcgtacctacttattcgacactagtgagtcggacgtaacaaactaattcgtaccgactaacgttcggnggacgggcctactccacacttcgtacagtaacgactaacgtaacaacgtaaccttacctttanctanaacaagtacgacacgtcgagaacgacgacgaacgacgacgtctagtttactatttacggtagacgtaacggaagacgaaccgtacaaccgtacccgtaaccgtactaccggaacctaaggtaccgtgggtacgggttcttcggggtcggtacgggaccgtaccgggtctagtccgtacttccgtcccaccgtccgacctacccgacggaccgtcccgtagttccccttccgtccccggcgcgtccctacgg

SEQ ID NO: 22463 - DNA, 804 bp, Homo sapiens
  misc_feature: GYAE6OF01DTCZJ.12.40.D07.1.454.CMB.1.raw
  modified_base (110)..(110): a, c, t, g, unknown or other
  misc_feature (110)..(110): n is a, c, g, or t
  modified_base (292)..(292): a, c, t, g, unknown or other
  misc_feature (292)..(292): n is a, c, g, or t
tcagatacgacgtacacgaccggtgctcgatttagtgatagagcgtaacaacagagggctcaccatggagtttgggctgagctgggttttcctcgttgctcttttaaggnggtgtcagtgtcgagggcaccgtggtggagtcggtgggggacgccggtgtccagccgtgggccggtcctgacactcgcctgtgttcgcctctggtactttcctctaatttctattccatgcacgtcgggtccgccaggcctccgaggcgaacggggctcgaggtggtaggctacttatgcanatgatggcgtacaaataaacttcacgactaaacgttccggtaggacggggcctattccgaacctatccgtaccaaggacgaactaaattaacgaaacgtaacccttacctttaatcgtacgaactaaaactagacgacgtaccgtagaacgaacccgaagtaaccgaaccgaccgggtactttacggtaactttaagtttacgttcggaccgaaggaagacggaacgaaccggaaccaaccggtaacctacggtaccgaaccgtaaagttaacgttacggggtacggggttccgtttacgggttaaccgggtcgggggtaaccccggtaacggggttacccccgttggggttacccctaacggtttcccggtaccccgttacccccggtaacgttaccccccggttaacccaacccgggttaaaccccggggccccttaaccgggtttcccccgggtttaaccccgttttcccccccgggaacggggtcccccgttccccgggttaacccgg

SEQ ID NO: 22464 - DNA, 671 bp, Homo sapiens
  misc_feature: GYAE6OF01CE47O.12.40.D07.1.454.CMB.1.raw
  modified_base (242)..(242): a, c, t, g, unknown or other
  misc_feature (242)..(242): n is a, c, g, or t
  modified_base (353)..(353): a, c, t, g, unknown or other
  misc_feature (353)..(353): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtactttcccttctaattttctattccatcgcacgtgggtccnccgaggctaccgaggcgaagggggctcggaggtggggtgctacttattgcacatgatggctacaaacaattctacgctaaagttccggtaggacggggcctattcaacctntcctccaagacgaactaaattaacaaagtaacctaccctttatactagaactaaatagacagcctagaacgaccaaggacgacgacggtctagtcttaattatgcgagagagacgacaaccacgaacctacgtcgaactaagtacgtaggtcggggtctttacggtcggtacgggccggtaacggggtcccgttggtccgtacgttccgtcccgtaccccgtacgccccgtaccccaaccggtacccggggacccctacggtttcccggttacccccgtttccccccggtcgggccccgtccccgttcggtacccccg

SEQ ID NO: 22465 - DNA, 667 bp, Homo sapiens
  misc_feature: GYAE6OF01E5IZQ.12.40.D07.1.454.CMB.1.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (402)..(402): a, c, t, g, unknown or other
  misc_feature (402)..(402): n is a, c, g, or t
  modified_base (631)..(631): a, c, t, g, unknown or other
  misc_feature (631)..(631): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctntggtactttcccttnaatttctattccatcgcacgtgggtccgccgaggcctccgaggcgaaggggctcggaggtgggtgctactattgcacatgagtggcgtacaaactaaacttcaacgactaagttccgtaggacggggcctacttccaaccacttctaccgaagaacgtaactaaattacgaaacgaaaccttccctttaanactgaactaaaagtcggtaacacgtacagtacgaaccgtagaccgacgacggtcttacgtattacgttatggaccgtcgaagaagacgtacaccgaacgtacccgtaacgtgaccctaaagtacgtacgggttacggggtcctttgggtaccgggttcgggaccgaccggggtacccgtgtaccgtccgtccgcccctccgaccgtcctacccgacgaccgggtccccncgttcccggttccctccccgtcggcccgtccctcgg

SEQ ID NO: 22466 - DNA, 576 bp, Homo sapiens
  misc_feature: GYAE6OF01AS2H4.12.40.D07.1.454.CMB.1.raw
  modified_base (312)..(312): a, c, t, g, unknown or other
  misc_feature (312)..(312): n is a, c, g, or t
  modified_base (359)..(359): a, c, t, g, unknown or other
  misc_feature (359)..(359): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
  modified_base (490)..(490): a, c, t, g, unknown or other
  misc_feature (490)..(490): n is a, c, g, or t
  modified_base (558)..(558): a, c, t, g, unknown or other
  misc_feature (558)..(558): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggattttcccttcaattttctattccatgcactgggtccgccaggctccaggcaaggggctcggagtgggtgcacttatgcacatgatggctcaacaaattcacgcaaattccgngagggccattcaccatctccagagacaattacaagaaccacctttanctagcaaatcgacagcctagacgaccagaccgacacggntgtctattatgcgngagagagacacacgacctacnggaccaatacgtagtagggggtcttagttcgtcggggccgtacggggacctggtccngttccgcccgtccccgacgtccctacccgaaccaccggggcccacgtcccggttaccttaccccccgngggtcccgcccgttccgg

SEQ ID NO: 22467 - DNA, 877 bp, Homo sapiens
  misc_feature: GYAE6OF01EO4N4.12.40.D07.1.454.CMB.1.raw
tcagatacgacgtacacgaccggtgctcgatttagtgatagagcgtaaacaacagagggctcaccatggagtttgggctgagctgggttttcctcgttgctcttttaagaggtgtccagtgtcaggggcacctggtggagtcgtgggggagccggtggtccagcctgggccgtcctgacactcgctgtgttgcctctggtactttccctctaatttctattccatcgcacgtgggtccgccaggcctaccgaggaccgaacgggggctcgggaggttcggggtgtacctacgtttattcgcaacataggatcgggtaccgtaactaaaacgtaaacttttccgaacgaacctaaaacgtttcccgggttagggaaccgggggtcccgtaatttacccaacccgtacgttaccctacccgaaagaactaaaccgtaaatttaaaccgaaacgtaaacccttacccgtttaatccgtaacgaactaaaatacgactaggccctaggaccgaacgacgaccgaacgtacggtaccttacgttacgttaattacgtttacggacggtacggaaggaacgaacggaacccgtaaccgaaacccgtaaacccgttaccggtacccggttaacctaaacgtttaacggttaacgggttacggggggttaccgtttacgggtttcccgggttcgggggtacccggtacgggggtaccccgttagggtaccccgtaacgttccccggtccccgttacccccggaaccggtcccccttaaccccggtaaccccggaaaccccggggtccccgttaaaccccgggttccccggtttaccccccggtttcccccccggttcgggtcccccggttaccccggtaccccgg

SEQ ID NO: 22468 - DNA, 875 bp, Homo sapiens
  misc_feature: GYAE6OF01AO2PF.12.40.D07.1.454.CMB.1.raw
  modified_base (516)..(516): a, c, t, g, unknown or other
  misc_feature (516)..(516): n is a, c, g, or t
tcagatacgacgtacacgaccggtgctcgatttagtgatagagcgtaacaacaggagggctcaccatggagtttgggctgagcgtggtttcctcgttgctcttttaagaggtgtccagtgtcgaggggcacctggtggagtcgtgggggcgccgtggtcaggcctgggcggtcctgacactcgcctgttgttcgcctcgtggtactttccctctaattttcattccaatcgccgtacgttcgggtccgccgaggtcctccgaacgggccggaacgggggtccttacgggaggtggggtcggactacctttagtgaccacgtgtgacgttcgggacttaacaaaacttaacgttaccgtaccgtacttaaaaccggttccgggtaacgggacccggggtccgtaaccttacccgacctacttccaccgtaagaacccgtaagtaaacgttaaccaaaccggtaaaccctttacccgttttaacgacgtaacgtaacgtaaaacgttccggtaaaccnccggttaaccctaggaaaccgtaaacccgaacggtaaccggtaaccgtaccggttaccgttacgttaccgttaacgtttagttacccggacgtacggaacgaaacggtaacgaaccgaaccggttaacccgtaaccgttaaccgacgggttaacctaaacggtttaacggtacgggttccgggttacgtttaacggggtcccggacggggttacccggtaaccgggtcccgtacggtacgtaccggttcccgtaccccgtacccggtacccgtcccgtaacccggaccccggtacggaccccccgttacgggttccccgttaccccggtccccggtaccggtccccgtcgggtcccccg

SEQ ID NO: 22469 - DNA, 618 bp, Homo sapiens
  misc_feature: GYAE6OF01CB9PZ.12.40.D07.1.454.CMB.1.raw
  modified_base (395)..(395): a, c, t, g, unknown or other
  misc_feature (395)..(395): n is a, c, g, or t
  modified_base (453)..(453): a, c, t, g, unknown or other
  misc_feature (453)..(453): n is a, c, g, or t
  modified_base (477)..(477): a, c, t, g, unknown or other
  misc_feature (477)..(477): n is a, c, g, or t
  modified_base (509)..(509): a, c, t, g, unknown or other
  misc_feature (509)..(509): n is a, c, g, or t
  modified_base (535)..(535): a, c, t, g, unknown or other
  misc_feature (535)..(535): n is a, c, g, or t
  modified_base (611)..(611): a, c, t, g, unknown or other
  misc_feature (611)..(611): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtactttcccttctaattttctattcccatgcacgtgggtccgccaggctccgaggcgaagggggctcggaggtggggtggctacttattgcacatgatggcgtacaaactaattcacgactaaacgttccggtggacggggccagtttccacctatctccaagagaactaaattacaaacgtaacctaccctttanctagacaaatagacacgtcagacgaccagacgacgacgcttgtacttattactgacgngagacgagaacacgaacgacctcncgacaacgtacgtaggtgggtcttggttcggngggaccgacggggtaccctggtaccngtcccgtaccgtccccgacgtcccgtacccaccggaccggcccctacgtcccggttcccttaccccgcgggtcccncccgtcg

SEQ ID NO: 22470 - DNA, 587 bp, Homo sapiens
  misc_feature: GYAE6OF01ADES4.12.40.D07.1.454.CMB.1.raw
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttccctntaatttctattccatgcactgggtccnccaggctccaggcaaggggctcggagtgggtgcacttatgcacatgatggcgtcaacaattcacgcaaattccgtggacggggccattccacctatctcagagacaattacaagaacctacctttanctanacaaatgacncgcctagacgaccagaccgacacggtctgtactattatggcgacggagagacgaaccacaaccgaacctacgtcggacctaatacgtaggtggggtcttcggttcggtacgggccggaacgggtccgtcggtcctacgtccgtcccacccgacgtccctaccgaccgacggccctacgtcccgttcccttccccgcggtccgcccgtccgg

SEQ ID NO: 22471 - DNA, 753 bp, Homo sapiens
  misc_feature: GYAE6OF01CS7CU.12.40.D07.1.454.CMB.1.raw
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtctggggggagccgtggtccagcctggggcggtccctgacactcgcctgtgttgcctctggtacttttcccttctaattttctattccatgctacgtggggtcccgccaggcctccgaggcgaagggggctcggaggtggggtgctactttatgcacatgagtggcgtacaaactaattcacgacaaacgtttcgtggacggggtccattccaccatctaccgagaacgaactaattaaccaacgaaccttacccctttaatcgtagaacctaaaagtacgacctaagccctaaggaaccgaaccgtaacggaaccgacgtaaccgggtcttacgttacctttaattacgttacggaccggtaacggaaggacgaacggaaccctaacccgaaaccgtaacccgttactaacgggtacccaaacgttacgttaacgggtcgggggttacgttttacgggttaccggtcggggggacccgtaacgggggtaccccgttagggttacctcgttacccggtcccttcccccgaaccgtcccctaacccgaaccccgtaacgggcccctaaccgttcccggttaccccctcccccggtacggccccgtcccgtccgg

SEQ ID NO: 22472 - DNA, 784 bp, Homo sapiens
  misc_feature: GYAE6OF01ADNQ1.12.40.D07.1.454.CMB.1.raw
  modified_base (152)..(152): a, c, t, g, unknown or other
  misc_feature (152)..(152): n is a, c, g, or t
  modified_base (239)..(239): a, c, t, g, unknown or other
  misc_feature (239)..(239): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtggtggagtcgtgggggganccgtggtccagccgtgggccgtccctgacactcgctgtgtgcctgtgtactttccctataatttctattccatgcacgtcgggtccnccgaggctccgagggcgaagggggtctcggagggtggtcgactaacgtttagtcggactacgtagtggagttcggacgttacaaactaatttccaacgactaaacgtttccggaggtacggggaccctattccaaccgtacttcccgtaccgaagaacgaccttaaaattaacccgaaagtaaccctacccttttagactgaacctaaatcgaacgtacgaccgtaggaaccgaaccgaggtaaccgaccgtacggtcttacgttacttaattcgttacggccgtaacggaaggtaacgacggtaaccaacccgtaacggtaaccctacggtacggacctaaacgttacgtagggttccggggtactttacgggttcgggaccggggtaccgtaccggggtacccttgggtaccctacgttacccggtccccgtaccgtacccggtaccccgtacccggaaccccggtaaccggggtaccccttccgggtttaccccgggttacccccttacccccgggtccgggtcccccgtcccggtacccgg

SEQ ID NO: 22473 - DNA, 810 bp, Homo sapiens
  misc_feature: GYAE6OF01DO1KN.12.40.D07.1.454.CMB.1.raw
  modified_base (151)..(151): a, c, t, g, unknown or other
  misc_feature (151)..(151): n is a, c, g, or t
  modified_base (215)..(215): a, c, t, g, unknown or other
  misc_feature (215)..(215): n is a, c, g, or t
  modified_base (444)..(444): a, c, t, g, unknown or other
  misc_feature (444)..(444): n is a, c, g, or t
  modified_base (466)..(466): a, c, t, g, unknown or other
  misc_feature (466)..(466): n is a, c, g, or t
  modified_base (544)..(544): a, c, t, g, unknown or other
  misc_feature (544)..(544): n is a, c, g, or t
tcagatacgacgtacacgaccggtgctcgatttagtgatagagcgtaacaacgagagggctcaccatggagtttgggctgagcgtgggtttcctcgttgctcttttaagaggtgtccagtgtcaggggcaccgtggtgagtcgtggggganccggtggtccagccgtgggccgtccctgacactcgcctgtgttcgcctctggtactttccctanaatttctacttccatcgcacgtcgggtcccgactaggcctccgaggaccgaaggggccttacggaggtcgggtcgacttacgtttagtcgacactagtgacttgggacctacaaactaacgttcaacgtactaacgttccggtaggaacggggtccctacttacaacccgtacttcctaaccgaaggaaacctactaaaacgttacgaaacctacccttaccgttttanacacgaactaaaatcggtaacncggtaccctagaaccgtacgaacggccctaaggtcgtacgttacgttacgttactttaacggtcgacccgagggttanaaaccgggtacaaacccgttacgaaacccgtaaacccgttaggtaaccgttaacctaacccggttaagtcgggggttaaccgggttaacttcccgggttacggggtaaccgggggccccttaaacggggtcccctaacgggttaccaacgttcccccgggtaccctttaacccccggccgtacccgttaaccccggaccccgggtaagtacccccgtcggttacccggtttccccccgtcccgaccgggtaccctccccgttcggg

SEQ ID NO: 22474 - DNA, 726 bp, Homo sapiens
  misc_feature: GYAE6OF01BWLS7.12.40.D07.1.454.CMB.1.raw
  modified_base (247)..(247): a, c, t, g, unknown or other
  misc_feature (247)..(247): n is a, c, g, or t
tcagatacgacgtacacgaccggtgctcgatttagtgatagagcgtaaacaacagaggactcaccatggagtttgggctgagcttgggttttcctcgttgctcttttaagaggtgtccagtgtcaggggcaccgtggtggagtcgtggggggagccgtggtccagccgtgggcggtccctgacactcgcctgtgttgcctctggtactttcccttctaatttctattccatgctacgtcgggtcccnccgaggcctccgaggccgaaggggctcggaggtggggtgctacttatcgcacatgatcggcgtacaaactaaacttcaacgactaaagttccggtaggacggggcctaagttccaccacttcctaccgaagaacgtaactaaatttaaccaaagaacccttaaccccgtttatcgtaagactaaaattacgaccaacgtccgtagaacgaaccaagaccgacgacggtactgtacttattacttgacgtacgaaggacgacgaccaacgaccgtaaactaccgtacggaccaaacgttacgtacgggttaggggtacctttcgggttccgggtacggggtacccgtacgggggtacccttcgggtactaccggttacccgtaccccgtccccgacggtccccctaacccgaacccggaaccgggtaccctaccgggttcccgtccccgttacccccggtcggccccgtccccgtaccgg

SEQ ID NO: 22475 - DNA, 729 bp, Homo sapiens
  misc_feature: GYAE6OF01EM7T4.12.40.D07.1.454.CMB.1.raw
  modified_base (149)..(149): a, c, t, g, unknown or other
  misc_feature (149)..(149): n is a, c, g, or t
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcgtccctgacactcgcctgtgttgcctctggatttcccttnaatttctattccatgcactgggtccnccaggctccaggcaagggctcgagtggtgcacttatgcacatgatggcgtacaactaattcctaacgctaaagttcccggtggacgggggccctatttccgaccctagttcctaccaaggtacgaacgtaattaaccgaaagtaaacctacccctttatcctagaccaaaagttacgaacaggtaccctagaacgtaacccaaggacccgaccgtacggacttcgtacttaatttacgttggacgacgtaaggacgacgaacctaccgaaccggtaaccctacgtacggaccctaaacgttaacgtaggttacgggggtacctttacgggttaccggttacgggggacccgtaacgggggtaccccttggggtacctaacgttcccgggtacccttccccccgaaggtcccccttacccgaaacccgtaaccggggtcccctacggtttaccccggtcccctttaccccccggtgggtcccccgtcccgttaccgg

SEQ ID NO: 22476 - DNA, 819 bp, Homo sapiens
  misc_feature: GYAE6OF01CWJYG.12.40.D07.1.454.CMB.1.raw
tcagatacgacgtacacgaccggtgctcgatttagtgatagagcgtaacaacagagggctcaccatggagtttgggctgagctgggttttcctcgttgcttctttttaagaggtgtccagtgtcaggggcacctggtggagtcgtggggggagccgtggtccagcctgggcggtccctgacactcgcctgtgttgcctctggtattttcccttctaattttctattccatgcactgggtccgccaggcctccgaaggcgaaggggtctcggaggtggggtgctaactttagtgaccaacatgagttcggacgtaccaaaactaaactttcctaacggactaaaacgttttcccggtggaacgggggtcccaatttccaaccattaccctaccaaaggacgtaaacctaaaacgttaaacaaacgtaaacccttaacccttttaatcctaacgaacaaaaattagaaccacgccctaaggaacaacccaaggtaaccgaaccgtaaccgggacttacggttacttaagtttaacgttggaccgacggaaaggaacggaacaaacccgaccaaaccgtaaacctaaccgttacggaaccctaaagttaccgttaaagggttcggggttacgtttacggggtttaccggtcgggggaacccgtaacgggggtaccctacgggtacctaacgttacccggttcccctacccccggaagttcccccgttaacccggaaacccccggtaaaccggggacccccctaggtttaccccgggttaccccctttaccccccgggccggtccccggtcccccgttacccg

SEQ ID NO: 22477 - DNA, 692 bp, Homo sapiens
  misc_feature: GYAE6OF01DK34D.12.40.D07.1.454.CMB.1.raw
  modified_base (246)..(246): a, c, t, g, unknown or other
  misc_feature (246)..(246): n is a, c, g, or t
  modified_base (329)..(329): a, c, t, g, unknown or other
  misc_feature (329)..(329): n is a, c, g, or t
  modified_base (390)..(390): a, c, t, g, unknown or other
  misc_feature (390)..(390): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcagggggcacctgggtggagtcgtggggggagccgtggtccagcctgggcggtccctgacactcgcctgtgttgcctctggtacttttcccttcaatttctacttccatcgcacgtggggtcccnccaggcctccgaggcgaaggggctcgaggtggggtgctacttatgcacatgatggctacaacaattcacgactaaattccggnggacggggccattccacctatcctccaagacaactaattaacaagtaacctacccttttanacctgaactaaaagtcgaacacgcctagaacgacccagaccgacgacggtctcgttactattacgtgacgacgaggacgacgacaaccgaacgtaaccctacgtacggacctaaagtacgtaggtcgggggtactttcggttcggtcggggtaccgaacgggggtaccctgggtccctaacggttcccgttcccgtacccccgtacgacccccgttaacccgaaccccggtaaccggggtccccctacggttcccccgggttacccccttcccccggtaccgggcccccgtccccgtcccgg

SEQ ID NO: 22478 - DNA, 632 bp, Homo sapiens
  misc_feature: GYAE6OF01CV2FD.12.40.D07.1.454.CMB.1.raw
  modified_base (210)..(210): a, c, t, g, unknown or other
  misc_feature (210)..(210): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggatttcccttnaattttctattccatgcacgtgggtccgccaggctccaggcaaggggctcggagtggggtgcactttatgcacatgatggcgtacaaacaaattctaacgacaaattccggtgagggccgattcacatcnccagagacaattacaaacgaactaccctttancctagtacaaatagacagcctagacgaccagacgtaccacggtctgtactattacgttgacgcgtaagagtagacacaacgaacctacgtcgactaagtaacgtagtcggggtacttcggttcgtaccggggtcacgggggtaccctggtacctacgtccgttaccaccccgacggtccccaccgtaacccgaaccggggacccctaacggttcccgggttacccctttcccccggtacggtccccggtccccgttccgg

SEQ ID NO: 22479 - DNA, 684 bp, Homo sapiens
  misc_feature: GYAE6OF01EZR2F.12.40.D07.1.454.CMB.1.raw
  modified_base (410)..(410): a, c, t, g, unknown or other
  misc_feature (410)..(410): n is a, c, g, or t
  modified_base (463)..(463): a, c, t, g, unknown or other
  misc_feature (463)..(463): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccggtggtccagccgtgggcggtccctgacactcgcctgtgttgcctctgtactttccctctaatttctattccatgcacgtcggggtcccgccaggcctccgagggcgaaggggctcggaggtggggtgcacttatgcacatgatggcgtacaaacaaattccaacgactaaagtttccggtggacggggcctagttccaacctattcctaccgaagaacgtaacaaatttaaccgaaacgtaaaccttccctttaanccttaagacaaaatacgactagtccctaggaacgaccaagacgacgacgtctntactattagtcgacgcgagacgtagacaacaccgaaacctcgacgacctaagtacgtagggtcggggtctttcggtaccggtcggggtaccgtacggggtacccgttgtacgtccgttaccgtcccaccccgtacgtcccgtaaccccgaaccgggaacccgtccccgtaacggtttccccggttacccccttcccccgacgggtcccctccccggtccgg

SEQ ID NO: 22480 - DNA, 654 bp, Homo sapiens
  misc_feature: GYAE6OF01CBIQA.12.40.D07.1.454.CMB.1.raw
  modified_base (212)..(212): a, c, t, g, unknown or other
  misc_feature (212)..(212): n is a, c, g, or t
  modified_base (432)..(432): a, c, t, g, unknown or other
  misc_feature (432)..(432): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctgtggtactttcccttntaattttctattccatgcacgtcgggtccgccaggcctaccgaggccgtaagggggcttcggaggtggggtggctacgtttattggaccatagtgaagtcggaccgtactaaactaaatttcgtaaccgactaaacgtttcccggtaggacggggtccctaattccaacctaactccgtaccaagacgaactaaattaacaaacgtaacctaccgtttancgtagacaaaagtcgacagcctagacacaaggacacacgctagtacttattgtgacgagaagagacgacaaccgaaccgaacctacgacgacctaatacgtagtcggggtacttggtcggtacgggcgtacgggtcctaggtctacgtccgtaccctacccgcgaccctccgacccgacggcccctacgtcccgttcccgtccccgtcggcccgtccgtccg

SEQ ID NO: 22481 - DNA, 748 bp, Homo sapiens
  misc_feature: GYAE6OF01C15D0.12.40.D07.1.454.CMB.1.raw
  modified_base (195)..(195): a, c, t, g, unknown or other
  misc_feature (195)..(195): n is a, c, g, or t
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
  modified_base (338)..(338): a, c, t, g, unknown or other
  misc_feature (338)..(338): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcgaggggcacctggtggagtcgtgggggagccgtggtccagcctggggccgtccctgacactcgcctggggtnttgcctctggtacttttccctnaattttctattccatgcacgtgggtcccnccaggcctccgaggcgaaggggctcggaggtggggtgctactttatcgcactatgatggcgtacaaactaaattcaacgactaaattccggnggacggggcctattccacatctaccaaggacaactaattaacaaagtaacctacccttttanacgtanaacaaaatcgaaccagcctagaacgacctaaggaccgaacgacggtctacgttacttaagtttacgtcgacggtacgaaggacgaacgaaccgaaaccgaacccgtaaaccgttacgtaccggaaccctaaagttaacgtaacggtacgggggttacttttagggttacccggtacgggggtacccgtaacggggtacccgtacgggttaccgtacgtcccggttacccgtacccccgaccggtaccccgttaaccccgaacccggtaacccggggaccccctaacggttcccccggttaccccgtttaccccccgtccgggtccccgtcccccgttaccgg

SEQ ID NO: 22482 - DNA, 658 bp, Homo sapiens
  misc_feature: GYAE6OF01BSR56.12.40.D07.1.454.CMB.1.raw
  modified_base (493)..(493): a, c, t, g, unknown or other
  misc_feature (493)..(493): n is a, c, g, or t
tcagatacgacgtacacgaccggtgctcgatttagtgatagagcgtaaacaacagagggctcaccatggagtttgggctgagcttgggttttcctcgttgctcttttaagaggtgtccagtgtcaggggcacctggtggagtcgtggggggagccgtggtccagccgtgggccggtccctgacactcgcctgtgttgcctctggtactttcccttctaatttctattccatgcacgtcgggtcccgccaggcctcccgaggccgaagggggctcggaggtgggtggactacttattggccacatgatcggcgtacaaactaaattcctaacgactaaagttccggtggacggggcctattccacctatcacagacgtaacaattaacaaacgtaacctacctttatctacgaactaaatacgacacgcgtagacgacagacgacgacgtctgtactagttatcgcgacgagagacgacacgaccgaactacgngaccagtacgtggtacgggtcttaggtcggtacgggccgtacgggacccttggtcctacgtccgtacccgccccgacgtccccgaacccgaaccgggacccgggtccccctaacggttccccggttcccccgttacccccggtccggccccgtccccggtaccgg

SEQ ID NO: 22483 - DNA, 749 bp, Homo sapiens
  misc_feature: GYAE6OF01A4GFU.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtactttcccttctaatttctattccatgcacgtgggtccgccaggcctccgaggcgaaggggctcggaggtggggtgctacttattgcacatgatggctacaactaattctaacgactaaacgttccggtaggacggggcctattaccacccgtattcctacccgaagaacgaactaaattaacaaacgtaacctaacccctttatactagaaccaaaagttacgaactacgacccgtagaaccgaacccgtaggaaccgtacgaccgggtaccttacggttacttaagtttacgttacggacgacggtaacggaagaacgtaaccaaccgtaacccgtaaaccctaacgtaccggtaaccctaaacgttaccggtaagggttacggggggtaccgttttacgggttccggtacggggggtaccccgtaacgggggtaccccgttgggtacccgtacgttcccgtacccgttaccccgacgtcccctacccgaacccggaccggtccctacgttcccggttaccccttccccggcggcccgtcccgtcg

SEQ ID NO: 22484 - DNA, 619 bp, Homo sapiens
  misc_feature: GYAE6OF01C9EG8.12.40.D07.1.454.CMB.1.raw
  modified_base (242)..(242): a, c, t, g, unknown or other
  misc_feature (242)..(242): n is a, c, g, or t
  modified_base (358)..(358): a, c, t, g, unknown or other
  misc_feature (358)..(358): n is a, c, g, or t
  modified_base (575)..(575): a, c, t, g, unknown or other
  misc_feature (575)..(575): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagccgtgggcggtccctgacactcgcctgtgttgcctctggtactttcccttcaattttcctattccatgcactgggtccnccaggctccgaggcaaggggctcggaggtgggtgctacttatgcacagtgacgtggctacaaacaattcaacgactaaagttccggtagacggggcctatcaccagtctacagtanaactaatacaagaacctactatcagacaaatgacagtccagacgacaagtacgacgacgacctgtacttattacgtgaccgtacgagagacacgaacacgaacctacacggaccaatacgtagtcggggtacttcggtagtacggggaccgtacggggaccctgggtcacgtccgtcctacccgacgtccctaacccgacccggtaaccggaccccncggttacccggtcccctttaccccgcgggtcccctccgtcccgg

SEQ ID NO: 22485 - DNA, 603 bp, Homo sapiens
  misc_feature: GYAE6OF01AUZFK.12.40.D07.1.454.CMB.1.raw
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcggagtgggtggcacttatgcacatgatggcgtacaacaaattcacgctaaattccgtaggacggggccattccaccatctcaganacaattacaagaacctacctttanctgacaaatacgacagcctagacgaccagacgacacggctgtactattatgcgcgagagacgacacacgacctacgacgaccaatacgtaagtggggtactttggttcgtcggggaccgtacgggggtaccccgttggtaccgacgttccggtcctaccccgtacgtccccgtacccgacccgaaccgggcccctacgtcccgggtcccttacccccgtcgggcccgtccccgtccgg

SEQ ID NO: 22486 - DNA, 830 bp, Homo sapiens
  misc_feature: GYAE6OF01D6S1P.12.40.D07.1.454.CMB.1.raw
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcccgtgggcgtccctgacactcgcctgtgttgcctctggtactttcccttnaatttctattccatgcacgtgggtcccnccaggctccgaggcgaaggggctcggaggtcggggtggctactttagttgctacatggatggacgtcaaaactaattcctaacgctaaacgtttccggtagggtacggggaccctatttccgaacctacttccgtacccgaaggtaacgtaacctaaattaaaccaaacgtaacccttaaccccttttaagcctaggaaaccctaaaagtacgaaccgacggtacccgtagaacggaacccgaaacggaaccgaaacccggtacgggtccttacggttaaccttaagtttacgtttacgaccgggacggtaaaggaacggaagaacccgtaaaccgaaacccggtaaacccgttaaccggtacgggaaccctaaacgttacgttaacggggtaccgggggttaccgtttacgggttaccgggtacgggggtaccccgggaacggggtccccgttacgggttaccgtacgtacccggttcccttaccccggcccgttacccctaccccgggtaacccgaacccgggtcccctaccggttccccggtttaccccttaccccccgggtcgggtccccggtcccgtacccggg

SEQ ID NO: 22487 - DNA, 985 bp, Homo sapiens
  misc_feature: GYAE6OF01DSO0L.12.40.D07.1.454.CMB.1.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggccgtccctgacactcgctgtgttgcctntggtattttccctntaactttctattccatcgcacgttcggggtcccgaccagggccttaccgagggaccgtaagggggcccttcggaggttggggtcgactaacgtttattcggctaaccgtagtcggtaagtcggtaccgtaacctaaaactaaaacgtttcccttaaaccgggaacctttaaaaaccggttttcccgggtaacgggtaaccgggggggtaccccttaaacgttttcccgaaacccttacttacccgttaccccgaaaagggtaaccggtaaaaccctaaaaacgttttaaacccggaaaaacgtaaacccttaaccccccgttttttaaactacccgtttaaccggaaaccgtaaaaaacgttaaccggtaaaccgaaacggtacccccgttaagggaaccggtaaaaccccgaaacggtaaaccgggaaccgtaacccggggtactttaccgggttacctttaaagttttaaaccggttcgaacccgggtaacgggaaacgttaacggggtaaccaaacccgtaaaccgtaacccgggttaaacccttaaccgggtaccgaacccgttaaaacgttaacgttacgggttaacgggggtttctttaaccggggtttaccgggtacccggggtaccgaaccgggggttaccccgttggttaccgaccgttcccggttaccccttacccgacccgtaccgttacccggaaaccccgggtaaacggccccctggttacccccggttccccttcccccggtcggtccccgtcctacccggg

SEQ ID NO: 22488 - DNA, 697 bp, Homo sapiens
  misc_feature: GYAE6OF01BLJ6K.12.40.D07.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (398)..(398): a, c, t, g, unknown or other
  misc_feature (398)..(398): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcaggggcacctggtggagtcgtgggggagccgtggtccagccgtgggcgtcccgtgacactcgcctgtgttgcctntggactttccctnaatttctattccatcgcacgtcgggtccgccaggcctccgaggcgaaggggctcggaggtgggtgctacttatcgcacatgagtggactacaaactaaattcaacgctaaacgttccggaggacggggcctattccaccgtactcctaccagacgaacaattaaccaaagtaacctaccctttaanctagaacaaaagtacgacagtacctaggaacaccaggaccgacgacgcgtactctatagtcgacgacgagagacgacacgacgtaacctacgtacgacgtaactacgtacggtacgggtcgttaaaaaaacggttcggtacgggtaccggtacggggtacccggtacggtaccgtacgttaccgttacccgtaccccgtacccggtacccgtacccgtaacccgtaaccggtaccccgtacccgttacccggttaccccgttaccccccggttcccgggtccccggtccccgtacccgg

SEQ ID NO: 22489 - DNA, 1122 bp, Homo sapiens
  misc_feature: GYAE6OF01CWW7V.12.40.D07.1.454.CMB.1.raw
tcagatacgacgtacacgaccggtgctcgatttagtgatagagcgtaacaacagagggctcaccatggagtttgggctgagctgggtttcctcgttgctcttttaagaggtgtccagtgtccaggggcaccgtggtggagtcgtggggggactccggtggtcccaggtcccgtgggggccggtcccctaggacctaccgtccgcccttggtcgttcgcccttcgtcgggtaactttttccccgttactaaaagttttcctaactttcccgaattcggcctacggttcgggggttacccccgaccgtaacgggcccttccccggaaggggtaccgtaaaacggggggtccttccgggaagggttggggggtcgaccttaaccgtttaacgttcggacctaaccgtaagttcggtaaggttccggggtaaccggtaacccaaaacgttaaaccgtttccccgtaaccgaaccgttaaaaccgggtttccccggtagggggtaaaccgggggtacccctaacgtttacccgaaacccgttacgttcccctaaccccggaagggtaaacgtaaaccgtaaaaccgtttaaacccgaaacggttaaacccctttaaccccgttttaaacttccgtaaacggaaccctaaaaagttaccggaaacccgttaaccggaccgttaacgggaaaaccggtaaaccccgtaacggaacccggtacccgtaacccgggttcctttacgggttaacctttaagttttaaacgttcgggtaacggtccggaaagggttaaccggaaccgaacccgtaaacccggttaaaaccccggtaaaccccgttaaccggttaacccgggaacccttaaaccggttaaccggttaacgggtttaccggggggtaccctttttaggggttcccgggtacgggggtacccccggttaaccggggggtacccgttacggggttaccctaaccggttccccggtaccccgttacccccggtaacccggttcccccgttaaaccccccggtacccgggtaaaccccgggccccgttaaccccgggttttaccccgggttcccccgttacccccccggttccgggtcccccggtcccccgttcccggg

SEQ ID NO: 22490 - DNA, 676 bp, Homo sapiens
  misc_feature: GYAE6OF01D1BPA.12.40.D07.1.454.CMB.1.raw
  modified_base (245)..(245): a, c, t, g, unknown or other
  misc_feature (245)..(245): n is a, c, g, or t
  modified_base (364)..(364): a, c, t, g, unknown or other
  misc_feature (364)..(364): n is a, c, g, or t
  modified_base (389)..(389): a, c, t, g, unknown or other
  misc_feature (389)..(389): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcgaggggcacctggtggagtcgtgggggagccgtggtccagccgtgggccgtccctgacactcgcctgtgttgcctctggtactttcccttcaattttctattccatcgcacgtcgggtcccnccaggcctccgaggccgaaggggcctcggaggtgggtcggctacgttatgacacatgatggactacaaactaattctacgactaaattccggtggacgggctattcaccatctacaganaactaatacaagtaacctccgttanctagaactaaatagacacgactgaacaccgaagacgacacgtctgtactagttagtcgacgacgagacgagaaccacgaaccgtaaccttacggacggtaacctaagtaaccgtagggtcggggtctttcggtacggtccggggacgtaaccgggtcccttagggacctacgttcccggtaccctaccccgtcggtacccctaacccgaaacccgggtaaccggccccgttaacgttcccccggttaccccgttaccccccggtcgggtccccgccccgttacccgg

SEQ ID NO: 22491 - DNA, 611 bp, Homo sapiens
  misc_feature: GYAE6OF01AXYKF.12.40.D07.1.454.CMB.1.raw
  modified_base (236)..(236): a, c, t, g, unknown or other
  misc_feature (236)..(236): n is a, c, g, or t
  modified_base (367)..(367): a, c, t, g, unknown or other
  misc_feature (367)..(367): n is a, c, g, or t
tcagatacgacgtacacgaccggtgctcgatttagtgatagagcgtaacaacgagaggactcaccatggagtttgggctgagctgggttttcctcgttgctcttttaagaggtgtccagtgtcaggggcacctggtggagtctgggggagccgtggtccagccttgggcggtccctgacactcgcctgtgttgcctctggatttcccttcaatttctattccatgcactgggtccnccaggctccaggcaaggggctcgagtgggtgcacttattgcacatgatggcgtcaacaaattcacgctaaattccgtgacggggccgattccacctatcctccagagacaattacaagaactaccctttanctagactaaatagacagccctagacgaccagtacgacacggctgtctattattgcgacgtagagagacacaccgaacctacgtacggaccaatacgtacgtggggtcttcgttacggtcggggaccgacggggtacccgtggtactacgtccgtccctccccgacgtcccctaccgacccgtaaccggggcccctacgttcccggttacccgttaccccccgtcggtcccggtccccgtaccgg

SEQ ID NO: 22492 - DNA, 842 bp, Homo sapiens
  misc_feature: GYAE6OF01CK4F9.12.40.D07.1.454.CMB.1.raw
  modified_base (301)..(301): a, c, t, g, unknown or other
  misc_feature (301)..(301): n is a, c, g, or t
  modified_base (501)..(501): a, c, t, g, unknown or other
  misc_feature (501)..(501): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgaggggccaccgtgggtggagtcgtggggggacgccgtggtccaggccgtgggggtccggtccctgacctacctcgccttgttgttcgcctcgtggtacttttccctactaactttctattccatcgctacgtcgggtccgcgaggcctcgaggacgaaggggctcggaggtggggngactactttagttgacctaactagtggtaagtcggggccttaaaccaaaagtaaactttaccgtaacgtactaaaaacggtttcccgggtagggtaaccggggggtacctaactttacccgaaaccctattaccccgttaccgaaaggtaacgtaaaccttaaaagttaaaccgaaacgtaaaccccttacccttttaanaccgtaacgaaactaaaacttaacggactacggtaccgaagtaacggaaccaaggacccgtaacgaccggtaccttacgttattaacttgttcgacgtacggaagtaacgacgaacaacgtaaccgtaacttaccgagaacctaacgttacgtagggtacgggtcgtttacgggttcggtacgggggaccgtaaccgggggtaccctcggtaccgtaacgtcccggtacccttaccccggtaccgtccccgtaacccggaacccggtaacccgggtaccccgttacccgggttcccggttacccccttcccccggacgggttcccctaccccggttccggg

SEQ ID NO: 22493 - DNA, 796 bp, Homo sapiens
  misc_feature: GYAE6OF01B6BLP.12.40.D07.1.454.CMB.1.raw
  modified_base (238)..(238): a, c, t, g, unknown or other
  misc_feature (238)..(238): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcactggtggagtcgtggggggagccgtgggtccagcctgggcggtccctgacactcgcctgtgttgccctctggatttcccttctaatttctattccatgcactgggtccnccaggcctccaggcgaagggggcctcggaggtggggtggctacttattgcacatggatcggcgtacaaacaattcctacgtacaaagttcccggtggacgggggcctaattccaccgatcctacgagaacgtaacaaactttaacgaacgtaaaccttaacccctttataccgttaggaacctaaaagttaacgaacgtaacgtcccgtaggaacggaacccggaacggaaccgtaacccggaccgggttaccttacggttacctttaattttaaaggttccggacggtaccgggtaaaggacggaacgaaacgtaacccgaaaccggtaaaccccgtaacgttacccgggaaccttaaacttaaccggttacggttaggggggttcctttagggtttcccgggtacggggggtacccgtaacggggggtaccccttcgggttaacctccggttcccggtaccccgttacccccggtccgtacccgttacccgaacggggtaccgtaccccgacccgttacccgggagtacggaccctaccgggcgggtacccccggg

SEQ ID NO: 22494 - DNA, 683 bp, Homo sapiens
  misc_feature: GYAE6OF01B95M3.12.40.D07.1.454.CMB.1.raw
  modified_base (149)..(149): a, c, t, g, unknown or other
  misc_feature (149)..(149): n is a, c, g, or t
  modified_base (212)..(212): a, c, t, g, unknown or other
  misc_feature (212)..(212): n is a, c, g, or t
  modified_base (401)..(401): a, c, t, g, unknown or other
  misc_feature (401)..(401): n is a, c, g, or t
tcagatacgacgtacacgaccggtgctcgatttagtgatagagcgtaacaacagagggctcaccatggagtttgggctgagcggtggtttcgtcgtaggctctttaagaggtgtcagtgtcaggggcacctggtggagtcgtggggggnccggtggtccagccgtgggcggtccctgacactcgcctgtgttgcctctggtacttttccctnaatttctattccatgcacgtgggtccgccaggcctccgaggcgaggggctcgaggtggggtcgctacttagttcgctaacgatggatggcgtacaactaaattctacgctaaagttccggtgacggggccattccacctatccctcaagacgtaacaaatttaccgaaaactaacctaccccttttaanccgttagaacctaaaagtacggacctaagtcccgtaggacaccgaagaaccgaccgtacggctagtacgttaattacgttaggcgacggagaagacaaccacgaaccgtaacctacgtacggtaaccaagtaccgtaggttacgggtctttaccggttcgggttcgggcgtaaccggggtaccgtcgtacgtacgtcgtccgtcccctacggcccttaacccgaccgaccgggtccctacgtcccggttaccccgttccccgccgggtcccgtccccgtccg

SEQ ID NO: 22495 - DNA, 887 bp, Homo sapiens
  misc_feature: GYAE6OF01B2DDT.12.40.D07.1.454.CMB.1.raw
tcagatacgacgtacacgaccggtgctcgatttagtgatagagcgtaacacagagggctcaccatggagtttgggctgagcttgggttttcctcgttgcttctttttaagaggtgtccagtgtcgaggggcaccgtgggtggagtcgtggggggagccggtggtccagccgtgggccggtccctgaccactcgcctgtgttgcctgtggtactttcccttactaatttctacttccatgctacgtcgggtcccgccgaggcctccgaggacgaaggggctacgggaggttggggtcgactactttagttgaccaacagttggacggttggaccgttaaccgaaacttaaactttaccgtaaccgacttaaaaccgtttcccggggtagggaaccgggggtacccgttactttacccaacccgtacgttcccgtaaccccgaaaggtaaccgtaaacctaaacgttttaaaccgaaaaccgtaaaccccttaccctttttaacgtacgttaacgaaacgtaaaaacttaccggaaacctacggtacccgttaaaggaaccgaacccgaaacggtaaccgaccgaccggttccgttacgttacttacgtttagtcggacgacggaacggacgaacgaaccaaccgaaaccgtaaccgtaccgtacgaaccgtaacgttaacgtacgggttacggggttacgtttacgggttaccgggtaccggggtaccgggtaccggggtacccgttacggtaccgtaccgttccccggtaaccccgttccccggtaccgtacccctaaccccggacccgtaaccccgggtaccccgtaccggtttacccccggtttccccgttaccccccggtccgggtccccgtccccgttcccgg

SEQ ID NO: 22496 - DNA, 756 bp, Homo sapiens
  misc_feature: GYAE6OF01BXN0T.12.40.D07.1.454.CMB.1.raw
  modified_base (224)..(224): a, c, t, g, unknown or other
  misc_feature (224)..(224): n is a, c, g, or t
  modified_base (453)..(453): a, c, t, g, unknown or other
  misc_feature (453)..(453): n is a, c, g, or t
tcagatacgacgtacacgaccggtgctcgatttagtgatagagcgtaacaacagagggctcaccatggagtttgggctgagcttgggttttcctcgttgctcttttaagaggtgtccagtgtcaggggcaccgtgggtggagtcgtggggggacgccggtggtccaggccgtggggccggtccctagacactcgcctgtgttcgcctcgtggtactttcccttntaatttctattccatcgctacgtcgggtcccgaccgaggtcctaccgaggccggaaggggtcctacgggtagggtcgggggtgaccttaactttagttcggacaacgagttaggagtcggacgtaaccaaaacttaaacttccgtaacgaactaaacgttccggtagggacgggtcctattaccacctatcctacgaagactaactaatacaaacgtacctacctttanctacgacaaatacgacacgacgtagaacgaccaagaccgactcggtcttagtaccttagtacgtcggacgacggtaagaacggagaacccaaccgaaccgtaaaccctcgtacggaaacccttaagtaaccggttggggtcggggttaccgttttacgggtccgggtacggggacccgtaacggggtaccccgtgtacccgtccgttccgtccccgtacccgaccgtcccgacccccgtaacggacccgggccccttacgggttccccgttccccgtaccccggcggtccccgtccgtaccgg

SEQ ID NO: 22497 - DNA, 720 bp, Homo sapiens
  misc_feature: GYAE6OF01DXE9R.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagccgtgggcggtccctgacactcgcctgtgttcgcctctggtacttttcccttctaattttctattccatcgcacgtggggtcccgccaggcctccgaggcgaagggggctacggaggtggggtgctacttattgcacagtgatggactacaaactaaattcgtaacgactaaaacgttccggtaggacgggggtcctaattccaacctacttctacccgaaggaacgaaacctaattaacaaacgtaaccctaaccctttatctacgactaaatacgacacggcctaggacgaaccaaggaacgacgacggtctagttacttattactgcggacgagtacgagaccaaccacgaacctacgtacgacctaagttaactaggttcggggtctttacgggttcggtcggggtaccggacggggtcccgttcggtccgttacgtcccgttccctacccccgtacgtacccccgtacccgaaccccggtaaacccgggtcccctaccggttccccggttaccccgttccccccggtaccgggtccccgtaccccggtcccg

SEQ ID NO: 22498 - DNA, 763 bp, Homo sapiens
  misc_feature: GYAE6OF01EEQ83.12.40.D07.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
tcagatacgacgtacacgaccggtgctcgatttagtgatagagcgtaacaacagaggactcaccatggagtttgggctgagcttgggttttccctcgttgcttcttttaagaggtgtccagtgtcaggggcacctggtggagtcgtgggggganccggtggtccagccgtgggccggtccctgacactcgcctgtgttcgcctntggtactttcccttntaattttctacttccatgctacgttgggttccaccgaggcctaccgaggaccgaaggggtctcggaggtggggtgacctactttagtcgactacgataggacgttcgggcctaacaaaactaacgttccgtaacgacttaaaaggtttccccggtaggggaaccggggtccctaactttaccaaccgtacttaccgtacccgaaggaactaacctaaacgttaaaccaaacgtaacccttaacccctttagtaccgtaacgaacctaaaacgtacgaccgtacggtaccctaggaaccaaccggaaacgaccgacgtaacgtcttacgttactagttacgtcgcgacgaagagacgtaccgaaccgacgaaccgtcgtacgactaacgtacgtagggtcggtcgttaggttcggacgggtaccgacgggtaccgtcggacgtcgtccgtcccgtaccgaccgtacccgtaccgaaccccgtacggcccgtaaacccggtttccccgtacccggttccccccggtacggcccccgccgtccccgg

SEQ ID NO: 22499 - DNA, 761 bp, Homo sapiens
  misc_feature: GYAE6OF01D1J5A.12.40.D07.1.454.CMB.1.raw
  modified_base (216)..(216): a, c, t, g, unknown or other
  misc_feature (216)..(216): n is a, c, g, or t
  modified_base (397)..(397): a, c, t, g, unknown or other
  misc_feature (397)..(397): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcaggggcacctggtggagtcgtggggggagccgtggtccagccgtgggcgtccctgacactcgcctgtgttcgcctctggtacttttcccttntaatttctattccatcgctacgtcggggtcccgccgaggcctcccgagggaccgaagggggcctacggagggtggggtcggctaacgtttagttcgacacgatggactggtacgtacaaactaaaatttccgtaacggactaaacgtttccgggtagggacggggtcctaacttccacctntcctacgaagacgaaactaattaacgaaacgtaacccttaccgtttatcttagaactaaagtaacgacacggtactaggaaccgaaccaaggtaaccgaccgacggtacttacgttacttacttagttacggtacggacgaagtaacgacgaacacccgaacctaaccgtaccgtacgtaaccgtaacgttacggtaggtacggggttcgtttagggttaccgggtacgggtaccggtaccgggtacccgtacggttactaccgttcccgtaccccgtccccgtacccgtaccgaccccgtaaccgaaccggtacccgtacccgttccgttacccccgttccccgtccggccctccggtacccg

SEQ ID NO: 22500 - DNA, 905 bp, Homo sapiens
  misc_feature: GYAE6OF01EH25S.12.40.D07.1.454.CMB.1.raw
  modified_base (246)..(246): a, c, t, g, unknown or other
  misc_feature (246)..(246): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggccacctgggtggagtcgtgggggacgccgtggtccagccgtgggccgtccctgacactcgctgtgttcgcctctggtactttccctactaatttctattccatcgcacgtcgggtccnccgaggcctccgaggcgaagggctcggaggtcgggtgctacttagttcgacacgatgtagtcggacgtaacaaactaattaccgtaacgactaaacgttccggtaggacggggtcctacgttaccaacctacttcctaccgaaagacgtaaacctaaacgttaaccgaaacgtaaacccttaaccctttagtacgtacgtaaactaaacgtacgacgtacgtaccgtagaaccgaaccgacgaaccgtaccgtacggtccttacggttacttaacggtttacgttacggaccggtaacggtaagaacggaaccgtaaccgtaaacccggaaaccccgtaaacccgtttacggacccggtaaacctaaacgtttaaccggttcgggggttaccgggggtttaccgttttaccggggttaccgggggtacccgggggtaaccccgggtaaacccgggggttaccccgttacggggtaccgttacccgggttttaccccggtaccccgttaccccccggaaccccttcccccgggttaaacccccggaaacccccgggtaacccccggggttaccccttaccccgggttttccccccgggttaccccccccggtttacccccggggtacccggggtccccccgtaccccggttacccccggg

SEQ ID NO: 22501 - DNA, 791 bp, Homo sapiens
  misc_feature: GYAE6OF01A3S70.12.40.D07.1.454.CMB.1.raw
  modified_base (245)..(245): a, c, t, g, unknown or other
  misc_feature (245)..(245): n is a, c, g, or t
  modified_base (305)..(305): a, c, t, g, unknown or other
  misc_feature (305)..(305): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgagggcaccgtggtggagtcgtgggggagccgtggtccagcctgggcgtccctgacactcgcctgtgttgcctctggtactttcccttacaagttttctaattccagttgcacgtcgggtccnccgaggtcctccgaggccgaaggggctcggaggtgggtcggctacgtttagttgacactntagagtggaccgttacaaactaaattccgaacgtacctaaaagtttcccggagggacgggtacccgtattccaacctagttccctacgaaggataaaccgtaattaacgaaacgtaaccttaccgttttaacctaggaactaaagtacgaactacgtcccgtagaaccgaaccgacggtaacccgacgaacgtcttacgttacttagtttcgtacgcgaacgagaacgtacgaaccgacgaaccgtaaccgtaccgtacgaaccgtaacttaccggtaggttacggggttaccctttgggttaccgggtacgggtacccggttaaccggggtacccgtagggttaccgtaaccgttcccgttaaccccgtaccccgtaaccggtcccccttaacccggaacccggtaacccgggtacccccgttaaccgggttccccggtttaccccgtacccccggttaccgggccccgttaccccggttacccg

SEQ ID NO: 22502 - DNA, 774 bp, Homo sapiens
  misc_feature: GYAE6OF01DEWSF.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcgaggggcacctgggtggaggtcgtggggggagccgtggtccagccgtgggcggtccctgacactcgcctgtgttcgcctctggtactttcccttcaattttctattccatcgcacgtcggggtcccgccgaggcctccgaggcgaacgggggctacggaggtggggtggacctacgttattgcacatgatggcctacaaacaacttctacgtactaaacgttccggtaggacgggggtacctacttaccgacacttccgtacccaaggacggaaactaacttaacgaaaacgtaccttaacccttttagtctaacgaacaaaataacgacaacgccgtaggaaccgaaccacgacgacgtaacggtctacgttacttagttacgtcggacgagtaggaacgaccgaacaacccgaaccgtaacctaacgtacgggaacctaaagttacggtaagggttcgggggttcctttagggttaccggcggggggtacccggaacggggttacccgttagggtacctaccgttcccggtcccttaccccgaaccggttacccctccccggaaacccgggtacccgggacccccttaccggggttcccccggtttacccccgttacccccggtccggggcccctccccgggttacccgg

SEQ ID NO: 22503 - DNA, 614 bp, Homo sapiens
  misc_feature: GYAE6OF01BS08B.12.40.D07.1.454.CMB.1.raw
  modified_base (462)..(462): a, c, t, g, unknown or other
  misc_feature (462)..(462): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtattttcccttctaatttctattccatgcactgggtccgccaggcctccgagggcgaaggggctcggaggtggggtggctacttattgcacatgatggcgtacaaactaaattcctaacgactaaagttcccggtaggacggggcctattccacctatcctaccgaaggacgaactaattaacaaacgtaacctaccctttatctagacaaatagacagcctagacaccagacgacgacgctgtctattatgcgagagaganacacacgaactcacgacaatacgtagtacgggtcttcggttcgtcggggaccgacgggtaccctggtacctacgtccgtcctccccgacgtccctacccgaccgaccggtcccacgttcccggttcccttcccccgtcggcccgtcccgtcg

SEQ ID NO: 22504 - DNA, 668 bp, Homo sapiens
  misc_feature: GYAE6OF01BKNLZ.12.40.D07.1.454.CMB.1.raw
  modified_base (217)..(217): a, c, t, g, unknown or other
  misc_feature (217)..(217): n is a, c, g, or t
  modified_base (307)..(307): a, c, t, g, unknown or other
  misc_feature (307)..(307): n is a, c, g, or t
tcagatacgacgtacacgaccggtgctcgatttagtgatagagcgtaacaacagagggctcaccatggagtttgggctgagcttgggttttcctcgttgctcttttaagaggtgtccagtgtcgaggggcacctggtggagtcgtggggggagccgtggtccagccgtgggccggtccctgacactcgcctggtgttgcctctggtactttcccttntaatttctattccatgcacgtcgggtccgccaggcctccgagggccgaagggggctcggaggttggggcgctactttagttcgcacatgntggctacaaactaattcacgtactaaagttccggtaggacggggtccattccgacctatctccagacgaacaattacaacgtaactaccctttatctagactaaatagacacgctagacgacgagacgacgacgtctgtactattgtgcgtacgagacgagaccacgacgtaacctagtacgactaagtacgtacggtacgggtcttcggttacgacgggtaccggtacgggtacccgtggtacctacgttcccggtacccgtccccgacgtaccccgtacccgaaaccggtacccgggtacccctaacggttcccccggttccccgtttacccccggcggttccccgtcccgttacccgg

SEQ ID NO: 22505 - DNA, 289 bp, Homo sapiens
  misc_feature: GYAE6OF01EXYIF.12.40.D07.1.454.CMB.1.raw
  modified_base (147)..(147): a, c, t, g, unknown or other
  misc_feature (147)..(147): n is a, c, g, or t
  modified_base (241)..(289): a, c, t, g, unknown or other
  misc_feature (241)..(289): n is a, c, g, or t
tcagatacgacgtacacgaccggtgctcgatttagtgatagagcgtaacaacagaggactcaccatggagtttgggctgagctgggtttttccctcgttgctccgaggagccacctccgagagcacacgccggcccgtcgggtctcnggccctagggtaccaaaggtaccctaaccgtttcccgttaacgttccgttactcgtcgggacggtcgggcgtaggacgacggacgtacgatagnnnnnnnnnnnnnnnnnnnnnnnnnnnnnnnnnnnnnnnnnnnnnnnnn

SEQ ID NO: 22506 - DNA, 628 bp, Homo sapiens
  misc_feature: GYAE6OF01EQSVL.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtacttttcccttcaattttctatttccatgctactggggtccgccaggcctccaggcaaggggctcggaggtgggtggcacttattgcacatgatggcgtacaaactaaattctaacgacaaatttcccggtaggacggggcccgtattccaaccatcctccagagaactaattaacaaacgaacctaccctttatctagactaaaatacgacagcctagacgaaccagaccgacacggctgtctattatgcgcgagagagacacaacgaacctacgtcgacaatactagtcggggtcttggtcgtcgggccggacgggaccgtcggtactacgtccgtcctaccccgacgtcccctacccgacccgaaccgggtcccctaacggttcccggttaccccttcccccggtccggtcccgtcccgtcccgg

SEQ ID NO: 22507 - DNA, 909 bp, Homo sapiens
  misc_feature: GYAE6OF01DYCRD.12.40.D07.1.454.CMB.1.raw
  modified_base (250)..(250): a, c, t, g, unknown or other
  misc_feature (250)..(250): n is a, c, g, or t
tcagatacgacgtacacgaccggtgctcgatttagtgatagagcgtaacaacgaggggactcaccatggagtttgggctgagcttgggttttcctcgttgcttcttttaagaggtgtccagtgtcgaggggcaccgtggtggagtcgtgggggagccggtggtccagccgtgggccgtcctgacactcgctgtgttcgcctcgtggtactttccctataatttctacttccatgacctacgtcgggtccnccgaggcctcgaaggcgaaggggtctacggaggtgggtacgctacgtttagtcgcaacgtagtggagttaccgggcttaacaaaactaacgtttccgtaacgaactaaacgtttccgggacggtaacgggggtaccctaatttcccaaccgtacttaccgtaccgaagaacgtaaactaaaacttaaccgaaacgtaaacccctttacccgttttagtactacgaaacgtaaagtaacgacctagtaaccgtaggaaaccgaaccgaacggaaccgaaccgtaacggtcctagttaacgtttaagttacgtaccggggacgtaacggacgaaaacgaccggtaaaccccaaccgtaaaccgtaaaccccgttacgttaaccgaaaccccgttaagttaaccgggtaacggggttccggggtttaacgtttcggggttaccccggggtaacgggggtacccccgggttaaaccggggttaaccccgtgggttaccttaaacccgggttccccgttacccccgttaaaccccggaaccggttcccccccgtaaacggaaccccggtaaaccccggggtcccttacccccgggttttaccccgggttaaccccccgtttcccggaaccccgggttcccgtccccgttccggtaaacccccgg

SEQ ID NO: 22508 - DNA, 714 bp, Homo sapiens
  misc_feature: GYAE6OF01BPUBR.12.40.D07.1.454.CMB.1.raw
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgaggggccaccgtgggtggagtcgtggggggacgccggtgggtccaggccgtggggccggtccctgacactcgcctgtgttcgccttctggtactttccttctaactttctattccatgctacgtcgggtccncaggctccgaggacgaagggctggaggtggtgctacttntgcanatgatggactanaactaaattcgaacactaacgttccggaggacgggtacctattccaccatcctacgaagacgaactaactaacaaagtaaccctaccctttaanctacgaactaaanacgaacacgactacgaacgaacccaggaaccgacgacgtacttgtacttattacgtgaccgagaagtaacgacaaccgaacctaccgaacgtacgacgtaaccctaaagttacggtcggttcgggtactttacgggtacgttcgggacggacccgggtacgggttacccgtaggtaccgttaccgtccccgtacccgtccccgaccgtacccccgtcccgaaaccccgggttaccggaccccgttaccggttcccccggttaccccttcccccgggtcgtcccccgtacccggg

SEQ ID NO: 22509 - DNA, 677 bp, Homo sapiens
  misc_feature: GYAE6OF01A2YGG.12.40.D07.1.454.CMB.1.raw
  modified_base (461)..(461): a, c, t, g, unknown or other
  misc_feature (461)..(461): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccatggtccagcctgggcggtccctgacactcgcctgtgttgcctctggtatttcccttcaatttctattccatgcacgtgggtccgccaggctccgagggcaagggggctcgaggtgggtggcacttattgcacatgatggcgtacaaactaaattcctaacgctaaacgtttcccggtaggacgggggtcccgattccaacccatcctacccaagaacgacctaaattaaccaaacgtaacctaaccccttttatacctgaactaaatacgaacacgctgaacgaccagacgacacggtctgtctattnttcgcgacgagacgagaccacaaccgtaaccctactacggaccaagtaaccgtaggtacgggggtctttcggttccggtggggacccgacgggggtaccctcgggtactaccgtacgtccccgtcccccgacgtcccgtaccccgaacccgaaccggggtccccctacggttcccgggttaccccctttccccccggtcgggtccccgtcccccgg

SEQ ID NO: 22510 - DNA, 721 bp, Homo sapiens
  misc_feature: GYAE6OF01CIHEX.12.40.D07.1.454.CMB.1.raw
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtgggtccagcctggggcggtccctgacactcgcctgtgttgcctctggacttttcccttctaatttctattccatgcacgtcgggtcccnccaggcctccgaggcgaaggggctcggaggtgggtgcacttatgcanatgatggcgtacaaataattcacgactaaattccggtggacggggcctattccaaccatcctaccgaagacgaactaaattaacaaacgtaaccttaaccctttatcctagaactaaaagtacgaaccacgtacctaggaacgtaccgaacggaaccgaccacgggcttgtacttaattagttacggcgacgaaggagacgaacctaaccgaaacgaacccttacgacggaacctaaagtaaccgtaggtacgggggttctttacgggttccggtacgggggacccgtacggggtaccccttgggtaccgtacttcccgggtccctaccccggtaaccgtccccctaacccgaaacccggaccgggtaccccctacggttccccggtttacccccttccccccggtcgggtcccccgtcccggttcccg

SEQ ID NO: 22511 - DNA, 928 bp, Homo sapiens
  misc_feature: GYAE6OF01DC3L7.12.40.D07.1.454.CMB.1.raw
  modified_base (202)..(202): a, c, t, g, unknown or other
  misc_feature (202)..(202): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgaggggcaccgtggtggagtcgtgggggagccgtggtccagccgtgggccggtccctgacactcgctgtgttcgcctntgtactttcccttctaatttctattccatcgctacgtcgggtacccgccacggcctaccgagggtccgaacgggggtcctagggagggttggggtcggaccttacgtttaacttggacctaacgtagttacggtaaggtcggggttacccgtaaaacctaaaaacttaaacgttttaccgtaaccgggtaaaccttaaaaccggtttcccgggttaagggggaaccgggggtaacccgttacctttaccggaaaccctacgtttacctaacccgtaaagggaaccgttaaaacgtaaacctttaaaacgaaaccgttaaaaccctttaccttttaacgacttaacgaaacctaaaagtaccgaaacgtacgtacccgtacgaaacgtaccgaaacggacccggaacgtaccggtactttacgttaccgttaagtttaccggttacggaccgggtaacggtaaacggacggtaaacgaaccgaaaacccgtaaacccgaaaccgttaccggtaacccgtaacgttaaacgttacgggttaacggtttaccgggggtccttttaccggggtcgggtaaccgggggtacccggtacggggtccccgttaggacgtacccgttcccggtaccctaaccccgcggtaccccctaaccggaccccggtaacgggtcccccgttacggttccccggtttaccccctacccggccggttacccgtccccgtacg

SEQ ID NO: 22512 - DNA, 816 bp, Homo sapiens
  misc_feature: GYAE6OF01BIZBX.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggtactttccctctaatttctattccatgcacgtcgggtccgccgaggcctccgaggcgaaggggctcggaggtggggtgactactttagttcgacactagtgtaagtggaccgtacaaactaacttctaacgactaaacgttccggtaggaccggggcctacgttaccaccctaatccctaccgaaggtaacgtaaactaaacgttaaaccgtaaacgtaaacccttaaaccccttttataccgtaccgaaactaaaacgttaacggaacctaacggtccctaacggaacgaacccgaacggaaccgtaaccgtaccggtaccttacggttactttaattacggttacgaccggtacgaacggtaacgaacgtaacccaacgaacccgtaaccctacggtaccgtaacctaaacgtacggttacgggtacggggttcctttacggggttccggtaccgggggacccgggtaacccggggtaccgttacgggtccctaacgttccccggttacccgtaccccgtccgtaccccgtaaccggaaccccgggtaccggtaccccgtacccggttccccggttacccccgttccccgggtccggccccggtccccgttccgg

SEQ ID NO: 22513 - DNA, 675 bp, Homo sapiens
  misc_feature: GYAE6OF01ATK52.12.40.D07.1.454.CMB.1.raw
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtattttcccttcaattttctattccatgcactcggggtccgccaggcctccgaggcgaagggggctcggaggtggggtgcactttatgcacatgatggcgtacaaactaaattcaacgactaaagttcccgtaggacggggtcctattccgaccatcctaccgaagtacgactaattaacaaacgaaacctaccctttatcgtagaccaaagtacgacacgcctagacgaccagacgacgacggtctcgtacttattagttcgacgtacgaaggagagaaccacgtaccgtaaccgtacgtacggacctaatacgttaggtcgggggtactttcggttacggtcggggtaccgacggggtaccctggtcctagttcccggtcctacccccgcgtacccctacccgaacccgaaccgggtcccctacggttccccggttaccccttaccccccggtcgggtccccgtccccgtacccgg

SEQ ID NO: 22514 - DNA, 598 bp, Homo sapiens
  misc_feature: GYAE6OF01AI1YK.12.40.D07.1.454.CMB.1.raw
  modified_base (209)..(209): a, c, t, g, unknown or other
  misc_feature (209)..(209): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttnaatttctattccatgcacgtgggtccgccaggctccaggcaaggggctcggagtggggtggctacttattgcacatgatggcgtacaactaattcacgacaaagttccgtggaggggccgattccacctatcctccagagactaattacaaacgtaaactaccctttatctagaccaaaatcgacagcctagaacgaccagaaccgacgacgtctgtctattatgcgacgagagacgacacgaccgacctacgacgacagtactaggtgggtcttgtcgcgggaccgacgggtacctcggtcgtctccgtccgtaccccgcgtcccgtaccgaccgaaccgggccctaacgtcccggtacccttcccccggtcggcccgtcccgtccgg

SEQ ID NO: 22515 - DNA, 817 bp, Homo sapiens
  misc_feature: GYAE6OF01BY0RR.12.40.D07.1.454.CMB.1.raw
tcagatacgacgtacacgaccggtgctcgatttagtgatagagcgtaacaacagagggctcaccatggagtttgggctgagctgggtttcctcgttgctcttttaagaggtgtccagtgtcaggggcacctggtggagtcgtgggggagccggtggtccagcctgggcggtccctgacactcgcctgtgttgcctctggatttccctcaatttctattccatgcacgtgggtccgccaggcctccgaggcgaagggggctcggaggtggggtgctacttatgcacatgatggacgtacaaacgtaaattccgtacgactaaagtttcccggtaggaacggggggtccctaatttcccgaaccctacttcccgtacccaaagggtaacggtaaacctaaaacgtttaaaccgaaaacggttaaaacccctaacccctttttaacgtaccttacggaaacctaaaaacgttaacggaacctaacgggtaccccttaggaaacccgaacccgaaaggtacccgaaccgacccgggtcgttacgttaccttaagtttagttacggaccggtacggaacggaaggaacgaaccgtaaccaaaccggtaaccccttacgtaccgggacctaaacttacggtaggttacggggggtcttttcgggttacggtcgggggaccccgacgggggtacccgtgggtacctacggttcccgtaccgtaccccccgacggtccccttacccggaaccccgaaaccgggtccccctaaccggttcccgggttcccccttacccccggttcgggcccccgtccccggtccgg

SEQ ID NO: 22516 - DNA, 741 bp, Homo sapiens
  misc_feature: GYAE6OF01EM7GC.12.40.D07.1.454.CMB.1.raw
  modified_base (211)..(211): a, c, t, g, unknown or other
  misc_feature (211)..(211): n is a, c, g, or t
  modified_base (401)..(401): a, c, t, g, unknown or other
  misc_feature (401)..(401): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccggtggtccagcctgggcggtccctgacactcgcctgtgttgcctctggtatttcccttntaatttctattccatcgcacgtcgggtcccgccgaggcctccgaggcgaaggggctcggaggtgggtgctactttatgacacatgagtcggacgtacaaactaattctacgactaaacgttccggtaggacggggcctattccaccatcctaccagacaactaacttaacaacgtaaacctaccctttanccgtagaactaaaagtacgaacgacgtaccgtagaacgtaaccacggaaccgaaccgaccggtcttacgtacttattagttcggacgacgaaggagaacgaaccaacgaacccgtaaccgtacgtacggtaaccctaaagttaacgtgggttacgggggttacctttggggtttacccgggtacgggggaccccggtaacgggggtaccccgttgggtaccgtaccgttcccggtcccctacccggtacccgtaccccgtaccccgaaccggacccgggtacccctaacggttccccggttaccccttacccccggtccgggtccccgttccccgtaccg

SEQ ID NO: 22517 - DNA, 788 bp, Homo sapiens
  misc_feature: GYAE6OF01DQ3PV.12.40.D07.1.454.CMB.1.raw
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtcgtgggggagccgtggtccagcctgggcgtcctgacactcgctgtgttgcctctggtactttccttctaatttctattccatgcacgtcgggtccgccaggctccgaggcgaaggggctcggaggtgggtcgctacttagttgacacgatgagtggcgtacaaacaacttcctacgactaaacgtttccggtaggacgggggtcctattaccacccgtacttccaccgaacgaagaactaaaactttaacgaaaacgtaaaccttacccgttttaatccgtagaacctaaaatacggaacacgtaccgtaggaaccgaaccgaacgaaccgaaccgtaccggtacgtttacgttacgtttaagttaacgttcggaccggtacggaaaggtaaacggaaccgtaaaccgtaacccgtaaacccgtaaacccgttaaccgtaccggtaaaccctaaacgtttaacggttacgggttacgggggttcttttacgggttaccgggtaccggggacccgggtaacggggtccccgttagggtacctaacgttccgtccctacccgaccgtccctaacccggaacccggtaccgggaccccgtacgttaccccggttccccttaccccggtcggccccgtcccgtcggtacccg

SEQ ID NO: 22518 - DNA, 674 bp, Homo sapiens
  misc_feature: GYAE6OF01B357D.12.40.D07.1.454.CMB.1.raw
  modified_base (241)..(241): a, c, t, g, unknown or other
  misc_feature (241)..(241): n is a, c, g, or t
  modified_base (388)..(388): a, c, t, g, unknown or other
  misc_feature (388)..(388): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagcctgggcggtccctgacactcgcctgtgttgcctctggtactttcccttctaatttctattccatgcacgtgggtccnccaggcctccgaggcgaaggggctcggagtgggtgcacttatgcacatgatggctacaacaattctaacgcaaagttccggaggacggggtccatttccacctatcctacgaagacgaactaaattacaaacgtaacctacctttanctagacaaatagacagcctagaagaccaaggacgacgacggctaggtactatttacgtgacgtacgaagaagacgaacaaccgtaaccgaacctacgacggaacctaaacgtacgtaacgggtggggtacctttagggttccggtacgggggtacccgacgggggtacccctggggtacctacgtcccggtacctaccccgacgtaccccgtaccgaacccggaacccgggtcccctacgtcccgggttaccccttcccccggtacgggtccccgtccccgtacgg

SEQ ID NO: 22519 - DNA, 645 bp, Homo sapiens
  misc_feature: GYAE6OF01BQBHO.12.40.D07.1.454.CMB.1.raw
  modified_base (93)..(93): a, c, t, g, unknown or other
  misc_feature (93)..(93): n is a, c, g, or t
  modified_base (109)..(109): a, c, t, g, unknown or other
  misc_feature (109)..(109): n is a, c, g, or t
  modified_base (151)..(151): a, c, t, g, unknown or other
  misc_feature (151)..(151): n is a, c, g, or t
  modified_base (277)..(277): a, c, t, g, unknown or other
  misc_feature (277)..(277): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
  modified_base (400)..(400): a, c, t, g, unknown or other
  misc_feature (400)..(400): n is a, c, g, or t
tcagatacgacgtacacgaccggtgctcgatttagtgatagagcgtaacaacagagggctcaccatggagtttgggctgagctgggttttccncgttgctcttttaagnggtgtccagtgtcaggggcacctgggtggagtctgggggganccgtggtccaggcctgggcgtccggtgacgaccgtacggcctgtagttcgctctgactttccctcaatttcaacttccagtcgctcgtcgggtaccgcaggcctccaaggccaaggggcctacggngtgggacgcattatgcatgtgacgtggacgtaccaaactaattcaacgcaaacgtttcccggagggaggggcccaattccaccnttccggacaggactanaattaccgaanaacctcctttancagacaagtcgacacgtcaggacacgagacgtacgacgtactgtacttagttacgtcgacgacgagacgtacacgaacgtacaactgacgactaagtcgtcggtcggtcttacgggtcggtacgggaccggtacggtaccgtggcctacgtccccgtacccgtacccgccgtacccgtacccgaaccggtacccgcccgttaccgttcccggttcccctaaccccgggtcgcccgtcccgtaacg

SEQ ID NO: 22520 - DNA, 817 bp, Homo sapiens
  misc_feature: GYAE6OF01DJPBS.12.40.D07.1.454.CMB.1.raw
  modified_base (251)..(251): a, c, t, g, unknown or other
  misc_feature (251)..(251): n is a, c, g, or t
  modified_base (504)..(504): a, c, t, g, unknown or other
  misc_feature (504)..(504): n is a, c, g, or t
tcagatacgacgtacacgaccggtgctcgatttagtgatagagcgtaacaacagagggctcaccatggagtttgggctgagcttgggtttttcctcgttgcttcttttaagaggtgtccagtgtcgaggggcacctgggtggagtcgtggggggagccgtggtccagccgtgggcgtccctgacactcgctgtgttcgcctcgtgtacttttcccttctaattttctattccatcgacacgtcgggtcccnccgaggctccgagggcgaagggggcttcggagggttggggtcggctaactttagttcggctaacatggagtggactacaaactaaatttccgaacggactaaaagtttccggtaggacggggtccctaagtttccactactcctaccgaagtacgaacctaaattaacgaagtaaacccttacccttttagaccttgaaacctaaaaatgaaccgtagtacctaggaacaacccgagaaccgacgaaccggtnttacgtcttaattagttaggaccggacgtaaagggacgaacgaaacctaaccgaaacccggtaaccttaaccggtaccggaaccttaaaaggtttaccggttaggttaccggggggttacttttcggggtttaccggccggggggtaccgtaaccggggggtccccttacggggtaccttaccgttaccccggttccccgtacccccgtaagttacccccccgaacgtaaacccccgggaaccggggtcccccttaagggttcccccgtttccccgttaccccccgggtccggccccggtcccggttacccgg

SEQ ID NO: 22521 - DNA, 823 bp, Homo sapiens
  misc_feature: GYAE6OF01DPME8.12.40.D07.1.454.CMB.1.raw
  modified_base (198)..(198): a, c, t, g, unknown or other
  misc_feature (198)..(198): n is a, c, g, or t
tcagatacgacgtacacgaccggtgctcgatttagtgatagagcgtaacaacagagggctcaccatggagtttgggctgagctgggttttcctcgttgcttctttttaagaggtgtccagtgtcagggggcacctggtggagtcgtgggggagccgtggtccagcctgggcggtcctgacactcgcctgtgttgcctntggtatttcccttactaatttctattccatgcacgtcggtccgtcaggcctcgaggcgagggctcggaggtgggtcgcgtacttagttcgacacgatggtagtcggcgtaacaaactaaattccgtaacgtaactaaacgtttcccgggtaggggaccggggtacccgtaactttacccacctaacgttcctaccgaaagggtaactaaaacgtaactttaaaccaaacgtaaaccttacccgttttaatcctaagaactaaagtaacacgacgtccgtagaacgtaaccgaagtaaccgacggtacgtccgttacgttacgtttaacgtttacgtcggacgtacggaaagaggaaccgaactaaccgaaaccgtacgtaaccggtacgtaacccgttaaagttccgttaagggtttcggggttaccgtttacggggttaccggttaccgggggacccgggtaaccgggggtaccccgttacgggttccctacggttcccggttaccccgtccccgtaaccggtccccctaccccggaacccggtaacccgggtaccccgttaccgggttccccgggtttaccccgttacccccgggttcccggtcccccgtcccgttacccggg

SEQ ID NO: 22522 - DNA, 808 bp, Homo sapiens
  misc_feature: GYAE6OF01C6NM2.12.40.D07.1.454.CMB.1.raw
  modified_base (253)..(253): a, c, t, g, unknown or other
  misc_feature (253)..(253): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcgaggggcacctgggtggagtcgtggggggagccgtggtccagccgtgggccggtccctgacactcgcctgtgttcgcctcgtggtacttttcccttctaatttctacttccatgccgactcggggtcccnccaggcctccgaggcgaaggggcctcggaggtggggtggctacgtttattcgacactaagtggtagtcggacgttacaaaacgtaaaatttccaaaccggtactaaaacgttccggaaggacgggggcctaattccaaccacttctacccgaagactaactaaacttaacgaaaacgtaaacccttaacccctttaatccgtaaggtaaacctaaaaagtacgaacgtacgacccgttagggaaaccaaccggaacgaccgaaccgtaccggtacctacgggtttacttaaggtttacgttacgtaccgggtacgaaacggtacggaaccgtaaccgaaccgtaaaccgtaacccgtaacgtaaccggaacctaaacgttacgtacggtacggggttcgtttacggtttcggccggggtacggtacgggtcccgtaggtccgtacgtccgtcccgtaccccgtaccgtccccgtaccgtaaccccggacggtaccccgtacccggttacccggttcccccgttacccccgtccggtccccggtccccgttcccgg

SEQ ID NO: 22523 - DNA, 747 bp, Homo sapiens
  misc_feature: GYAE6OF01AJQ5U.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtgatccagcctgggcggtccctgacactcgcctgtgttcgcctctggtactttcccttctaatttctattccatgcacgtcgggtcccgccaggcctccgagggcgaagggggctcggaggtggggtggctacttattgcacatgagtcggcgtacaaacgtaattccacgactaaattccggtaggacggggcctattccacctagtcctaccagacgaactaattacaaacgtaacctaccctttatctagaactaaatacgaacacgaccgtaggaacgacccaggaaccgacgtacggtcgttacgttacgttaacttacgttcggtacggacggtaaggaacgggtaacgaaccgaaccgtaacccggtaaaccctaccggtacggtaaccctaacgttaaccgttaacgggttacgggggttctttacgggttccgggtacggggtacccggtacggggtacccgttcgggtaccgtaccgttcccgtacccgtaccccgtaccgtccccgtacccgaacccggtaacccgggtccccgtacccggttcccggttaccccgttcccccggtccggcccggtaccccgg

SEQ ID NO: 22524 - DNA, 753 bp, Homo sapiens
  misc_feature: GYAE6OF01BJKF9.12.40.D07.1.454.CMB.1.raw
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggtatttcccttcaatttctattccatgcacgtgggtccgccaggcctccgaggcgaaggggctcggaggtggggtggctacttattgcacatgatggcgtacaaactaaattcaacgactaaacgttcccggtagggacggggcccgtaatttccaacctacgttaccctacccgaaaggaacgtaaacctaaattaaccaaacgtaaacccttacccccgtttttaatccctacgaacctaaaaagtacggaacctacggtacccgtaggaacgaacccgaaggaaccgaccgaccggtcgttagttacttaagtttacgttcggacgtacggaagaacggacgaaccgaaccgaaccgtaaacccgttacgtacggaacctaaacgttaacgttacggttacgggggtcctttacgggttaccggttcggggacccggtaacgggggtacccgtgggtaccgtacgtcccgtccctccccgacgtcccctacccgacccgaaccgggcccgtacgttcccggttcccttcccccggtcggtccccgcccgtccg

SEQ ID NO: 22525 - DNA, 784 bp, Homo sapiens
  misc_feature: GYAE6OF01A6KF4.12.40.D07.1.454.CMB.1.raw
  modified_base (481)..(481): a, c, t, g, unknown or other
  misc_feature (481)..(481): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcgaggggcacctggtggagtcgtgggggagccgtggtccagccgtgggcgtccctgacactcgcctgtgttgcctctggtactttcccttctaattttctacttccatcgcacgtgggtcccgccaggcctccgaggccgaaggggctcggaggtggggtgctacgtttatgccacagttggatcggcgtacaaaactaaagtttcctaaccggtactaaaacgttttccccgggtaggaaacgggggtcccgtaacgtttaccaaccccgtacttcccgtacccgaaggaaacgtaaacctaaaatttaaccgaaaaccgtaaaccttaccccttttatcctaggaacaaagtacgaacncgcctagaacgaaccagacgacgacgcttagtacttattagtgacgacgaagacgaagaaccaacgaaccgtaaccgtacgtacgtaacctaaacttacgtaacggtcgggggttactttaccgggtttccgggaaccggggtcccgggtaacggggttaccccgttagggtaccctacggttcccgtccccgtacccccgtaaccggtccccaaccccggtaacccggaaccgggtccccctaacggtttccccgggttacccccttaccccccggtccggggtccccgtccccggtacccg

SEQ ID NO: 22526 - DNA, 701 bp, Homo sapiens
  misc_feature: GYAE6OF01EFT1K.12.40.D07.1.454.CMB.1.raw
  modified_base (151)..(151): a, c, t, g, unknown or other
  misc_feature (151)..(151): n is a, c, g, or t
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (414)..(414): a, c, t, g, unknown or other
  misc_feature (414)..(414): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtggtggagtctgggggganccgtggtccagcctgggcggtccctgacactcgcctgtgttgcctntggtattttccctnaattttctattccatgcacgtcggggtccnccaggcctccaggcaaggggctcggagttcggggtgcctacttatcgcactatgatggacgtacaaactaaattcctaacgactaaacgttccggtaggaccggggtcctagttaccacctagttcctaccgaagacgaacctaaattaaccaaagtaaacctaccctttaanctacgacaaaagtacgacacggcctagaacgacctacggaccgtaacgacggtctagtacgttaatttacgtaggacgacggaagacgaacgtaaccaacgtaaccgtaaccgtaccgtacgtaaccctaaagttacgtagggtacggggttactttcgggttaccggtacggggcccgtaacggggtacccgttggtacctacgtccgtaccctaccccggacgtacccgtaccgacggtccgaccgtaacccgtcgaacgacgtaccgaaccggtcggacccggg

SEQ ID NO: 22527 - DNA, 769 bp, Homo sapiens
  misc_feature: GYAE6OF01CV18K.12.40.D07.1.454.CMB.1.raw
  modified_base (153)..(153): a, c, t, g, unknown or other
  misc_feature (153)..(153): n is a, c, g, or t
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (272)..(272): a, c, t, g, unknown or other
  misc_feature (272)..(272): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcgaggggcaccgtggtggagtcgtggggganccgtggtccagccgtgggccggtccctgacactcgctgtgtcgcctntgtctttcctntaatttctattccatgcacgtgggtccncgagctccgaggcgaagggctcggaggtggggngctagttatgacacatgatcggctacaactaatcgtaaccgataaacgttccggaggacgggtccgtattaccaccgtactaccgtaccgagacgtaaactaagttaacaaacggtaacccttacctttaagtctacgaaccaaaagttaccggaacacgttaccagggaacgaacccgaacggaacgaccgtacggtacttacggttactttaagtttacgtccgacggtacgaacggtaacgaacgaacccgaaaccgaaccgtaaccgtacggtaacgtaacctaaacgttaacgtacgggttacgggggttactttacgggttaccggtaccggggtaccggtaccggggttacccgtcggttaccgtaccggtaccccgtttacccgaccccgtaacccgtccccgtaaccccgtaccggtaacccgggtacccctaccggttccccggttaccccgttacccccggccggttccccggtcccgtaccccgg

SEQ ID NO: 22528 - DNA, 662 bp, Homo sapiens
  misc_feature: GYAE6OF01C5QFD.12.40.D07.1.454.CMB.1.raw
  modified_base (246)..(246): a, c, t, g, unknown or other
  misc_feature (246)..(246): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (379)..(379): a, c, t, g, unknown or other
  misc_feature (379)..(379): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtgggtggagtcgtggggggagccgtggtccagccgtggggcggtccctgacactcgcctgtgttgcctctggtactttcccttctaatttctattccatgccacgtggggtccnccaggctccgaggcaaggggctcgaggtgggtgcacttatgacacatgatcggctacaaactaatctacgacaaattccgnggacgggctntcacntccncagtacgaactaataacaacgtaacacctttanactacgaactaaaagtagaacacgtcctaaggacgaaccaggaccgacgtacgtacgtgtacttagttactgtacgacgaagacgacgtacacgaaccgaactacgacggtaactaacgtacgtaacggtcggggtactttcgggtaccggtacggggaccgtacggggtacccgtcggtaccgtaacgtccggtccctacccgtacgtacccgtacccgaacccggtacggtacccgtacgtacccggttcccgttaccccggtcggtcccgtcccgtccgg

SEQ ID NO: 22529 - DNA, 1019 bp, Homo sapiens
  misc_feature: GYAE6OF01DRIJ4.12.40.D07.1.454.CMB.1.raw
  modified_base (200)..(200): a, c, t, g, unknown or other
  misc_feature (200)..(200): n is a, c, g, or t
tcagatacgacgtacacgaccggtgctcgatttagtgatagagcgtaacaacaggggactcaccatggagtttggctgagctgggttttcctcgttgcttcttttaagaggtgtccagtgtcgaggggcaccgtggtggagtcgtgggggagccgtggtccagccgtgggccggtcctgacactcgcctgtgttcgcctntggtactttcccttataactttctacttccatcgctacgtcgggtaccgccgagggcctccgagggtaccgaagggggtccttacgggagggttggggtcggtaccttaacgttttacgttcgacacgtaattacggtagttcgggaccgttaaccaaaacgttaaaacgtttcccgtaacggaaccttaaaacggtttccgggtaggggtaaccggggggtccccttaacgtttacccgaacccgttaacggttaccctacccggtaaagggtaaccggttaaacctaaaacgtttaaaccgaaaaccgttaaacccttaacccgtttttaataccggttaacgaaacgttaaaaacgttaacggaaccgtacgttaacccggtacggaaaaccggtacccaaacgggaaaccccgggtaaaccgtaccggggttacccgttaaggtttaacccggtttaagtttaaccggtacggtacccggtacgtaaacgggaaacggtaaccgtaaccgtaaacccgtaaacccggtaaacccgttaccggtaacccggtaaacccgtaaaacgtttaccggttaagggggtttaccgggggttaccgttttaaccggtttccggggtaccgggggtaaacccggtaccggggggttaacccttccgggttaaccgtaccggtttaccccgtaccccgttccccggtaaaccggtccccgtttaaccccggaacccggttaccgggtacccccgttaaccgttccccgggtttaccccgttacccccggtaccggtacccccggtcccccggtggtaccccggg

SEQ ID NO: 22530 - DNA, 609 bp, Homo sapiens
  misc_feature: GYAE6OF01AOAM5.12.40.D07.1.454.CMB.1.raw
  modified_base (211)..(211): a, c, t, g, unknown or other
  misc_feature (211)..(211): n is a, c, g, or t
  modified_base (323)..(323): a, c, t, g, unknown or other
  misc_feature (323)..(323): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctgggtggagtcgtggggggagccgtggtccagcctgggcggtccctgacactcgcctgtgttgcctctggatttccctnaatttctattccatgcacgtgggtccgccaggctccgaggcgaaggggctcggaggtggggtgctacttatgcacatgatggcgtacaactaaattcacgacaaattccggngacggggccattcaccatctccagagacaatacaagacacctttanctgacaaatacganagcctagacgaccagaacgacacggctgtactattatgacgngagagacgacaacgaccgaaacctgtacgactaaactacgtagtggggtcttcggtacggtcgggtcccgacgggaccctgggtaccacggttccgtcccgtacccgtaccgtccctacccgaaccggaacccgggtccccacggttcccggttccccttccccggtcgccccggtcccgtccg

SEQ ID NO: 22531 - DNA, 821 bp, Homo sapiens
  misc_feature: GYAE6OF01C1PFU.12.40.D07.1.454.CMB.1.raw
  modified_base (156)..(156): a, c, t, g, unknown or other
  misc_feature (156)..(156): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgaggggcaccgtgggtggagtcgtgggggganccgtggtccagccgtggggcgtccctgacactcgctgtntgctntgtntttccctntatttctattccancgcacgtcgggtccgccaggtcctccgaggacgaacggggctcggaggtggggcgactactttagtcgacanagtggtatcgggactaacaaactaacttccaacgtaccttaaagttccgggtagggacggggtacctattaccactacgttacctaccaaggacaaactaaattacgaaaaccttaacccttacctttacgtactacggaactaaagtaacgaccgacgtaccgagtaaccggacctaaggaacccggaccgtacgggttacttagttaccgtttaatttaccggttcgggaccgtaacgggaacggtaacggaaccgaaaccctaaccccgaaaccggtaacccccttaaggtacccggtaaccctaaaggtttaccggtaaggggtttccggggttacccgttttggggtaccgggttacggggggaccccgttaaccggggggttcccttacgggtaccgtacccgttccccggtaccccttacccccggcgtacccccgtaaccgaccccgggaccggttaccccgtaccgttcccggtttaccccccgtaccggtcccgggccccgttcccgtaccgg

SEQ ID NO: 22532 - DNA, 742 bp, Homo sapiens
  misc_feature: GYAE6OF01CZMQQ.12.40.D07.1.454.CMB.1.raw
  modified_base (213)..(213): a, c, t, g, unknown or other
  misc_feature (213)..(213): n is a, c, g, or t
  modified_base (434)..(434): a, c, t, g, unknown or other
  misc_feature (434)..(434): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagccgtgggcggtccctgacactcgcctgtgttgcctctggtactttccctntaatttctattccatgcacgtcgggtcccgcaggcctccgaggcgaaggggctcggaggtgggtggctactttgtcgcacagtgagtggaccgtacaaaactaattcctaaactaactaaacgtttcccggtaggacgggggtccctaacttccgaacctactacctacccgaagaacgtaacgtaaattaaccgaaaacgtaaccttaacccgttttaanctacggtaaactaaaacgtacgaactaacgtacctacggaaacgacccgtaacggaccgaacgtaccgggtctacgttacctttaattacgttacggtcgaacggtaagagacgaacaacccgtaaaccgtaccttacgtaccggtactaaacgttgtaggtcggggttactttcgggtacggcgggtacccgtaagggtccctgtacgtacgttccgtaccctacccgtacgtcccgtaacccgaacccgacgggtacccctacggtttccccggtacccttccccggacgccccgttcccgtccgg

SEQ ID NO: 22533 - DNA, 954 bp, Homo sapiens
  misc_feature: GYAE6OF01CVB57.12.40.D07.1.454.CMB.1.raw
  modified_base (242)..(242): a, c, t, g, unknown or other
  misc_feature (242)..(242): n is a, c, g, or t
  modified_base (432)..(432): a, c, t, g, unknown or other
  misc_feature (432)..(432): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagccgtgggcgtccctgacactcgcctgtgttgcctctggtacttttcccttcaattttctattccatgcacgtgggtccnccaggcctccgaggcgaaggggctcggaggtggggtgctacttatgcacatgatcggcgtacaaactaattcctaacgactaaacgtttcccggtaggacgggggccctaatttccaaccctattacccttacccgaaggaacgtaacctaaaagtttaaccaaaacgtaacccttaacccctttttaanaccttacgaactaaaaacttacggaacctaacggtcccgttaaggaaccggtaacccgaaacggtaacccggaaccgtacccggggtacctttacgggtttacctttaaagttttaaggtttccgggaacccggtacgggaaacgggtaacggaaccggtaaacccgtaaacccgtaaacccggtaaaaccccgtttaaccggttacccgggaaaccccgttaaaacgtttaaccgggttaacggggtttaccggggggggtttaccttttttaaccgggggtttccgggttacccgggggggggtaacccccggtaaccgggggggttacccccttagggggtttaccctaaacccggttccccgggttaaccccgttacccccccggaacggttacccccccgttaaccccggaaacccccgggtaaacccgggggttaccccccttaacggtttccccccggggtttacccccctttaccccccccgggtacggggtccccccgtcccccggttaccgg

SEQ ID NO: 22534 - DNA, 622 bp, Homo sapiens
  misc_feature: GYAE6OF01A37G8.12.40.D07.1.454.CMB.1.raw
  modified_base (487)..(487): a, c, t, g, unknown or other
  misc_feature (487)..(487): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtatttcccttcaatttctattccatgcacgtgggtccgccaggctccaggcaaggggctcggagtgggtggcacttatgcacatgatggcgtacaaactaaattctaacgactaaagttccggtaggacgggggccctatttccaccattcctaccaaggacgaactaaattaaccaaagtaaaccctaccccttttaatcctagaactaaaatacgaccagccctagaacgaccaggaccgacgacggtctgtacttattatgcgcgagagacacacacgaactacngaccaatacgtagtcggggtcttggtcggtcggggccgaggggtaccctggtactcgtccgtcctcccgacgtccctaccgaacccgaccgggccctacgtcccggtcccttcccccggtcggcccgtcccgtcg

SEQ ID NO: 22535 - DNA, 797 bp, Homo sapiens
  misc_feature: GYAE6OF01A36G5.12.40.D07.1.454.CMB.1.raw
  modified_base (423)..(423): a, c, t, g, unknown or other
  misc_feature (423)..(423): n is a, c, g, or t
tcagatacgacgtacacgaccggtgctcgatttagtgatagagcgtaacaacagagggctcaccatggagtttgggctgagcgtggtttcgtcgtagctctttaagaggtgtccagtgtcgaggggcaccgtggtggagtcgtgggggagccggtggccagccgtgggccggtccctgacactcgctgtgttgcctcgtggtactttccctataatttctaattccatgccacgtcgggtcccgcgaggcctccgaggacgaagggctcggaggtgggtgacctacttagtcgactaacagtcgaagtcgggactaacaaaactaaacttcctacgaactaaacgtttccgagggacggggtctaattccgacctattccacgaacgataacctaagtaacaacgaaccttaccttatcgaanactaaatacgacagtacctagaacgacaaggactacgacgtcgtattactagttagttacgacgtacgaacggtaacaacgaaccgtaacgaacccgtaaaccgtcgttaaaccggacctaaaacgttaacgtaacgggttacggggtactttacgggttaccgggtaccgggggtacccggtaaccggggttacccgtacgggttaacccgttaaccggttcccgttaacccccgtacccccggtccggtaacccccgttaacccccgggaaacccgtaacccggggaccccgtttaacccgggttacccccggttaccccccggtttaacccccgggtaccgggtccccccggtttaacccccgtacccggg

SEQ ID NO: 22536 - DNA, 629 bp, Homo sapiens
  misc_feature: GYAE6OF01BVYCH.12.40.D07.1.454.CMB.1.raw
  modified_base (236)..(236): a, c, t, g, unknown or other
  misc_feature (236)..(236): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
  modified_base (453)..(453): a, c, t, g, unknown or other
  misc_feature (453)..(453): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggattttcccttcaatttctattccatgcactgggtccncaggctccaggcaaggggctcggagtgggtgcacttattgcacatgatgggctcaaacaaattctacgacaaattccggtaggaggggccatttccaacctatcctccaagacgacaaattacaaagaacctaccctttanctgccaaaatagacagcctagacgaccagaccgancggctgtctattagtgcgcgagagagacacacgaacctacncggacaatacctagtcggggtactttggttcggtcggggaccgacgggggtcccttgggtcctacggtcccgttccgtcccccacggccctaccccgaaccggaacccggggtcccctacggttaccccgggttacccctttccccccggtgggtccccgtcccgtcggtaccccg

SEQ ID NO: 22537 - DNA, 746 bp, Homo sapiens
  misc_feature: GYAE6OF01B9C1X.12.40.D07.1.454.CMB.1.raw
  modified_base (183)..(183): a, c, t, g, unknown or other
  misc_feature (183)..(183): n is a, c, g, or t
  modified_base (439)..(439): a, c, t, g, unknown or other
  misc_feature (439)..(439): n is a, c, g, or t
tcagatacgacgtacacgaccggtgctcgatttagtgatagagcgtaacaacagaggactcaccatggagtttgggctgagctgggttttcctcgttgctcttttaagaggtgtcagtgtcgaggggcaccgtgggtggagtcgtggggggagccgtggtccagccgtgggcggtccctgacnctctcctgtgtcgcctctggtactttccttctatttctactccatcgcacgtcgggtcccgcgaggcctaccgaggacgacggggctcgggaggtgggtgctaactttagtcgacacagtagagtcgggactaactaaactaacttaccgtacgaacttaacgttccggaggtacggggtccctaataccactaccgtcctacgaagaacgaacttaaacgtaaccgaaacgtaacccttaaccctttatacgtanaaccgtaaaatacgaactacaccgtagaacgaccgaaacggtaccgacgtccggtattacgtaactattacgcggacgtacggaagtacgaacgtaccaaaccgtaacccgaacgttcgaacgtaaccaagttacggtaagggttcggggttacgtttcgtccgggagggtaccggacgggtaccgtcggacctcgttcccggtaccaccccggtacggtcccccaaccggaacccgggtaccccggactttaccccggttccggtttaccccccgtcccggtacccgggtcccgtccccggtcccg

SEQ ID NO: 22538 - DNA, 636 bp, Homo sapiens
  misc_feature: GYAE6OF01BUGG8.12.40.D07.1.454.CMB.1.raw
  modified_base (150)..(150): a, c, t, g, unknown or other
  misc_feature (150)..(150): n is a, c, g, or t
  modified_base (323)..(323): a, c, t, g, unknown or other
  misc_feature (323)..(323): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccgtggtccagcctgggcggtccctgacactcgcctgtgttgcctctggtacttttcccttcaattttctattccatgcacgtgggtccgccaggctccgaggcaaggggctcggagtgggtgcacttatgcacatgatggcgtcaaactaattcctacgacaaatttccggnggacggggcctattccaccattcctccaagacgaactaaattaacaaacgtaacctaccctttatctagaacaaatagacagcctagacgaccagacgacacggtctagtcttattatgcgacgagagagacacaacgtaacctacgtacggacctaatacgtaggtcggggtactttgggttaccggtcggggtacccgaacggggtccctgggtactacgttcccgtaccctaccccgacgtcccctacccggaaccgtaccgggccctacgttcccggttacccttcccccgcgggccccgtcccgtcgg

SEQ ID NO: 22539 - DNA, 735 bp, Homo sapiens
  misc_feature: GYAE6OF01CRZEM.12.40.D07.1.454.CMB.1.raw
  modified_base (151)..(151): a, c, t, g, unknown or other
  misc_feature (151)..(151): n is a, c, g, or t
  modified_base (251)..(251): a, c, t, g, unknown or other
  misc_feature (251)..(251): n is a, c, g, or t
  modified_base (449)..(449): a, c, t, g, unknown or other
  misc_feature (449)..(449): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggganccgtggtccaggccgtggggccgtccctgacacgtcgcctgtgttcgccttcgtggtacttttcccctataagttttcattccatcgcacgtcgggtccncaggcctaccgaggcgaaggggctcggaggtggggtcgctactttagtgacactagtgatcgggtactacaaaacgtaattcctaacgactaaacgtttcccggaggaaccgggggtccctatttacccaaccgtacttccctaccggaaagaacgtaacctaaagtttaacaaacggttaaccctacccgttttaancccgtaaggaacctaaagtacggaactacgtcctaggaacgaccctaggaccacgacggtcttacgtacgttattagtcgcgaacgagacacgaactaaccgaacgaacctacgtacggacctaaagttacgtacggtcggggtctttaggtcggtacggggacccgtaacgggtccctaggtccgtacggtccgtcccgacccgtcgtaccccgtaccggaaccgaacccgggtccctaacggttcccggttaccccgtaccccggtcggccccgtcccgtacgg

SEQ ID NO: 22540 - DNA, 779 bp, Homo sapiens
  misc_feature: GYAE6OF01DDPUD.12.40.D07.1.454.CMB.1.raw
  modified_base (111)..(111): a, c, t, g, unknown or other
  misc_feature (111)..(111): n is a, c, g, or t
  modified_base (188)..(188): a, c, t, g, unknown or other
  misc_feature (188)..(188): n is a, c, g, or t
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
tcagatacgacgtacacgaccggtgctcgatttagtgatagagcgtaacaacagagggctcaccatggagtttgggctgagcttgggttttcctcgttgcttcttttaagnggtgtccagtgtcgagggcactggtggagtcgtgggggagccgtggtccagcctgggcgtccctgacactcgctgtntgcctntgtactttccctnaagtttctattccagttgacacgtcgggtccncaggcctaccgaggccgaaggggtcctaggagggtggggtgtacctaaacgtttagttgaccatagttcggaatgggtacctacaaaactaatttcgtaacgaacctaaaagtttcccggaaggaccggggacctaatttccaacctatccgtaccaaggaacgtaaataacttaacaaaccgaactttaccccgttaatacacggaacaaaagtcgacctaaggactaggaacaacccaaaggaccaacgtacgtacgttacgtacttaacgttagtacgacgtaacgtaaggacgaacgaacaaccgtaaaccgaaccctaacgttacggaaccttaaacgaaacgttacggtaggggttcgtttacggttccggaaccggggttaccgaaccggggttacccgtaggttacctacggttaccccgtcccgttaacccccgacgtacccccgttaacccggaacccggtaacccgggtcccttaaaccgggtccccgttaccccgttcccccggtagtacccccgtcccgttacccgg

SEQ ID NO: 22541 - DNA, 751 bp, Homo sapiens
  misc_feature: GYAE6OF01B4201.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggctacctggtggagtcgtggggggagccggtggtccagcctgggcggtccctgacactcgcctgtgttgcctctggatttcccttcaatttctattccatgcacgtggtccgccaggctccgaggcgaaggggctcggaggtgggtggcacttattgcacatgatggcgtacaactaaattcctacgactaaacgttccggtaggacgggggcccgtattccgacctactcctccgaacgagaacctaaagttaaccaaacgtaacctaaccctttatctacgaactaaagtacgaacacgcctagaacgacccaagaccgacgacggacttcgtacttaagttcgtacggcgacgtagaacggacaaccgacgtaacccgaaccctacgtacgaaccctaattaacggtaggttcgggggttcctttcgggttaccgggttacggggacccggtacccgggggtacccgttcgggtaccgtaccgttcccgttaccccgtcccccggtaccgtaccccttacccccggaaaccccggaccccggggttaccccctaacccggtttcccggggttccccccgtttaccccccgggtccgggttcccccggcccccgtttacccgg

SEQ ID NO: 22542 - DNA, 830 bp, Homo sapiens
  misc_feature: GYAE6OF01B3WA6.12.40.D07.1.454.CMB.1.raw
  modified_base (153)..(153): a, c, t, g, unknown or other
  misc_feature (153)..(153): n is a, c, g, or t
  modified_base (211)..(211): a, c, t, g, unknown or other
  misc_feature (211)..(211): n is a, c, g, or t
  modified_base (455)..(455): a, c, t, g, unknown or other
  misc_feature (455)..(455): n is a, c, g, or t
tcagatacgacgtacacgaccggtgctcgatttagtgatagagcgtaacaacagagggctcaccatggagtttgggctgagcttgggtttttcctcgttgctcttttaagaggtgtccagtgtcaggggcacctggtggagtcgtgggggganccgtggtccagccgtgggcgtcctgacactcgctgtgttgcctctgtactttcccttntaattttctacttccatgctacgttcgggtcccgcaggtcctccgaggacgaaggggtctcggaggtcggggtggactacgtttatcgacacagttacggattcgggacctaacaaaacgtaaactttcctaacgacgtaaaacgtttcccggagggaccggggtccctaagttacccaaccgtacttccctaccgaaaggtaccgaaactaaaacgttaacaaacggtaccttacccttttanactacgaactaaagacgaacacgtacctagaacgaccagaaccgaccgtacggtcttacgttacttaactttagtacggacgtaacggaagaacgtaacggaaacccaaaccgtaaccgtaaaccctacggtaccgtaaacctaaacgttaaccggttaacggggttacggggttaccgttttacggggtttacccgggtacgggggtacccgggtaaccgggggttacccgttcgggttaccgttaccggttacccgttaccccgtacccccggtaccggtaccccctaacccggaaccccgggtaaccggtacccgtacccggtttcccggtaccccctttacccccggccggtacccgtccccgttacccgg

SEQ ID NO: 22543 - DNA, 673 bp, Homo sapiens
  misc_feature: GYAE6OF01AJEBO.12.40.D07.1.454.CMB.1.raw
  modified_base (154)..(154): a, c, t, g, unknown or other
  misc_feature (154)..(154): n is a, c, g, or t
  modified_base (213)..(213): a, c, t, g, unknown or other
  misc_feature (213)..(213): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
tcagatacgacgtacacgaccggtgctcgatttagtgatagagcgtaacaacgagagggctcaccaatggagtttgggctgagctgggttttcctcgttgcttcttttaagaggtgtccagtgtcaggggcacctggtggagtcgtgggggganccgtggtccagcctgggcggtccctgacactcgcctgtgttgcctctggactttccctnaatttcattccatgcacgtgggtcccgccaggcctccgagggccaagggggcctcggaggttggggtcgctactttagtgcacatggatcggacgttacaaactaaagttccaacgactaaacgttccggtaggacgggcctattccacctatcctcgagtacgactaactacgaagaaacctccttagctagactaaatcgactacgcctagaacgaccagaccgacnccggtntacgtctagttagtcgcgtcgaagacgacgactacaccgtaacctacgtacgactaacgtacgtagtacggggtcttaggttccggtacggggtaccgtaaccggggtaccgtacgggtacctaccgttcccgtacccgtaccccggtacgtaccccgtaccgaacccggaccgggccctaccgtccgggttccccttaccccgggtcgccccggtcccgtccgg

SEQ ID NO: 22544 - DNA, 674 bp, Homo sapiens
  misc_feature: GYAE6OF01AORIW.12.40.D07.1.454.CMB.1.raw
  modified_base (154)..(154): a, c, t, g, unknown or other
  misc_feature (154)..(154): n is a, c, g, or t
  modified_base (247)..(247): a, c, t, g, unknown or other
  misc_feature (247)..(247): n is a, c, g, or t
  modified_base (449)..(449): a, c, t, g, unknown or other
  misc_feature (449)..(449): n is a, c, g, or t
  modified_base (615)..(615): a, c, t, g, unknown or other
  misc_feature (615)..(615): n is a, c, g, or t
  modified_base (643)..(643): a, c, t, g, unknown or other
  misc_feature (643)..(643): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctgggtggagtcgtggggggganccggtggtccagccgtgggccggtccctgacactcgcctgtgttgcctctggacttttcccttctaatttctattccagtgcacgtgggtccnccacggcctccgaggcgaagggggcctcggaggtgggtggctacgtttagttgaccacattggatcgggaccgttacaaactaaacttttccaacggacctaaaacgtttcccggagggacggggccgtaactttaccgaacctacttccctacccgaaagtaacgaacctaaattaacgaaacgtaaccctaaccctttanctagacctaaaagtcgacacgcctagaacgaccaggaccgacgcgtctcgtactattagtgaccgtagaagagacgaccaaccaaccgaacctacgacgaccaatacgtggtacggggtctttcggtcggcggggtccgagggtccctcggtctacgtccgtcccnccccgcgtccctaccaccgaccggcccncgtcccgtccctaccccgcggccgcccgtcg

SEQ ID NO: 22545 - DNA, 831 bp, Homo sapiens
  misc_feature: GYAE6OF01B9X81.12.40.D07.1.454.CMB.1.raw
  modified_base (241)..(241): a, c, t, g, unknown or other
  misc_feature (241)..(241): n is a, c, g, or t
  modified_base (277)..(277): a, c, t, g, unknown or other
  misc_feature (277)..(277): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagccgtgggcgtccctgacactcgcctgtgtgcctctggtactttcccttctaatttctattccatgctacgtcgggtccnccgaggcctccgaggcgaaggggctcggaggtgggngctacttatcgacacgatgagtcggactacaaactaaattccgaacgtactaaacgttccggtaggacggggacctaacttccactactcctaccaagaacaactaaactaaccaaacgtaacctaccgttatcagaacaaagtacgacacgtccgtagaaccgtaccgaagtaccgaaccgtacggtcttacgttacgttaagttacgttcggaccgtaacggaacgacggtaaccgaaacccgtaaccgaaaccccggtaaaccgttaaccggttaccgggtaaacccttaaaacgttaccgggttacggggttaacgggggtttacccttttccgggggtttaccgggtaaccgggggtacccgggttaacccggggttacccgttacggtaacccgttaacgttccccccggttaacccgtaccccccggtaccgtaccccccggttaaccccgaacccggggaaaccccggttcccccggttacccgttcccccgggttacccccgtttacccccgggtcccggtaccccggtcccccgtttaacccgg

SEQ ID NO: 22546 - DNA, 713 bp, Homo sapiens
  misc_feature: GYAE6OF01AFTGY.12.40.D07.1.454.CMB.1.raw
  modified_base (245)..(245): a, c, t, g, unknown or other
  misc_feature (245)..(245): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (627)..(627): a, c, t, g, unknown or other
  misc_feature (627)..(627): n is a, c, g, or t
  modified_base (650)..(650): a, c, t, g, unknown or other
  misc_feature (650)..(650): n is a, c, g, or t
  modified_base (695)..(695): a, c, t, g, unknown or other
  misc_feature (695)..(695): n is a, c, g, or t
tcagatacgacgtacacgaccggtgctcgatttagtgatagagcgtaacaacagaggactcaccatggagtttgggctgagctgggttttcctcgttgcttcttttaagaggtgtccagtgtcaggggcacctggtggagtcgtggggggagccgtggtccagcctgggccggtcctgacactcgcctgtgttcgcctctggtactttcccctataattttcattccgatgctacgtcgggtccnccaggtctcagggcgaagggggccttaggaggttggggngactacttatgacaacntgatggctacaaactaatcgtaacgactaagttccgagacggggtccatttaccaccattcccacgagaagacctaaagttaaccaaacggtaaccctttccttatcgtacgaaactaaacgtacgaacaacggcccttaaggaaaccaccaacgggtacccaacggtaccgggacttaggtttaaccttaatttacgttcgggaccgtacggaaggtaaagaaccgaaaccgtaaccgaacccaaccgttaccggtacgaacctaaaggtacctagggtacggggtctttcggtacggtcgggaccgtacgggtacctggttacncgttccgcctacccgcgtacccncccgaaaccgacccgtccctacggtcccggttacccctccccggngtccccgtccgtacccgg

SEQ ID NO: 22547 - DNA, 934 bp, Homo sapiens
  misc_feature: GYAE6OF01AGD8F.12.40.D07.1.454.CMB.1.raw
  modified_base (152)..(152): a, c, t, g, unknown or other
  misc_feature (152)..(152): n is a, c, g, or t
tcagatacgacgtacacgaccggtgctcgatttagtgatagagcgtaacaacagaggactcaccatggagtttgggctgagctgggttttcctcgttgcttcttttaagaggtgtccagtgtcaggggcacctggtggagtcgtgggggganccgtggtccagcctggggccggtccctgacactcgcctgtgttcgcctctggtacttttcccttactaattttctactttccattcgcctacgttcggggtccgccaggcctccgaggccgaacgggggcctcggaggttggggtgggacctacgtttattcggaccacgtaatggaagttggggtccgttaacaaaaccgttaaaactttccgtaaacccggtacctaaaaacggttttcccgggtaggggaaccggggggtaccccgtaaattttacccgaacccttaacttcccgtacccaagggtaacgtaaacctaaaactttaaaccgaaacgtaaaacccctaccccctttttaatccgtaacgaacctaaaagtaacgaacctaacggtacccttaacggaaccggaaccccaacgggtaacccgaaccggtaacccggtccgttacggttacctttaacgtttaacgtttacggaccgggtacggtaaggaacggaaccgaaccgaacccgtaaacccggtaaacccgtaccggtaccggtaacctaaacgttaacgtaacggttacggggggttcgtttacgggtttccgggttacgggggacccgggtaaccggggtacccgttcgggttaccgtaccggtttcccgtaccccgtaacccccggtacccggtacccctaccccggaacccggtaacccggggtccccgtaccggttcccccggtttaccccgttaccccccgggtcggtcccccggtccccgtaccccggg

SEQ ID NO: 22548 - DNA, 693 bp, Homo sapiens
  misc_feature: GYAE6OF01B9VXY.12.40.D07.1.454.CMB.1.raw
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagccgtgggccggtccctgacactcgcctgtgtgcctctggtactttcccttctaatttctattccatgcactgggtccgccaggctccgaggcgaaggggctcggaggtggggtgctacttattgcacatgatggctacaaactaaattcacgactaattccggaggacggggccattaccacactcctaccgagacaactaattaacgaaagaacctacctttatctagacaaatgacagcctagacaccagacacgacgnttntactattacgtgcgagagaacgacgaacaaccgaccgtaacctacgtacgacctaactacggtacggtcgggggttcgtttcgggttccggacgggggtaccgggacccggggtacccttcgggttaccctacgttcccggtaccccttacccccgtaccgaccccggttaccccaaacccggggtaacccgggcccccgtttaaaccggtccccgggtttccccctttaccccccgggccggtcccccggttccccgtaccccggg

SEQ ID NO: 22549 - DNA, 883 bp, Homo sapiens
  misc_feature: GYAE6OF01D85A2.12.40.D07.1.454.CMB.1.raw
  modified_base (157)..(157): a, c, t, g, unknown or other
  misc_feature (157)..(157): n is a, c, g, or t
  modified_base (225)..(225): a, c, t, g, unknown or other
  misc_feature (225)..(225): n is a, c, g, or t
  modified_base (483)..(483): a, c, t, g, unknown or other
  misc_feature (483)..(483): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcaggggcaccgtgggtggaggtcgtggggggacnccggttggtccaggcccgtggggccgtccctgaccactcgcctgttgtcgcctgtggtactttccctntaatttctagttccatgactacgtcgggtcccacgaggtcctaccggaggacggaacggggtctagggaggttcggggtacgacctatttagttcggactactagtaggacgtgggaccttaacgaaacttaacttcgaaccggtaaccttaaacggttcccggtaggggaccggggtcctaacttccaaccggtacttccaaccgaggtaacgtaaacctaaagttaaccgaaacggtaaccttaccccgttttaanaccgtaggtaactaaagtacggtaaccaggtacccgaaggtaacgaacccgtaaggaaccggtaccgtacggtacgttacggttaacttaagttacgttacggaccggtaacggtaaggaacggtaactaaccgggggggtaacctaaccggtaaaccgtacgtaacggtaaccgtaacgttaacggttacgggttacggggttacggtttacgggttaccgggtaccggggtaccgggtaaccggggtacccgttaccgggttacgtacccggttaccggtacccgtaccccggtacccggtacccggtaacccggtaacccgggtacccgggtacccggttaccggttcccggttaccccggttaccccggtcccggtaccccggtcccggtacccgg

SEQ ID NO: 22550 - DNA, 860 bp, Homo sapiens
  misc_feature: GYAE6OF01BYL6Q.12.40.D07.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
tcagatacgacgtacacgaccggtgctcgatttagtgatagagcgtaacaacagagggctcaccatggagtttgggctgagcttgggtttcctcgttgcttcttttaagaggtgtccagtgtcgaggggccaccgtgggtggaggtcgtaggggggactccggtcggtaccacggccgtggggccggtccctgacnctcgctgtgtcncctgtggtactttcctataactttctacttccagtcgaccgtacggttccggggtcccgaccgacgggtcctaccggacggggacggaaccgggggtcgtacgggacggggttgggggtacggtaccttaactttagtacgacctaacgtagttacggacgtaccggggtaactaaacctaaaactaaacggtttccgaaccgtaactaaacgggtttcccgggtaggggaccggggtacccttacttacccaccgtaacgttcccgtaacgaagaacgtaaacctaaagtaacccgtaaacgtaaccttaacctttagacttacgaaactaaacgtacgaccgaacgtcctaagaccgtaaaccgacggtacctaacggtcgtacgttacgttaccgttagttacgtccgggagtaccggaagtaacgtaacccgtaacgaacccgtaacccggtaacctacggacgttaacctaacgggttacggaggttaccggggttaccttcgggttacgggaccggggtacccgtaccgggtaccgttaacgtccggtaaccgttcccggtaaacccgtccgaccggtaccccttacccggaccggtaccgtccgtaccggtcccgttccgtacccggtcgtaccgccgtacccgg

SEQ ID NO: 22551 - DNA, 859 bp, Homo sapiens
  misc_feature: GYAE6OF01CH2GS.12.40.D07.1.454.CMB.1.raw
  modified_base (213)..(213): a, c, t, g, unknown or other
  misc_feature (213)..(213): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctgggtggagtcgtgggggagccgtggtccagccgtgggcggtccctgacactcgcctgtgttgcctctggtactttcccttntaattttctattccattgcctacgtgggtcccgcaggcctccgaggcgaaggggctcggaggtggggtcggctacttagtgcacatgatggactacaaactaattcctaacggactaaacgttccggtaggacggggtaccctattccaaccctattccccgttaaccgaaggaacgtaaacctaaaacgtttaaccaaaaccggtaaaccctttaacccccgtttttaatacccgtaagtaacctaaaaagtaccggaacgtacgtacccgtaacgggaaccgaaccccgaacggaacccgaccgaacccggtcgttacgttaccgtttaagtttacggttccggacgggtacgaacggtacggaaccaaccgaaccgtaaacccggtaacctaaccgttaccggaaccctaaagttacccggttaggggtaccggggtactttcgggttaccgggtacgggggaccccgtaacgggggtacccgttggtaccgtacggtaccccggttacccgtaccccccggtacgtacccccgttaccccggaaaccgggtaacccccggggtacccccttaaccgggttccccccggtttacccccgtttacccccccgggtcggtcccccccggtaccccgttacccggg

SEQ ID NO: 22552 - DNA, 562 bp, Homo sapiens
  misc_feature: GYAE6OF01AY396.12.40.D07.1.454.CMB.1.raw
  modified_base (149)..(149): a, c, t, g, unknown or other
  misc_feature (149)..(149): n is a, c, g, or t
  modified_base (309)..(309): a, c, t, g, unknown or other
  misc_feature (309)..(309): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcgtccctgacactcgcctgtgttgcctctggatttcccttcaatttctattccatgcactgggtccgccaggctccaggcaaggggctcgagtgggtgcacttatgcacatgatggcgtcaacaaattctacgcaaattccgngaggggccattcacatctccagagacaattacaagaaccnccctttanctgcaaaatgacagcctgagacccagtaccgaacacggctgtcttattattgcgtcgagagagacacaacgaacctactaggacccaatactagtaggggtcttagttccgtggggccacggggaccctggtccatccggtcctccccgagccctaccaccgaacggcccacgtccgttaccttcccccgtggcccgtcccgtcg

SEQ ID NO: 22553 - DNA, 835 bp, Homo sapiens
  misc_feature: GYAE6OF01C6Z9N.12.40.D07.1.454.CMB.1.raw
tcagatacgacgtacacgaccggtgctcgatttagtgatagagcgtaacaacagagggctcaccatggagtttgggctgagctgggttttcctcgttgcttcttttaagaggtgtccagtgtcaggggcacctgggtggagtcgtggggggagccgtggtccagccgtgggcggtccctgacactcgcctgtgttgcctctggtacttttcccttacaatttctattccatcgcactggggtcccgccaggcctccgaggcgaaggggctcggaggtgggtcgcacttatgcacatgatcggacgtacaaactaaattccaacgtactaaaacgtttccggtagggaacgggggccctagttaccaaccgtacttcctaccgaagaacgtaaacctaaacttaaaccaaaacgtaaccctaaccccgtttttaataccgttaacggaactaaaaacgtacggtaaccaacggtaccctaaggaaaccggaacccgtaaacgaaccggaaccgaaccgggtcccgttaacgttaccgtttaattttaacggttacggtacccggtacgggaaaggaaccggtaacggaaccctaaaccggaaacccgtaaaccgttaacccgtaacgggaacccctaaaagttacggttaacgggtttacgggggtacgttttacgggttccgggacgggggtacccgggtaaccggggtacccttaagggtcctaacttcccggttcccaccccgtaacgcccccgttacccaaacccgggtaccgggtaccctaccggttaccccggttcccctttacccccggcgggttccccgcccgtaccg

SEQ ID NO: 22554 - DNA, 756 bp, Homo sapiens
  misc_feature: GYAE6OF01CRP5Y.12.40.D07.1.454.CMB.1.raw
  modified_base (428)..(428): a, c, t, g, unknown or other
  misc_feature (428)..(428): n is a, c, g, or t
  modified_base (489)..(489): a, c, t, g, unknown or other
  misc_feature (489)..(489): n is a, c, g, or t
  modified_base (583)..(583): a, c, t, g, unknown or other
  misc_feature (583)..(583): n is a, c, g, or t
  modified_base (635)..(635): a, c, t, g, unknown or other
  misc_feature (635)..(635): n is a, c, g, or t
tcagatacgacgtacacgaccggtgctcgatttagtgatagagcgtaacaacagagggctcaccatggagtttgggctgagctgggttttcctcgttgcttctttttaagaggtgtccagtgtcgaggggccaccgtgggtggagtcgtggggggagccgtggtccagccgtgggcggtccctgacactcgctgtgttcgcctcgtggtacttttcccttctaattttctattccatgcacgtcgggtccgccgaggtcctcgaggcgaagggctacggaggtggggtgctacttagttgcacatgacgtggcgtacaaactaacttccgtaacgactaaacgttccggtaggaacgggggtccctattccgaactcgttacctcccgaaggtacaaacgtaataaactaacgaaccttacctttaanctaacgaactaaactagaaccgtaacgtcctagaacgacccaaagaccgacgtaaccggtntacgtttacgttaatttagtcggtaccaggaagaacgacgaaccgaacgtaacccgaaccgtaccgtacgaacctaaacgtacgtttaacgggngggttacgtttcggttcggaccggggtacccgggtaccgggtccgttacggnggttacccttcccgggtacccttcccgacccgtccctaaccccggtaaccccggaaccgggtccctaacccggttcccggttacccccgttccccggtacccggtcccgtcccggtacccg

SEQ ID NO: 22555 - DNA, 658 bp, Homo sapiens
  misc_feature: GYAE6OF01BDMKN.12.40.D07.1.454.CMB.1.raw
  modified_base (214)..(214): a, c, t, g, unknown or other
  misc_feature (214)..(214): n is a, c, g, or t
  modified_base (484)..(484): a, c, t, g, unknown or other
  misc_feature (484)..(484): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcgaggggcaccgtgggtggagtcgtgggggagccgtggtccagccgtgggccgtccctgacactcgcctgtgttgcctcgtggtactttccctntaattttctacttccatcgcacgtggtcccgccgaggcctcgaggtcgaagggctcggaggtgggtgctacttagtcgcacagtgagtggacgtacaaaacgtaaacttcgtaaccgtactaaacgtttccgggtaggaccggggtacctaacgtttccaaccgtaactcctaccgaaagacgaactaaacgtttaacaaacgaacccttacctttaatctacgaactaaatacgactagcctaagacgaccgtagaccgacgtacggtnttacgtacttagttagtcgacgtagaagagacgacacaacgactancgtanaactgagtcgggttactcgtcgcgggccgtacgggctcggtcgactccgccctacccgcgtacccaccgaaccgcggtaccccacggttcccgttcccgtaccccggcgtccccgcccgtcgg

SEQ ID NO: 22556 - DNA, 886 bp, Homo sapiens
  misc_feature: GYAE6OF01DEBE6.12.40.D07.1.454.CMB.1.raw
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
tcagatacgacgtacacgaccggtgctcgatttagtgatagagcgtaacaacagagggctcaccatggagtttggctgagcttgggttttcctcgttgcttcttttaagaggtgtccagtgtcgaggggcaccgtggtggagtcgtgggggacgtccggtggtccagccgtgggccggtccngacnctcgtcctgtgttcgcctcgtggtactttccttactaacttttctacttccatcgacgtacgtcgggtcccgaccgacggctacccgagggcggaaacggggcctagggtagggtaggggtcggacgttaccgttaagtacgacaacaaggttagacgtcggtaccgtaacctaaaacttaaaacgttacgtaaaacccggtaacctaaacggtttaccgggtacgggaccggggtacctaacttacccgtaaccgtaccttaccgtaaccgaacgtaaccgtaaactaaacttaaaccgaaaccgtaaacccttaaacccgttttaactacgtaacgtaaactaaacgaacgtaacgaccgttaccgaacgtaaaccgaacccggtaaacgaaccgtaaccggaccgtaacttcggtacctttaagtttaacgttcggaaacgtaacggtaaggaacaacggtaaccaaaccgtaaccgtaaacgtcccgtaagtaaccctaagtaacggtcgggttacggggttaccctttacggggtacggtccggggaaccggaccgggttaccgtcgggtaacctcggtacccctcccgaacccgtaccgtaccccggttaaacccgaaccccggtacggtaacccccgttacgttacccccgggttaccccgttacccccggccggtaccctccccgggtaccg

SEQ ID NO: 22557 - DNA, 846 bp, Homo sapiens
  misc_feature: GYAE6OF01CF0HB.12.40.D07.1.454.CMB.1.raw
  modified_base (241)..(241): a, c, t, g, unknown or other
  misc_feature (241)..(241): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctgggtggagtcgtggggggagccgtggtccagcctgggcgtccctgacactcgcctgtgttgcctctggtactttccctctaatttctattccatgcacgtcgggtccnccaggcctccgaggcgaagggtctcggaggtgggtgctacttatcgacacagtgatggacgtacaaacgtaaattcgaacggtactaaaacgttccggtaggaacggggcctaattacccaacacgttcctaccgaaggtaacgaaactaaattaacgaaaacgtaacctaacccttttaatcctaaggaaccaaaattacggaacctacgacccgtaggaaccgaaacccgtaacggaaccgaaccgtaacgggtccttacggttacctttaaagtttacgttacggaccggaacgaaaggacggaacgaacccgaaaccgtaaacccggtaaaccgtaaccggttcggaaaccccttaaagttaaccgttaacgggttacggggggttacctttacggggttaccgggtccgggggtaacccggtaacgggggtaccccgttaggtacccgttaccggttacccgttaaccccgtacccccggtaacgttacccccgttaaccccgaaaacccgggtaaacccggggacccccttaaccgggttaccccggttaccccccgtttaccccccggaagggtccccccggttaccccgtacccggg

SEQ ID NO: 22558 - DNA, 730 bp, Homo sapiens
  misc_feature: GYAE6OF01BL4SO.12.40.D07.1.454.CMB.1.raw
  modified_base (153)..(153): a, c, t, g, unknown or other
  misc_feature (153)..(153): n is a, c, g, or t
  modified_base (217)..(217): a, c, t, g, unknown or other
  misc_feature (217)..(217): n is a, c, g, or t
  modified_base (306)..(306): a, c, t, g, unknown or other
  misc_feature (306)..(306): n is a, c, g, or t
  modified_base (597)..(597): a, c, t, g, unknown or other
  misc_feature (597)..(597): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgagggcaccgtggtggagtcgtggggganccgtggtccagccgtgggccgtccctagacactcgcctgtgttcgccttgtggtactttccctntaattttccagttccatcgcacgttcgggccgccaggcctaccgaggccgaaaggggctcggaggtggggtcgctacttagtcgacacngtgatggactacaaactaattccgtacgactaaacgttccggtagacggggtacctatttaccaaccctattcccaccgaagacgtaactaaacttaacgaaaccgtaacctaccgttttacaccgtagaactaaatacgaacacgtccgtaggaaccaccgacggaaccgaccggtaacgcttacgttaccttagttacttcggacgtacgaaggaagacgaaccaaccgaaccggaaccttacgaacgtaccaacttacggtaggtcggggtacttggtttaaccgggngggacccggtacgggacccgtaggtacctacgtacccgtccctacccggacctaccccgttacgacccggaacccggtacccacccggtttccccggtcccgttcccccggtcggtccccggtcccgtacccg

SEQ ID NO: 22559 - DNA, 641 bp, Homo sapiens
  misc_feature: GYAE6OF01ELC1J.12.40.D07.1.454.CMB.1.raw
  modified_base (150)..(150): a, c, t, g, unknown or other
  misc_feature (150)..(150): n is a, c, g, or t
  modified_base (237)..(237): a, c, t, g, unknown or other
  misc_feature (237)..(237): n is a, c, g, or t
  modified_base (370)..(370): a, c, t, g, unknown or other
  misc_feature (370)..(370): n is a, c, g, or t
  modified_base (400)..(400): a, c, t, g, unknown or other
  misc_feature (400)..(400): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggganccgtggtccaactgggcgtccctgacactcgctgtgttcgcctctggtacttttccctataatttctattccatgcacgtgggtccncaggctccgaaggcaaggggctcggaggtggggtcgactacgtttatcgacaacatggatggactacaaactaaattcgtaacgactaaacgttccggtaggacggggccattccaccagtcctacgaagaanaactaattaacaagaaccttacccgtttanccgtagaaccaaaagtcgaactacgcctagacgtacccaaggacgtacagtctagtactattagtgacgacgtaagagacgaacaaccgaacgtaactacgtacgactaagtacgtaggtgggtcttaggtcgtacgggtacctacggggccctaggctacgtcgtcccaccgtacgcccgtaccgaaccgacggaccctacgttcccgttccgtacccccgtgccccgtccgtcgtcccg

SEQ ID NO: 22560 - DNA, 933 bp, Homo sapiens
  misc_feature: GYAE6OF01CDFFA.12.40.D07.1.454.CMB.1.raw
  modified_base (152)..(152): a, c, t, g, unknown or other
  misc_feature (152)..(152): n is a, c, g, or t
  modified_base (192)..(192): a, c, t, g, unknown or other
  misc_feature (192)..(192): n is a, c, g, or t
  modified_base (199)..(199): a, c, t, g, unknown or other
  misc_feature (199)..(199): n is a, c, g, or t
  modified_base (242)..(242): a, c, t, g, unknown or other
  misc_feature (242)..(242): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtcgtgggggganccgtggtccagccgtgggcggtccctgacactcgcctgtnttgcctntgtctttccctctaatttctattccatcgcacgttcgggtccnccgaggtcctaccgaagggcgtaaacgggggcctcgggagggttcggggtacggtcctaaccttttagttcggaccaaacgtacgttgggaacgttggggtaccccgttaacaaaaaccgttaaaagttttaccgaaccggttaaccgttaaaaacgtttttccccgggggtaggggaccgggggtaccccgttaacgtttcccaaaccctactttaccccgtaaccccaagggtaaaacgtaaaaccccttaaaaagttttaaccccaaaaaccggttaaaccctttaaacccccgttttatccggtaaacgtaaactaaaacgttaaacggaaccctaacggttaccccgtaggaacccgaaccgaaacggtaaccggaacccgtaccgggtaccttcgtttacttaagtttaacgttcggaccgggacgtaacgaacgggaaccgaaccgtaaccgtaaacccgttaacccgtaaccgtacggaaccctaaacgttaaccgtagggttacggggttaccgtttcgggtccggtaccggggtacccggtaccggggtacccgtacgggttccgaccggttcccgtcccgtaccccgtaccgtaccccgttaacccgacccggtaacccggtcccgtaccggttccccggttccccgttacccccggccggttccccggcccgttcccgg

SEQ ID NO: 22561 - DNA, 760 bp, Homo sapiens
  misc_feature: GYAE6OF01C8R6G.12.40.D07.1.454.CMB.1.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcaccgtgggtggagtcgtgggggagccgtggtccagcctgggccggtccctgacnctcgcctgtgttgcctntggtactttcccttctaacttttctattccatcgcacgtcgggtccgcgaggcctccgaggccggaagggggtcctacggagggttggggtcggacctacgtttagttcggacaacgatggaacgttcggaccgtacaaacgtaaacttccttaacgactaaaacgttccggtaggacggggtacctacttcgaccctagtcctaccaaggactaaacctaaacttaacgaaaaccaaacctttacccctttaatacgtaacgtaactaaaagtacggaacctacggacctacgaacggaacccgaagaacccggtacgaacggttcttacgttacttaagtttatacggaggtacggaagaacggaccgaaacaaccgtaacccgaaaccttcgacgaacccttaaatacggttagggtccgggttacgtttcgtaccgggtacggggcccgaacggggtcccttgggactaccgtccgtccctaccccgcgtccccgtaacacccgggacggccccttacggtccccgtacccttccccggccggtcccgcccgtacg

SEQ ID NO: 22562 - DNA, 780 bp, Homo sapiens
  misc_feature: GYAE6OF01BN5OX.12.40.D07.1.454.CMB.1.raw
  modified_base (113)..(113): a, c, t, g, unknown or other
  misc_feature (113)..(113): n is a, c, g, or t
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
  modified_base (598)..(598): a, c, t, g, unknown or other
  misc_feature (598)..(598): n is a, c, g, or t
tcagatacgacgtacacgaccggtgctcgatttagtgatagagcgtaacaacaggggactcaccatggtagtttgggctgagcgttgggttttcctcgttgcttcttttaagnggtcgtccaggtgtcgaggggcaccgtgggtggagtcggtgggggacgccgtggtccacgccgtgggccggtccctgacacgtcgctgtgttcgcctgtcgtactttcccttntaatttctacttccatcgcctacggtcgggtccacgtaggcctaccgagggcggaacggggtcctagggngggttcgggacgtacctaacgtttagtcggacctaagtatcggtaggtcggtacctaacgaaaacttacgttaccgacgtaacttaacggtccggtagggaccgggcctatcccgtaacactccgtacgaacgaataaacgtaactaacgaaactaccttaacctttgactagaaacttaagacgacgactaccgagaacgaaccgtaacgaaccgccggttaacgtccgttagtttacgtacgttacggtccggaataacgggagaactaacccggaacctaccggtaaaccgtaaccgtntaaccggaaaccttaggtacggtaacggggttggttaccggttcgtacggggttacccgggacggaccgggttaccgtggtaactcccgtcgtaccccacgtccgtaccccacggtaaacccggccgttacccgtccgacccggttccccgggtcctaccgcccgggttcccagtaccccgg

SEQ ID NO: 22563 - DNA, 724 bp, Homo sapiens
  misc_feature: GYAE6OF01AG0HG.12.40.D07.1.454.CMB.1.raw
  modified_base (151)..(151): a, c, t, g, unknown or other
  misc_feature (151)..(151): n is a, c, g, or t
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
  modified_base (398)..(398): a, c, t, g, unknown or other
  misc_feature (398)..(398): n is a, c, g, or t
tcagatacgacgtacacgaccggtgctcgatttagtgatagagcgtaacaacagaggggctcaccatggagtttgggctgagctgggttttcctcgttgctcttttaagaggtgtccagtgtcaggggcacctggtggagtctgggggganccgtggtccaggcctgggcggtccctgacactcgcctgtgttgcctntggattttccctnaattttcattccatgcactgggtccncaggctccaggcaagggctcgagtgggtgcacttatgcacatgatggcgtacaaactaaattctaacgctaaacgttcccgtagacgggggtcctatttccgaacctagtcctaccgaagtacgaacctaaatttacgaaccggtaacctacccttttaancctaggactaaaatacggactacggccctagaacgtacccaagaccgaacaccgggctagtacttaattacgttcgacgtcgtaacggaagaaggtacccaacgaacccgtaacctaccgtacggaacctaaagttacgttaagggttacgggggtactttcgggttaccggttgggggaccgttaaccgggggtaccctggggttacctacgttcccggtacccgtacccccgtaggtccccttacccgtaaccccggaaaccgggtcccctaacggttcccgggttacccttacccccggtcgggtccccgtcccggttaccgg

SEQ ID NO: 22564 - DNA, 744 bp, Homo sapiens
  misc_feature: GYAE6OF01C5G1G.12.40.D07.1.454.CMB.1.raw
  modified_base (155)..(155): a, c, t, g, unknown or other
  misc_feature (155)..(155): n is a, c, g, or t
  modified_base (180)..(180): a, c, t, g, unknown or other
  misc_feature (180)..(180): n is a, c, g, or t
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
  modified_base (396)..(396): a, c, t, g, unknown or other
  misc_feature (396)..(396): n is a, c, g, or t
tcagatacgacgtacacgaccggtgctcgatttagtgatagagcgtaacaacagagggctcaccatggagtttgggctggagcgtgggttttcctcgttgcttcttttaagaggtcgtccagtgtcaggggcaccgtggtggagtcgtggggganccgtggtccagcctggggccgtccngacactcgctgtgtgcctcgtgtactttccctntatttctattccatgcacgtcgggtaccnccgaggcctccgaggcgtaaggggcttcggaggtgggngctacttatgacatgngatggactacaaataacttcaacactaagttccggaggacgggcctagtccaacttaccncgaagagaactaactaacgaaacgttacctaccgttttancgtaagaacaaaaacgtgaacccgtacgcctaggaacgaacccgaaggaacccgacgtacgtcgttcgtaactttagtcgtacggccgaagaacggtagaacgaaccaacgtaacccgaacttacgaacggtaactaacgttaacggtcgggttacgggttactttcgggttaccgggccggggtacccggaacgggttcccgtagggtaccctacggttcccgtaccccgtacccgtaccggaccccgttaaccccggaacccgggtaacccccggtacccgttaaccggtttccccccgggttacccctttccccccggggacggttcccccgtccccggtaccgg

SEQ ID NO: 22565 - DNA, 733 bp, Homo sapiens
  misc_feature: GYAE6OF01BXUQQ.12.40.D07.1.454.CMB.1.raw
  modified_base (241)..(241): a, c, t, g, unknown or other
  misc_feature (241)..(241): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggtactttcccttctaattttctattccatgcacgtcgggtccnccaggctccgaggccgaaggggctcggaggtgggtggctacttatgacacatgagtggactacaaactaacttcaacgactaaacgttccggaggacggggtcccagtttaccaacctactcctaccgaagaacgaaactaaacttaacaacgtaaaccttacccgtttaataccgtacgaactaaaagtacgtaacacgtaccgtaggaacaaccgacgtaaccgaccgtacgggtcttacgtactttaacgttagttcggaccgaggtaagaacggaacgtaaccaaccgtaaccgtaaccgtacgtaccggaaccttaaagtacgtagggttacggggttacgtttgggttacccggtcggggtacccgacggggtacccttagggtacctacgtcccgtacccgtaccccgcgtaccctaacccggaaccgacccgggtaccctcggttcccggttaccccttccccggcggtccccgcccgttccgg

SEQ ID NO: 22566 - DNA, 703 bp, Homo sapiens
  misc_feature: GYAE6OF01DT8QM.12.40.D07.1.454.CMB.1.raw
  modified_base (182)..(182): a, c, t, g, unknown or other
  misc_feature (182)..(182): n is a, c, g, or t
  modified_base (350)..(350): a, c, t, g, unknown or other
  misc_feature (350)..(350): n is a, c, g, or t
  modified_base (405)..(405): a, c, t, g, unknown or other
  misc_feature (405)..(405): n is a, c, g, or t
  modified_base (463)..(463): a, c, t, g, unknown or other
  misc_feature (463)..(463): n is a, c, g, or t
tcagatacgacgtacacgaccggtgctcgattttagtgatagagcgtaacaacagagggctcaccatggagtttgggctgagctgggttttcctcgttgcttcttttaagaggtgtccagtgtcgaggggcacctggtggagtcgtgggggagccgtggtccagccgtgggcgtccctgacnctcgcctgtgttcgcctctggtacttttcccttactaattttctattccagtgcctacgtcgggtcccgccaggcctccgaggcgaacgggggctcggaggtggggtcgactactttatcgacactagtgagtcggactacaaactaattcacgactaacgttccggnggacgggcctattcactctcacaagacaactaataacaacgtaacctacctttanctagaactaaaagtacgaaccacgtccgtagaaccgaaccaaggaccgacgtccggtntacgttacttaagttacgttcggacgacggaagaacgtaacgaaccgaaccaaccgaacccttacgtacggtaacctaagttacgtacgggttacggggttctttgggttccggccggggaccggaccggggtacctcgggtctaccgttccgtcccctcccgtaccgtaccccacccgaacccggaccggtcccgtacgttccccggttccccgttcccccggcgtccccgtcccgtcg

SEQ ID NO: 22567 - DNA, 585 bp, Homo sapiens
  misc_feature: GYAE6OF01A6H3Z.12.40.D07.1.454.CMB.1.raw
  modified_base (151)..(151): a, c, t, g, unknown or other
  misc_feature (151)..(151): n is a, c, g, or t
  modified_base (210)..(210): a, c, t, g, unknown or other
  misc_feature (210)..(210): n is a, c, g, or t
  modified_base (317)..(317): a, c, t, g, unknown or other
  misc_feature (317)..(317): n is a, c, g, or t
  modified_base (368)..(368): a, c, t, g, unknown or other
  misc_feature (368)..(368): n is a, c, g, or t
  modified_base (506)..(506): a, c, t, g, unknown or other
  misc_feature (506)..(506): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtggtggagtctgggggganccgtggtccagcctgggcggtccctgacactcgcctgtgttgcctctggattttccctnaatttctattccatgcactgggtccgccaggctccaggcaaggggctcggagtgggtgcacttatgcacatgatggcgtacaaacaaattctaacgctaaattccgngaggggcctattcaccatctccagagacaattacaagaacctaccctttanctgacaaatgacagcctgaacgaccagaccgacgacgctgtctattattgcgcgagagagacacacgaacctacgtgacctaactacgtagttcgggggtcttcggttcgcggggtcccgaggggtacccctggtacncgttccgtcctccccgcgccctacccgaccgacggccctacgtcccggttcccttcccccgtcgccctccccgtccccg

SEQ ID NO: 22568 - DNA, 823 bp, Homo sapiens
  misc_feature: GYAE6OF01BQ6RB.12.40.D07.1.454.CMB.1.raw
  modified_base (241)..(241): a, c, t, g, unknown or other
  misc_feature (241)..(241): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcgtccctgacactcgcctgtgttgcctctggtactttcccttctaatttctattccatcgcacgtgggtcccnccaggcctccgaggcgaaggggctcggaggtggggtgactactttagttgcaacagtgagtggcgttacaaactaaattccaacggctaaacgtttccggaggacgggggaccctatttacccaccgtattcccgtaccgaaggaacgtaacctaaaatttaacccgaaaacgtaaacccttaacccctttttaagcccttaaggaacctaaaaagttacgacaacggtccctaagaacgtaacccgaggaaccgaccgacggtccttagttacttaatttagttcgccgtacggaagtaacggaacgaaccgtaaccgaaccctaaacccgttaccgtacggtaaccctaaacgtaacgttacgggttcggggtaccgttttacgggtttaccgggtacggggggaccccgtaacggggggttaccccttggggtaccctacggttccccgtccccttaccccccggacgtacccccgttaaccccggaacccggtaaacccgggtcccccgtaaccggtttccccgggttacccccccgttttaccccccggtacggggtcccccgtccccggtcccggg

SEQ ID NO: 22569 - DNA, 816 bp, Homo sapiens
  misc_feature: GYAE6OF01EC55Z.12.40.D07.1.454.CMB.1.raw
  modified_base (255)..(255): a, c, t, g, unknown or other
  misc_feature (255)..(255): n is a, c, g, or t
tcagatacgacgtacacgaccggtgctcgatttagtgatagagcgtaacaacagaggactcaccatggagtttgggctgagtcttgggttttcctcgttgcttacttttaagaggtgtccagtgtcgaggggcacgtgggtgagtcgtggggatccggtggtccacgtccgtgggccgtccctagaccacgtcgcttgtgttcgcctcgtgttactttcctatattctactccagtcgcgtacgtcgggtacccncgtagcctacgaaggcggaacgggtcctagggagggttggggtactacgttaccttaggtcactactagtgtaaggttcggaacctaactaaacttaacgttaccgtaacgtaacgtaacggttcggtaacgggacggggtacccttacgtaaccgacctacgttaccaccggtaagaacgtaaacctaacgttaaaacgaaccggtaaaccctttaaccttactacgtaacgtaaacgtaaactacggacccgtaacggtacctaaggtaacgacccgaaactacggaccggacgttcgtacgttactagttacgcgtacgtaacgagaacgtacaaccaacgacccgtaaaccgtcgaacgttaaccacgttagtaccgggtacggtcgtttcgggtaaccggtacggggaccggtacccgggtaaccttcggtacctacggttacccctaccccggtacggaacccgttacccggaaccccgtaacccggacccggtcccgtttacccgggtaccccttttacccccggccccgttaccggtcccgcccggttacccg

SEQ ID NO: 22570 - DNA, 853 bp, Homo sapiens
  misc_feature: GYAE6OF01DB8A1.12.40.D07.1.454.CMB.1.raw
  modified_base (216)..(216): a, c, t, g, unknown or other
  misc_feature (216)..(216): n is a, c, g, or t
  modified_base (745)..(745): a, c, t, g, unknown or other
  misc_feature (745)..(745): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcgaggggcacctgggtggagtcgtgggggagccgtggtccagccgtgggccggtccctgacactcgcctgtgttcgcctctggtactttcccttntaatttctattccatgcacgtcgggtccgccgacggtctccgaggcgaaggggcctacggaggtgggtggactacgtttagttcgacaacgtagtgagttcgggacgtaacctaaaactaacttaccgtaaccgtaacgttaaacgttcccggggtagggaacgggggtacccttaactttacccaaccctattacccgtacgtaaaggtaacgtaaacctaaacgttaaaccaaacgtaaaccctttacccctttaagtacctaacgtaaacctaaaacggtacgaaccgtaccggtaccgtacggaaaccgtaccgaaacgggtaaccgacccgtaacggtccttaaggttacctttaaagttcgttacggccggaacgaacggtaagaacctaaccgaacctaaacccgtaaccgttaccggtaacggtaacctaaagtttcggtaagggtccgggtttacgtttgggttaccggcggggtacccgtaacggggtccctacggtacacccggtttccgtaaccccncccggtaaacctccccctaacccggtaacccgggtacccgggtaccctttacccggtttcccccggttacccccgtttaccccggcggcccccgtcccggttaccggg

SEQ ID NO: 22571 - DNA, 821 bp, Homo sapiens
  misc_feature: GYAE6OF01CPSRN.12.40.D07.1.454.CMB.1.raw
  modified_base (219)..(219): a, c, t, g, unknown or other
  misc_feature (219)..(219): n is a, c, g, or t
  modified_base (305)..(305): a, c, t, g, unknown or other
  misc_feature (305)..(305): n is a, c, g, or t
tcagatacgacgtacacgaccggtgctcgatttagtgatagagcgtaacacagagggctcaccatggagtttgggctgagctgggttttcctcgttgcttcttttaagaggtgtccagtgtcgaggggcaccgtgggtggagtcgtggggggacgccggtggtccagccgtggggccggtccctgacactcgcctgtgtgcctcgtggtactttccctntaatttctattccatcgcgacgtcgggcccgcgacggcctaccgaggcgaaggggtctcgggaggtggggtgactattatgccaantgagtcggctacaactaatccgtaacactaaacgttccggtgggacgggtcctaacttccgacctactcctaccggaagtaacgaaaccttaagttaaaccaaaggttaacccttaaccccgttttaagtcgttaacgaaactaaagtaccgaactaccgaccgtaagaccgaaccgaacgacccgacgaccggtcttacgttacttacgttaggtcggaccggtaacgaggtaacggaacgtaacctaaaccgtaccccgtaaaccgtttaacggaccccggtaactaaacggtttaacggtaacggggttccgggggttacgttttaccggggttaccggggttaccggggggtcccgggtaaacggggtcccgttacgggtaccgttaccccggtccggttacccccgtaccccgtacccggtccccgtaacccggaaccccggtaacccgggaccccttccggtaccccggtttcccccctaccccgggtccgtcccccgtcccgtacccgg

SEQ ID NO: 22572 - DNA, 767 bp, Homo sapiens
  misc_feature: GYAE6OF01A8HJR.12.40.D07.1.454.CMB.1.raw
  modified_base (109)..(109): a, c, t, g, unknown or other
  misc_feature (109)..(109): n is a, c, g, or t
  modified_base (151)..(151): a, c, t, g, unknown or other
  misc_feature (151)..(151): n is a, c, g, or t
  modified_base (180)..(180): a, c, t, g, unknown or other
  misc_feature (180)..(180): n is a, c, g, or t
  modified_base (212)..(212): a, c, t, g, unknown or other
  misc_feature (212)..(212): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagatacgacgtacacgaccggtgctcgatttagtgatagagcgtaacaacagagggctcaccatggagtttgggctgagctgggttttcctcgttgctcttttaagnggtgtccagtgtcaggggcacctgggtggagtcgtggggganccgtggtccagcctgggcggtccctgacnctcgcctgtgttgcctcgtgacttttcccttnaattttctattccatgctacgtgggtccgcgaggcctccgaggcgaaggggtctcggaggtggggtgactactttatgactacatgagtcggacgtacaaacgtaattccaacgtactaaacgttccggtagggacgggggtacctatttaccgaccgtaattccgtaccgagaacgaactaaactacaaacgtaacctaccctttancgtanaactaaaatgaacacgtcctagacgtaacccagaacgaccgtacggtacttacgtacttaagttagttacggaccggtaacgaaggaacggtaacgtaaccgaaaccgtaaacccggtaaacccttacggtaaccggtaaccctaaagtaacggttacggttacgggggtacctttgggttaccgggtaccgggggtaccgtaacgggggaccccttgggtacctacgttaccggtacccgtaccccgtacgacccctaacccggtaaccccggaaccgggtaccctaacggttcccccgggttaacccctttcccccgggcggtccccgtcccgtacccgg

SEQ ID NO: 22573 - DNA, 745 bp, Homo sapiens
  misc_feature: GYAE6OF01BMG5H.12.40.D07.1.454.CMB.1.raw
  modified_base (109)..(109): a, c, t, g, unknown or other
  misc_feature (109)..(109): n is a, c, g, or t
  modified_base (179)..(179): a, c, t, g, unknown or other
  misc_feature (179)..(179): n is a, c, g, or t
tcagatacgacgtacacgaccggtgctcgatttagtgatagagcgtaacaacagaggactcaccatggagtttgggctgagctgggttttcctcgttgctcttttaagnggtgtccagtgtcaggggcacctggtggagtctggtgggagccgtggtccagcctgggcggtccctgacnctcgctgtgttgcctctggtactttcccttctaatttctacttccattgccacgttcgggtcccgccagggcctaccggaggtacgaggggtcctaggacggtggggtggctactttagttcgacacgatgagtcggtcgtaccaactaaacgttctaacgaacctaacgttcccgggtaggaacggggcctacgttaccgaacctacgtcctaccgagtaacgaactaaacttacgaaacgtaaccccttaccgtttatcgtacgaacctaaagttcgaactcgacctaggaaccgaccgtaaccggaacgcccgaaacgggtccttaggtactttaagttacgttcgaccgggacgtacgaagtaccgaaccacccggtaaacctacccgttacgtccgaacctaaagtcggaagggttcggggtctttaacgggtcgcgggggacgtcgggtacccgtggtcctaccgtccgtccccacccggtccgacccctacccgaccggaacccggtcccgtaccggttccccggttaccccgtcccccggtcggtcccccgtaccccg

SEQ ID NO: 22574 - DNA, 794 bp, Homo sapiens
  misc_feature: GYAE6OF01A3AO0.12.40.D07.1.454.CMB.1.raw
  modified_base (244)..(244): a, c, t, g, unknown or other
  misc_feature (244)..(244): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagccgtgggccggtccctgacactcgcctgtgtgcctctgtactttcccttctaattttctattccatcgctacgtgggtccnccaggcctccgaggcgaaggggctcggaggtgggtgctacttatcgacacagtgagtggactacaataacttcaacgtactaaagttccggaggacgggtacctattaccacctattcctaccaagaacgaactaaacttaaccaacgtaaaccttaccctttataccgtagaactaaaagtacgaacctagtacccgtaggaaccgaacccgaacggaaccgtaaccgtaccggtacgttacgtttactttaagttacgttacggaccggaacgtaaggaacgtaaccgaacgtaacccgaaacccgtaaccgtacgtaccgtaaccgtaaacgttacggtacgggttacggggttcctttacgggttaccggggtaccgggggtacccggtaaccgggggtacccgttacgggttaccgtacccgttacccgtccccgtaccccgtaccgtaccccccgtaaccgggaaccccgaaccgggtacccctaccgggttaccccgttacccccggttaccccggcccgggtccccgtccccgttacccggg

SEQ ID NO: 22575 - DNA, 685 bp, Homo sapiens
  misc_feature: GYAE6OF01D6ZGH.12.40.D07.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
tcagatacgacgtacacgaccggtgctcgattttagtgatagagcgtaacaacagagggctcaccatggagtttgggctgagcgttgggttttcctcgttgcttctttttaagaggtgtccagtgtcaggggcaccgtggtggagtcgtgggggagccgtggtccagcccgtgggacggtcccgtgacgactacggcctgtagttgcctntgtactttccctntatttctatccgatgcacgtggtccncgagtcctacgaggctaagggctacggaggtgggtgacctatttagtcggacagattggatggcttaccaaagtaattccgagactaagttccggnggacgggacattccaactntcgacaagagaactaagttacaacgtaactaaccttnctanacgtaaanggacgancctagaaccaacgacgaacgtacgcgtacctagtacttattacgagacgtcgaagagaagaaccaacaacgtaccctacgtaacgtactaacgtaacgtacggggtcggtaccgtttcggttccgggtacgggccggtaaccggggtacccttagggtacctacccgggtactaccccgttaccccgaaccggttcccaccccgaaccggacccggttcccgaacgtttccccgtacccgtacccgttccgggacctccccgacg

SEQ ID NO: 22576 - DNA, 876 bp, Homo sapiens
  misc_feature: GYAE6OF01ASER2.12.40.D07.1.454.CMB.1.raw
  modified_base (116)..(116): a, c, t, g, unknown or other
  misc_feature (116)..(116): n is a, c, g, or t
  modified_base (466)..(466): a, c, t, g, unknown or other
  misc_feature (466)..(466): n is a, c, g, or t
tcagatacgacgtacacgaccggtgctcgatttagtgatagagcgtaacaacagagggctcaccatggtagtttgggctgagcttgggttttcctcgttgcttcttttaagaggtntaccagtgtcgagggcacgtgggtggagtcggtagggggacgccggttggtcccaggccgttggggcccgtccctgacctaccgtccgtccgttggtgttcgccgttcgttggttaccttttcccttacttactttaccttattcccgagttacggacccgttacggttccgggtcccgaccgtacggtccgtaccgaacgggtccggaacgggggttcctacgggtaagggttggggtacctacccttagtttaactcgtaacacgtagtaggtacgtacggtaccgtaacaaaacgtaaccttcgaacgacgtaacgttccggtagggacggtacctacgtacacctntaccgtacaaggtaacctaataaacctaagaaccgttaaccttaccgttgacgtaaacgaacaaacgtacggaactaccgtaccgaagaaacccgacggtacgccgtaacgtccgttaagttacgttaacgttattaccggtacggaccgtaacgacggtaacgaaccggaaacctacggtaaaccgtaacccttaacggaacgtaaccttaaagttacgggttacgggttaacgggttcgtttacccggggttacgggcccggggtaccggtaaccggggtttccacgttacccgtcgtcccccgggttaacccacccggttccggacccctttaacccgggacccgttacccgtccccgttacccggttcccttacccggttccccgagggtcccctcggtaaccccg

SEQ ID NO: 22577 - DNA, 783 bp, Homo sapiens
  misc_feature: GYAE6OF01CXR8Y.12.40.D07.1.454.CMB.1.raw
  modified_base (216)..(216): a, c, t, g, unknown or other
  misc_feature (216)..(216): n is a, c, g, or t
  modified_base (246)..(246): a, c, t, g, unknown or other
  misc_feature (246)..(246): n is a, c, g, or t
  modified_base (443)..(443): a, c, t, g, unknown or other
  misc_feature (443)..(443): n is a, c, g, or t
tcagatacgacgtacacgaccggtgctcgatttagtgatagagcgtaacaacgagagggctcaccatggagtttgggctgagctgggttttcctcgttgctcttttaagaggtgtccagtgtcgaggggcaccgtggtggagtcgtggggggagccggtggtccaggccgtgggcgtccctgacactcgctgtgttcgctctggtactttcccttnaatttctattccatgccacgtcgggtcccncgagggtcctccgaaggcgaaggggtctacggagggtggggtcggactactttagtgcaagagtgagtggaccgtacaaaactaattccgaacgtactaaacgtttcccggtaggacggggtaccctaattccaaccgtattccgtaaccgaagacgtaaacctaaagttaaccaaacgtaaccttacccgttttancttaagaactaaagtacgaacgtacgcctaaggaacgtacccgaaggacccgtacgacggtcttacgtacgttaattacggttcggtacggacgaaggacgacgaaccgaaccgtaaccgaaaccgtacggtacggaacctaaacgtaacggtacggttacgggggtacttttacgggttcggtacggggtaccggtaaccggggtaccgtacggtaccgtacgttccggtacccgttaccccgtacggaccccttaacccggaacccggaacccgggtaccccgtccggttaccccggttaccccgttcccccgtaccggtccccgtcccggtacccgg

SEQ ID NO: 22578 - DNA, 699 bp, Homo sapiens
  misc_feature: GYAE6OF01C1WTU.12.40.D07.1.454.CMB.1.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (355)..(355): a, c, t, g, unknown or other
  misc_feature (355)..(355): n is a, c, g, or t
  modified_base (429)..(429): a, c, t, g, unknown or other
  misc_feature (429)..(429): n is a, c, g, or t
  modified_base (477)..(477): a, c, t, g, unknown or other
  misc_feature (477)..(477): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctggtggagtctggggggagccgtggtcccagcctgggacggtcccgtgacgacctacggcctgtagttgcctctggtacttttccctanaacttttctattcccattgccacgtcgggtccnccgaggcctccgaggcgaaggggctcgtaggtgggtgactactttatgcatatgatcgggactacaaaactaattccgtaacgactaaaacgtttccgggnggaacgggggcctaattcccacaacttcgacccgaagaactaacgttaacacgaaacctaccttacctttaganactaaaacgtagaacgacgaccgtcgtaaggaccaccggaagaaccgngacttcgttacgttaattagttcgtcgtacgaggtaagacgtaacacaaccgtaaccacgttacgactaacgtaacgtacgtacgggtacgttcgttgtccgggttacggaccgggtaaccgtcggtaacgccgttaccgtccgtacccgaccgtcctacccgacgacccggacgtcccgtaaccgtcccttacccggttccgcgttaccccgcgtacccgg

SEQ ID NO: 22579 - DNA, 813 bp, Homo sapiens
  misc_feature: GYAE6OF01BL6XX.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggaacctggtggagtcgtgggggagccgtggtccagccgtgggcgtccctgacactcgcctgtgttgcctctggactttcccttctaatttctattccatgacctacgtgggtccgcgaggcctccgaggcgaaggggctcggaggtgggtgctacttagtgacaactagtgagtcggacgtacgaaaacgtaattacgtaaccgactaaaacgtttccggtaggacggggccgtaactttaccaacctaacgttcctaccgaagaacgtaaacgtaaactttaaacggaaaacctaacccgttaaacccttttaacgtaccgtaagtaaacctaaaaagttaacgaaccgaacgtaccgtacggaaacgtaacccgaaaggtaacccgaaccgtacgggtaccgttacgttaactttaacgtttaacgttccgggaccggtaaccggtaaaggtaacgaacggtaaccaacccgtaaccgtaaacccgtaccgtaccgggaacccttaaagttaccgtaagggtcggggttacttgggttaccggtcggggacccgtaccgggggacccgttgtacgtacgtcccgttcccacccgaccgtaccctaacccggaacccggtaacggaccccctaccgttcccggtacccccgtttcccccgagggtcccccctcgtccgtaccccgg

SEQ ID NO: 22580 - DNA, 1064 bp, Homo sapiens
  misc_feature: GYAE6OF01ESM42.12.40.D07.1.454.CMB.1.raw
tcagatacgacgtacacgaccggtgctcgatttagtgatagagcgtaacaacagagggctcaccatggagtttgggctgagcttgggttttccttgttgctattttagaaggtgtccagtgtgaggtgcagctggtggagtcgtgggggaggtcttggtccagccgtcggggggtccctgagagtctcctgtaccaacctcgtggtattctagttgtttagtagtctagttggataggtaacgtcggggtcccgtaccgaggtcctacccgggaaggggggaacggggtcggtaggggtacgggttggggggtaccggacccgaaaactaaacgtaaaaacggaccgtaaaaggtaggtaaggggtaaaggttaacggaaaaagtaaaaacgtttaacgttaaggtttggggttaacgggtaacccgtttcggtaggggttaacggggtaaaccgggggtacccgttaactttaccgaaaaccgttaaccgttaccctaacccggaaaggaaaccgaaaccccgaaaacccggaaccccgtaaaaacgtaaaccccgtttaccaaaccgtttacggttaaaccttaccggtaaacgtaaaacccgtaaaaaaaacgtaaaacccgaaccggtaaccccggttaaaacggaaaacccgggaccccgggaaaacgggtaaccccggtaccgggttacccgtttagggtttaacgttttaaccgttttccggtagggttaaccgggaaccgggttaacccgggtaacccggtttacccgggttaacgggttaacgtaaaaccttttaaacgttttaaccgtaaacccgtaaaaacccgtacgttaaaccgtttaaaacggtttccccggtaacccgtaaccccggtaaaccgttccccggttaaactaacccttaacccggttttaacgttaccggaaccggtaccgggtaccggggttaacccggggacccggttaaacccggggttaccccgtccgggttaacccccgtcccgttcccttacccgacgtaccccgtcccccgtaaccgaaccccgggtaccccgg

SEQ ID NO: 22581 - DNA, 760 bp, Homo sapiens
  misc_feature: GYAE6OF01CJ77P.12.40.D07.1.454.CMB.1.raw
  modified_base (255)..(255): a, c, t, g, unknown or other
  misc_feature (255)..(255): n is a, c, g, or t
  modified_base (322)..(322): a, c, t, g, unknown or other
  misc_feature (322)..(322): n is a, c, g, or t
  modified_base (372)..(372): a, c, t, g, unknown or other
  misc_feature (372)..(372): n is a, c, g, or t
tcagatacgacgtacacgaccggtgctcgatttagtgatagagcgtaacaacagagggctcaccatggagtttgggctgagcgtgggttttcctcgttgcttcttttaagaggtgtccagtgtcgagggcaccgtggtggagtcgtgggggacgccgtggtccagccgtgggccgtccctgacacctcgcctgtgttcgtcctcgtaggtactttccctacttaatttctattccagtcgacctcggtcggtccnccgaggcctacgacggcgagggtctcggaggtcgggtgctacttagtcgacacagtgagtggactanaaactaattcgaacgaactaacgttcgacggtagggcctaattccgaacncgttacaccgtaggaacaaactaacttaacgaacgtaaaccccttaccgttataccgagaaactaaacgtacgaacgcgtaaccgtagaccggtaccaaagtaccgaacgtacggcttagttaccttaatacggtcgaccggaacgaaggacgtaccaaaactacccggaaactaacccgttagccggtaacctaacggttaacggtacgggttcggggttcccttaacgggtttcggtaacccggggaccgtaaccggggttacccgtccggttgtaaacccgttccggaaccccttcccgtaccgaaccccgttaacccacccgggtaaccggtaaccctcccgggttccccgtttaccccgccggcgtccccgttacccgcccgg

SEQ ID NO: 22582 - DNA, 755 bp, Homo sapiens
  misc_feature: GYAE6OF01EJ752.12.40.D07.1.454.CMB.1.raw
  modified_base (151)..(151): a, c, t, g, unknown or other
  misc_feature (151)..(151): n is a, c, g, or t
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
tcagatacgacgtacacgaccggtgctcgatttagtgatagagcgtaacaacagagggctcaccatggagtttgggctgagcttgggttttcctcgttgctcttttaagaggtgtccagtgtcagggcacctggtggagtcgtgggggacnccggtggtccagccgtgggcgtccctgacactcgcctgtgttgcctgtggtacttttccctntaatttctacttccatcgctacgtcgggtcccnccgnggcctccgaggcgaaggggcctcggaggtcggggtgactactttatgaccactagtgagttcggaccgtacaaaccttaaattccctaacgacttaaaacggtttcccgggagggaaccggggtcctaacttccgaaccctattccctaccgaaggtaataaccgtaaattaaccgaaaccgttaacctacccgtttttaanaccgtanaaaccgtaaaatacgaaccgacgtacccgaggtaaccaacccgacgaaccggacctaccggcttcgtaacttagttacgtcgacgtaccggaagacgaacgtaaccaaccgtaacgtaaccgtacgacggtaacctaaacgtacggtagggtacgggttactttacgttccgggtacgggtaccgtaccgggtaccgttcggtactaccgtaccgtacccgttcccgactacccgaccgaacccggtaccgccctaccggttcccggtccctcccccggcggtcccgcccgtccgg

SEQ ID NO: 22583 - DNA, 653 bp, Homo sapiens
  misc_feature: GYAE6OF01CCWQP.12.40.D07.1.454.CMB.1.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggactttccctnaattttctattccatgcacgtcgggtccncaggctccaggcaaggggctcgagtgggtgctacttatgcacatgatggcgtacaactaattctacgcaaattccgtgagggccattcacctatctcagagacaattacaaacgtaacctaccctttaatctagaccaaagtacgaacacgccctagaacgaccgtaaggacgtaaccacggctacggtacttaacgttagttacggacgacggaaacggagtaacggacctaaccgaccgtaaacctaccgtaccggacctaaagtacgttaggtacggggtgttcggttccgtcggggacggacggggaccctgggtacacgtcccgtcctaccccgaccgtccctacccgacccgaccgggcccctacggtcccggttacccttccccccgtcgggacccgcccgtacccgg

SEQ ID NO: 22584 - DNA, 749 bp, Homo sapiens
  misc_feature: GYAE6OF01BNTK2.12.40.D07.1.454.CMB.1.raw
  modified_base (212)..(212): a, c, t, g, unknown or other
  misc_feature (212)..(212): n is a, c, g, or t
tcagatacgacgtacacgaccggtgctcgatttagtgatagagcgtaacaacagagggctcaccatggagtttgggctgagcttgggttttcctcgttgctcttttaagaggtgtccagtgtcaggggcacctggtggagtcgtgggggagccgtggtccagccgtgggcgtccctgacactcgcctgtgttcgcctctggtactttccctntaatttctattccatcgctacgtcgggtcccgccgaggtcctccgagggccgaagggggcctacggaggttggggtggtacctattttagtgccaactagtgagtggctacaaactaattcaacgactaaagttccggtagggacggggtacctattaccaacccgtacttcctaccgaaaggtaccgaaactaaaacgttaaccaaaacgtaaacccttaccgtttaatacgtacgaaactaaagtacgacctaacgtacctagaacgaaccgagaaccgacgacggtcttacgttacttaagtttacgtacgaccgtacggaaagaacgacgaaccgaacgaaacccgtaaccgtacgtacgaacctaacgtacgtacggtacggggttacttcgggttaccggacggggtaccgacggggttaccctcgggtctaaccggtcccgaccctaccccgagtcccctacccgtaacccgggaccgtacccgttaccgtcccggttaccccttccccggcggtccccgtcccggtacg

SEQ ID NO: 22585 - DNA, 813 bp, Homo sapiens
  misc_feature: GYAE6OF01EYA08.12.40.D07.1.454.CMB.1.raw
  modified_base (150)..(150): a, c, t, g, unknown or other
  misc_feature (150)..(150): n is a, c, g, or t
  modified_base (174)..(174): a, c, t, g, unknown or other
  misc_feature (174)..(174): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
tcagatacgacgtacacgaccggtgctcgatttagtgatagagcgtaaacaacagagggctcaccatggagtttgggctgagctgggttttcctcgttgctcttttaagaggtgtccagtgtcaggggcacctggtggagtctggggganccgtggtccagcctgggcgtcccngacactcgcctgtgttgcctctggactttccctnaatttctattccatgcacgtcgggtccnccaggctccgaggcgaagggctcggagtgggngcacgttattgcacgatgactggcctacaactaaattcgnaaacgtcctaagttccgggngttcgtacgggacccaacgttctacccctaagacgtaccgaacttaagtaaacctaaactaaccctttaaacgttaaacacccgtttacgtaaaactaacggtaccaaaaacgtaccggtaacaccgggtaaccccgtacggaaacgggaaacccgaaaccgggtaaccggaaccgtttaaccggtacctttaacgtttacgtaacggttaaccgtacggtaacggacgggaaactaaccggtaaacccgaaacccgtaacccgttaacgggaaccctaaaccttaacggtaaccgtaggggtaaaccggtttacggttcgggttaccggggttaccggtaccgggtaccggggtaccggttaccgggacgttaccggtaccgtacccgtccggttccccgtaccccaccggtacccgggccccgtaaaccgtcccggggtacccctccccgttacccgggtccgttaccccccgtcggtacccg

SEQ ID NO: 22586 - DNA, 785 bp, Homo sapiens
  misc_feature: GYAE6OF01D24X0.12.40.D07.1.454.CMB.1.raw
  modified_base (150)..(150): a, c, t, g, unknown or other
  misc_feature (150)..(150): n is a, c, g, or t
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (427)..(427): a, c, t, g, unknown or other
  misc_feature (427)..(427): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcagggcacctggtgagtcgtggggganccgtggtccagcctgggcgtcctgacactcgctgtgtgcctgtgtctttcctntaatttctattccatcgctacgtcgggtccnccgaggtcctcgaggcgaacggggctcggaggtggggtcgactaactttagtcgcactagtgagtcggtacgtaacaaacgtaacttctaacgactaacgttccggaaggtcggggacctactccacctcttaccgtacaagacgtaaacttaaaacttaaccgaaaacgttaaaccccttacccgttttaanaccgttaacggaaacctaaaagtacgaaccgtacgtacccgtagaacaacccgtagaaccgacgtaccggttcttacgttaacgtttaatttacggtacgaccggaacggtaagacggtaacgacctaaccgtaaccgtaacctacggtacgtaacctaagtttacggtagggtttcggggtaccttttagggttcccgggtacggggaacccgttacggggtacccttaggttacctaccggttccccggtaccctaccccgggacttacccccgaacccgtaaaccggaccgggttccccttaccggtttccccggtttaccccgtcccccggcggtcccccgttccgtacccggg

SEQ ID NO: 22587 - DNA, 613 bp, Homo sapiens
  misc_feature: GYAE6OF01BF4Y9.12.40.D07.1.454.CMB.1.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtatttcccttnaatttctattccatgcactgggtccnccaggctccaggcaaggggctcggagtgggtggcacttattgcacatgatggcgtacaaactaaattctacgactaaacgttcccggtaggacgggggcctattcaaccctatcctaccagagtacaattaacaaagtaacctaccctttaatccgtagacaaaatagacaagtcccgtagagaacccagaccgacgacggctgtactattattgcgacgagacgagacacgaacgaacctagtacgacctaatacgtagtggggtacttgtcgtacgggaccgacgggacctggtcacgtccgtcctccccgacgtccctaccgaaccgaccgggtaccctacgtcccgttcccgtcccccgtcggcccgcccgtcg

SEQ ID NO: 22588 - DNA, 769 bp, Homo sapiens
  misc_feature: GYAE6OF01A31FM.12.40.D07.1.454.CMB.1.raw
  modified_base (204)..(204): a, c, t, g, unknown or other
  misc_feature (204)..(204): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtgggtggagtcgtggggggagccggtggtccagccgtggggccggtccctgaccactcgcctgtgttgcctntggtactttcccttctaatttctattccatgcacgtcgggtcccgccaggcctccgagggacgaagggggctcggaggtcggggtggctactttattcgacactatgagtcggaccgtacaaactaaattcacgtactaaacgttccgaggacggggtcctacttaccgacctatacctaccgaagaacgaacctaattaaccaaacgtaaccttacccgtttatctacgaacaaagtacgacacgcctaagaaccgaccgaacgaaccggaacctacggtacttacgttacttaagtttacgtcggccggagaagaaggtacgaaccgaaccaaccgtaacctaccgtacggaactaacgtaacgtagggttacgggtacgttttcgggttccggttaccgggggaccgtaccgggggtaccccgttaggtacccgtacgttcccggtaccccgtaccccggtaccgtaccccgtacccggaaaccccggtacccgggtaccccctacggtttacccccgggttccccgtttaccccccggcgggtcccccgtccctacccggg

SEQ ID NO: 22589 - DNA, 875 bp, Homo sapiens
  misc_feature: GYAE6OF01BK3Q0.12.40.D07.1.454.CMB.1.raw
tcagatacgacgtacacgaccggtgctcgatttagtgatagagcgtaaacaacagagggctcaccatggagtttgggctgagcttgggttttcctcgttgctcttttaagaggtgtccagtgtcaggggcaccgtggtggaggtcgtggggggagccggtggtccagccgtgggccggtccctgaccactcgcctgtgttcgcctcgtggtacttttcccttactaattttctacttccatcgctacgtcgggtcccgaccgaggtcctccgacggaccggaacgggtcctcggaggtgggtcgacctactttagtcgacacgtatggagtcggtaccgtaacaaactaaacttacaaccgtaactaaacgttccggtagggccggggtaaccctactttacccaacctacgttaccaccgtaagaacgtaaacttaaaacgttaaccaaaacggttaaacccttaacccgttttaataccggttaacaaaccgtaaaaacgttacgaaaccgacgtaccgtaacggaaccgtaaacccgaacggtaaccgaaccgtaccggttacgttaccgtttaacgttaacgtttaacgtccggaaccggtacgtaacggaaacggtaaccaacccgaaacccgtaaccggtaaacccttacgtaaccgaacctaaacgttacggtacgggttcgggttaccgttacgggttccgggtaccgggacccggtaaccggggtcccgttagggtacccttacgtaccccggttacccctacccggtaccctaaccccggtaccgaaacccgggtacccgggtccctaaccgggtttcccccggtaccccgttccccggccgggtacccccgttccgtaccccgg

SEQ ID NO: 22590 - DNA, 792 bp, Homo sapiens
  misc_feature: GYAE6OF01AI43I.12.40.D07.1.454.CMB.1.raw
  modified_base (211)..(211): a, c, t, g, unknown or other
  misc_feature (211)..(211): n is a, c, g, or t
  modified_base (457)..(457): a, c, t, g, unknown or other
  misc_feature (457)..(457): n is a, c, g, or t
  modified_base (483)..(483): a, c, t, g, unknown or other
  misc_feature (483)..(483): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagccgtgggcggtccctgacactcgcctgtgtgcctctggtactttccctntaatttcattccattgccacgtgggtccgccaggcctccgaggccgaagggggcctacggaggttcggggtggacctacgtttagtggaccacgagttggattcggggactacgaaaactaaacttttcgaaccgtcctaaaagtttcccggtagggacggggcccttaatttcccgaactagtttcccaccgtaaggtaccgtaacgtaaaacttaaccgaaacgtaaacccttacccttttacncgtacgtaaccaaaagttacgaaccnggtcccctaaggaccgaacgtaacggacccgtaaccgacggtacgttacgtttaccttaagttacttcggaccgtacgaagggaacgaacgtacccgaacgtaaacccgtaaccgtaccgtacgtacccgtaattaccgttagggttaccggggttctttacgggtaccggtcggggacccggtaccggggtcccgttaggccttacgtccggttcccacccccgtacgtccccgtacccgaacccggaaccgggtcccctacgttcccgggttaccccttcccccggtacggccccgtcgtaccccgg

SEQ ID NO: 22591 - DNA, 712 bp, Homo sapiens
  misc_feature: GYAE6OF01A9M89.12.40.D07.1.454.CMB.1.raw
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcacgtcgggtccgccaggctccaggcaaggggctcgagtgggtgcacttattgcacatgatggcgtacaaactaaattctaacgactaaacgtttccggtaggacgggggccgtaatttaccacctattcctaccgaagacgaacctaaattaaccaaacgtaaaccttaacccgtttatactacgaacaaattacgaacacggcctagaacgaaccaacgaccgaacgaccgggcttggtacttatttacgtcgacgacggagtaacgaacgacaaccgaaccgtaaaccctacgtaccggaaccaagttaaccgtaggttcggggtctttcggttcggtacgggggacccggtacgggggtacccgtcgggttaccgacgttccgttcccgtcccccgaccgtcccgtacccaacccggtaccgggtaccccgtacggttccccggttccccgttcccccggtacggccccgtcccgtcgtaccccg

SEQ ID NO: 22592 - DNA, 688 bp, Homo sapiens
  misc_feature: GYAE6OF01B9M4V.12.40.D07.1.454.CMB.1.raw
  modified_base (299)..(299): a, c, t, g, unknown or other
  misc_feature (299)..(299): n is a, c, g, or t
tcagatacgacgtacacgaccggtgctcgatttagtgatagagcgtaacaacagagggctcaccatggagtttgggctgagcttgggttttcctcgttgctcttttaagaggtgtccagtgtcaggggcaccgtgggtggagtcgtggggggagccgtggtccagccgtgggcggtccctgacactcgcctgtgttgcctctggtacttttcccttactaattttctattccatcgcacgtcgggtccgccgaggcctccgaggcgaaggggctcggaggtggggtgctacttatgcanatgatggactacaactaattctacgactaagttccggaggacgggacctattccaacctactcctacaaggacaactaaacttaacgaaacgtaacctacccttaatctacgaactaaaatacggaacacgtaccgtagaacgaaccgaagaaccgacgacggtactcgttacttaattacgttgcgagagaacggacgaaccaaccgaaccgtaaacctacgtacgtaacctaaagttacgtaggttacggggtctttgggtacgggtacgggacccggtacgggtaccgtcggtactcgttcccgtaccctacccgaccgtccctaacccgaacggaccggtacccctcggttccccgtacccttccccggcggccccgtcccgtcg

SEQ ID NO: 22593 - DNA, 699 bp, Homo sapiens
  misc_feature: GYAE6OF01DDVR2.12.40.D07.1.454.CMB.1.raw
  modified_base (190)..(190): a, c, t, g, unknown or other
  misc_feature (190)..(190): n is a, c, g, or t
  modified_base (255)..(255): a, c, t, g, unknown or other
  misc_feature (255)..(255): n is a, c, g, or t
  modified_base (316)..(316): a, c, t, g, unknown or other
  misc_feature (316)..(316): n is a, c, g, or t
  modified_base (636)..(636): a, c, t, g, unknown or other
  misc_feature (636)..(636): n is a, c, g, or t
  modified_base (641)..(641): a, c, t, g, unknown or other
  misc_feature (641)..(641): n is a, c, g, or t
  modified_base (652)..(652): a, c, t, g, unknown or other
  misc_feature (652)..(652): n is a, c, g, or t
  modified_base (658)..(658): a, c, t, g, unknown or other
  misc_feature (658)..(658): n is a, c, g, or t
  modified_base (686)..(686): a, c, t, g, unknown or other
  misc_feature (686)..(686): n is a, c, g, or t
  modified_base (691)..(691): a, c, t, g, unknown or other
  misc_feature (691)..(691): n is a, c, g, or t
tcagatacgacgtacacgaccggtgctcgatttagtgatagagcgtaacaacaggggactcaccatggagtttgggctgagcttgggttttcctcgttgcttcttttaagaggtgtccagtgtcgaggggccaccgtggtggagtcggtggggggacgccgtggtccaggccgtggggccgtccctgacnctcgctgtgtcgcctgtagtactttccctataatttcctattccagtgaccacggtgggtccacnggtcctacgagggacgtaacggggcttacggagggtggggtgaccttactttagtgaccanagtgagtcgggcttaacaaactaacttacgtaacgtaacgtaaaacgtttccggaggaccggggtacctaacgtttaccaacgtaacttccgtaacacggaaactaaactaacgttaaccaaaacgttaaacccttaccttttagtacgttacgaaactaaagtacgacgaacgtaccgagaaccgaaccgaacgaccggaccgtaacggtccttaggtacctttaagttagtacccggaggagtaacgaggaacaccgaacgtaacgtaacgtcacgtaccaattcgaggtgggcttaggtcgcgggtaccgaggtccncgtanctccgtcaccncgtacncgaacgtcggactcgacggcccttccgngaccncctgaccg

SEQ ID NO: 22594 - DNA, 816 bp, Homo sapiens
  misc_feature: GYAE6OF01B2MG1.12.40.D07.1.454.CMB.1.raw
  modified_base (151)..(151): a, c, t, g, unknown or other
  misc_feature (151)..(151): n is a, c, g, or t
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
tcagatacgacgtacacgaccggtgctcgatttagtgatagagcgtaacaacagagggctcaccatggagtttgggctgagcttgggttttcctcgttgctcttttaagaggtgtccagtgtcagggcacctggtggagtcgtgggggganccggtggtccagccgtgggccggtccctgacactcgcctgtgttcgcctctggacttttccctataattttcctattccatgcctacgtcgggtcccncaggcctccgaggcgaagggtctcggaggtgggtgctattatgcantgagtggctacaaactaattccaacgactaaagttcccggtggaacggggtccattcccgaacctcgtcctaccgaagaacgtaaacgtaaacttaacgaaacgttaaacccttacccgtttataccctagaactaaaacgtagtacctaggtacccaggaaccgaaccaacggaaccgaaccgaacggtaccgttacggtttactttaacgtttacgttccggaccggtaacggaacggtaacggtaacgaaccgaaaccgtaaacccgtaaacccgttaaccgtaccggaaccgttaaacgttacggttaacgggttacgggggtttccgtttacggggtttaccggtaccggggtaccgggtaccggggtaccccgttacgggtaccgttaccggttcccggtcccccgttaccccgacccgttaccccgtaccccgaacccggtaccggtccccggtaacccgtttccccgggttaccccctttacccccggtcccggtccccgtccccgtacccgg

SEQ ID NO: 22595 - DNA, 783 bp, Homo sapiens
  misc_feature: GYAE6OF01A9CFR.12.40.D07.1.454.CMB.1.raw
  modified_base (186)..(186): a, c, t, g, unknown or other
  misc_feature (186)..(186): n is a, c, g, or t
  modified_base (335)..(335): a, c, t, g, unknown or other
  misc_feature (335)..(335): n is a, c, g, or t
  modified_base (756)..(756): a, c, t, g, unknown or other
  misc_feature (756)..(756): n is a, c, g, or t
tcagatacgacgtacacgaccggtgctcgatttagtgatagagcgtaaacaacagagggctcaccatggagtttgggctgagcttgggttttcctcgttgcttcttttaagaggtgtccagtgtcgaggggccaccgtggtggagtcgtgggggagccgtggtccagcctgggccggtccctgacnctcgctgtgtgcctcgtgtactttcctctaatttctattccatgctacgtcgggtcccgccgacggcctccgagggaccgaaggggcttacggaggtcggggtcggaccttacgtttagttcgaccacgtagtcgagtcggaccgtaanaaacctaattccaacgtactaaacggttccgggtagggaccggggaccttacgttaccaacccgtacttcccgtaccgaaggactaaactaaacgttaaccgaaacctaaacccttacccgtttataccgaagtaacaattacgaaccctcgtaacgtaccgaactaaacccgaagacccgacggtacgcgttagttaaccttgttacgtacggccgaggtaaacggaacgacgtaaccgtaacccgtaacgtaaccccgtgaaccgtaactaaacgttgtacgggttcgggtacgtttcgggtaccggtccgggtaacccggtacgggttacccctgggtaacccttcggtccccgtcccgtaaccccgcgtacccgacccgaacccggtaccgtccccgttacgtccccggtttacccnccccggtaccggtccctccggtacccg

SEQ ID NO: 22596 - DNA, 871 bp, Homo sapiens
  misc_feature: GYAE6OF01A96GE.12.40.D07.1.454.CMB.1.raw
  modified_base (151)..(151): a, c, t, g, unknown or other
  misc_feature (151)..(151): n is a, c, g, or t
  modified_base (250)..(250): a, c, t, g, unknown or other
  misc_feature (250)..(250): n is a, c, g, or t
tcagatacgacgtacacgaccggtgctcgatttagtgatagagcgtaacaacagagggctcaccatggagtttgggctgagcttgggttttcctcgttgctcttttaagaggtgtccagtgtcaggggcaccgtggtgagtcgtggggganccgtggtccagccgtgggcggtccctgacactcgcctgtgttcgcctcgtggtacttttccctactaattttcctattcccatgctacgtcggggtccnccaggcctccgaagggccgaaggggctcggaggtggggtcgactacttagttcgcactagtgagtcggcgtaacaaaaccttaacgttaccgtaacggtacctaaaacgtttcccggtagggaaccggggtacccttaagttacccgaacccaacgtttaccgtacccgaaagggtaacaaccttaaaactttaaaccaaaaccgtaaacccttaacccgttttactaccgttaacggaactaaacgtaacgaaccgtacgtacccgtaggaacgtaacccgacgaaccgaaccgtacgtccgttacgttacttaagtttacgttacggaccggacgacggtaaacggaacgtaaaccgtaacgaaacccgtaaacccgttaaccgtaacggtaacccgtaaaccgtttaacgtaaccggggttacggggttacggttttaccgggtttccgggttaccgggggacccggttaaccggggtacccgttaggttacccgtaaccgttcccgtaccccgtacccgtaacccgtccccggtaccccgacccgggtaacccggtaccccgtaccgttcccggttaccccgttccccccgtccgggtccccgtccccgttacccgg

SEQ ID NO: 22597 - DNA, 689 bp, Homo sapiens
  misc_feature: GYAE6OF01D6UD3.12.40.D07.1.454.CMB.1.raw
  modified_base (240)..(240): a, c, t, g, unknown or other
  misc_feature (240)..(240): n is a, c, g, or t
  modified_base (416)..(416): a, c, t, g, unknown or other
  misc_feature (416)..(416): n is a, c, g, or t
  modified_base (651)..(651): a, c, t, g, unknown or other
  misc_feature (651)..(651): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcgaggggcaccgtgggtggaggtcgtgggggagccggtggtccaggccgtgggccggtccctgaccactcgcttgtgtcgcctctggtactttcccttataatttctattccgatgccngtcggtccgcgagcctaccgaggacgagggctcggaggtggtagctacttagtcgactacgagtgagtcggtcgtaactaaataacttacgaacgtaactaacgttcggaggacgggcctataccaccgtatactaccgaagactaacgtaactaacgaacgtaacctacctttanctacgaacaaatacgacacgcctaggacgaccgaagaccgacgtccggtacttcgtattacttgtcgacgaacgaagtagaccacgactaaaccggacctacgtacgactaagtacgttagggtaccgggttcttagggttccggacgggttacccggacgggtacgttacgacgttaccctcccggtaccctaccccggcttaacccccgacgtacccggacccggttaacccncccggttacccgtaccccttcccggcgcccgtccgtcg

SEQ ID NO: 22598 - DNA, 870 bp, Homo sapiens
  misc_feature: GYAE6OF01CQ8AH.12.40.D07.1.454.CMB.1.raw
  modified_base (182)..(182): a, c, t, g, unknown or other
  misc_feature (182)..(182): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcacctggtggagtcgtgggggacgccgtggtccagccgtgggccgtccctgacnctcgctgtgttcgcctctggtactttccttctaatttctacttccagtcgccgtacgtcgggtcccgccgacggtcctaccgacggcggaacggggtctacggtagggtggggtcggacttacgtttagttcggacaacgtagtacggtagtcggggtacctaacctaaaacgttaaacgtttaccgtaaccgtaaacctaaaacggtttcccggggtagggaccggggtacccgtattacccgaactacgttcccgaccgaagaacgtaaccttaaacgttaaaccgaaaccttaaacccttaacccgttttacgtacgtaacgtaaaccaaaagttaccggaacctaacggtacccgaggtaaccgaaccgaacggaaccggaccgacggttcgtacgttacttagttacggttcggacgtaccggaaaggtacgaaccgaccgaaccgtaaacccgtaaccgtccggtaacggaaccgtaacgttacgggttacggtacggggttcgtttacgggttaccgggtaccggggtacccgggtaccgggtaccggtacggttccgtaccgtcccgttaccccgtaccccgccgtaccccgtacccggaacccggtaccccgggtcccttaaccgggttcccccgtttacccccggtcccggtacccggtcccgttccccggtacccgg

SEQ ID NO: 22599 - DNA, 865 bp, Homo sapiens
  misc_feature: GYAE6OF01CAE8M.12.40.D07.1.454.CMB.1.raw
  modified_base (209)..(209): a, c, t, g, unknown or other
  misc_feature (209)..(209): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagccgtgggcggtccctgacactcgcctgtgtgcctctgatttccctntaatttctattccatgcacgtggggtcccgccaggcctccgaaggccgaaggggcctcgaggtcggggtcgactacttagttcgcacagtagagtggccgtacaaactaacttcgaacgtacaaacgtttcccggtaggacgggggtccctaagtttacccaacctattaccccgtaccgaacgggtaacgtaaacctaaaagttttaaccgaaaaaccggtaaaccccttaaaccccttttttaacgcccggttaacggtaacctaaaaaagttaaccgggaacctaacgggtccccttaagggaaaccgaaccccgaaacgggaaacccggaccgtaaccgggcctttaacggttacctttacgtttaagtttcggacccgagaggtaacggaacgaaccctaaccgaaaccgtaacccgtaaccgtacggtaacctaaacgtaccgttagggttacgggggtccgttttcggttaccgggtacgggggttacccgaaccgggggttacccgtcggggttaccttacggttccccgtacccgtttccccgaaccgttccccgttaccccgaacccggtaacccgggtaccccttacggtttcccccggtaccccgttttccccccggtacgggtcccccgttcccgtaccccgg

SEQ ID NO: 22600 - DNA, 878 bp, Homo sapiens
  misc_feature: GYAE6OF01BUXWE.12.40.D07.1.454.CMB.1.raw
  modified_base (153)..(153): a, c, t, g, unknown or other
  misc_feature (153)..(153): n is a, c, g, or t
  modified_base (184)..(184): a, c, t, g, unknown or other
  misc_feature (184)..(184): n is a, c, g, or t
  modified_base (213)..(213): a, c, t, g, unknown or other
  misc_feature (213)..(213): n is a, c, g, or t
  modified_base (245)..(245): a, c, t, g, unknown or other
  misc_feature (245)..(245): n is a, c, g, or t
tcagatacgacgtacacgaccggtgctcgatttagtgatagagcgtaacaacagagggctcaccatggagtttgggctgagctgggttttcctcgttgcttacttttaagaggtgtccagtgtcaggggcaccgtggtggagtcgtggggganccggtggtccagccgtgggccgtccctgacnctcgctgtgtcgcctgtgtactttccctntaatttctactccatgctacggtcgggtaccnccgaggtcctccgaaggacgaacggggtctcgggaggttggggcgcttacttagttcgactactagtgtagtcggacgtaacaaaacttaatttccgaaaccgtacttaaaaccgtttccgggaggggtaccggggtaccctaacgttaccacctaacgtcctaacccgagtaacgtaactaaaacttaccaaaacgttaaccctaaccgttttacacgttaacgaaacttaaacggaaccaagccgttaaccgtaaaggaccggaaaccaaccgggaaccggaccggtaaccgtcgttttaaccgttaacgtttagtttacggtaacggtacccgagggtaaaccgaacggaactaacctaccggtaaaccgtaacccgttaccggaacgtaacctaaacggttacgggttaacggtcggggtttacccggttcggggttaaccgggacggggtaacccgggtaaccggggttacccgtacgggtaccgtttacccggtacccttcccccgtaaccggtaaccccggtcccccggttaacccgaaaccccggtaacccgggtaccctacccggttttaccccccgggttccccgttaaccccgtcccgggcccccttacccggtaccccggg

SEQ ID NO: 22601 - DNA, 750 bp, Homo sapiens
  misc_feature: GYAE6OF01C3AOZ.12.40.D07.1.454.CMB.1.raw
  modified_base (154)..(154): a, c, t, g, unknown or other
  misc_feature (154)..(154): n is a, c, g, or t
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (322)..(322): a, c, t, g, unknown or other
  misc_feature (322)..(322): n is a, c, g, or t
  modified_base (367)..(367): a, c, t, g, unknown or other
  misc_feature (367)..(367): n is a, c, g, or t
  modified_base (475)..(475): a, c, t, g, unknown or other
  misc_feature (475)..(475): n is a, c, g, or t
tcagatacgacgtacacgaccggtgctcgatttagtgatagagcgtaacaacagagggctcaccatggagtttgggctgagctgggttttcctcgttgcttctttttaaagaggtgtccagtgtcgagggcacctgggtggagtcgtggggganccgtgtccagccgtgggcggtccctgacactcgcctgtgttgccttntggtacttttccccttntaactttctaatttcccagtcgcaacgttcggggtacccaaccgcgggtcctacccggagggaccgaacgggggcttaccggaggtggggtcgactaacttttntacgctaacgatgagtcggacgtacaaaactaaacgttcgaaacncgtaaaagtttccgggacggacggggtaccctattacccacgttaactcccgtaaccgtaagaacgtaaactaaacttaacgaaacgtaccctttaaacccgttttanaacgtaacgtaactaaaatacgaaccacgtaccgtaacgaaccgaaccgtaacggaacctccgtacggtactcgtattattcgcgacgcgaagacgacacaacgtacgacctcgtacgacctaaattcggtaggtccgggttcgttacggttcggaccgggtacgacgggttcctacgtcgtacgcccgtacccctaccgtcccgcctacccgtaaccgggacccgtaccgttccggttccccgttaccccgtacccggtccgcccgtaccggtc

SEQ ID NO: 22602 - DNA, 898 bp, Homo sapiens
  misc_feature: GYAE6OF01CPRPU.12.40.D07.1.454.CMB.1.raw
  modified_base (112)..(112): a, c, t, g, unknown or other
  misc_feature (112)..(112): n is a, c, g, or t
  modified_base (157)..(157): a, c, t, g, unknown or other
  misc_feature (157)..(157): n is a, c, g, or t
  modified_base (200)..(200): a, c, t, g, unknown or other
  misc_feature (200)..(200): n is a, c, g, or t
  modified_base (747)..(747): a, c, t, g, unknown or other
  misc_feature (747)..(747): n is a, c, g, or t
tcagatacgacgtacacgaccggtgctcgatttagtgatagagcgtaacaacagagggctcaccatggagtttgggctgagcttgggttttcctcgttgcttcttttaaagnggtgtccagtgtcgaggggcaccgtggtggaggtcgtgggggganccgtggtcccagcctgggcggtccctgacactcgcctgtgttncctctggtacttttcccttctaattttctaatttccatgacctaacgttcgggtcccgccgaggtcctaccgagggacgaaggggcctcggaggtgggtcgactacttatcgactactatgatcgggccgtaacaaataactttccaacgacttaaaaacgtttcccggaggaaccgggggacctaattaccgaccaacgttcaacccaaaggacgtaaactaaacttaaacaaaaccgtaaccctaaccctttttacacgttacgtaacaaaactagaacaacggtctaacggaacgaacccaagaaccgaccgaccggtcttagtaacttagtttacgtcgacgaacggtaacgacggtaacgaaccctaaacggaaaccccgtaaacgttaccgttaacggaaccctaaacggttaacctttaacgggttacgggggtttacccgttttacggggtttacccgggttacggggtaccccgggtaacccgggggttacccgtttaccggggttaccttaaacccgttccccgggttttaaacccnccccccgggtaaacccgttacccccggtaacccccgtaaaacccccgggaacccggggttaacccccgttaaccccggggttttaccccggttttacccccctccccccccgggtttaaccgggcccccccgttccccgttacccccgggg

SEQ ID NO: 22603 - DNA, 762 bp, Homo sapiens
  misc_feature: GYAE6OF01CSWGQ.12.40.D07.1.454.CMB.1.raw
tcagatacgacgtacacgaccggtgctcgatttagtgatagagcgtaacaacagagggctcaccatggagtttgggctgagcttgggttttcctcgttgcttcttttaagaggtgtccagtgtcgagggggcaccgtgggtggagtcgtggggggacgccggtggtccaggcccgtggggccggtccctgaccactcgcctgtgttgcctctggtacttttcccttactaattttctacttccagtcgcacgtcgggtcccgcgacggcctaccgagggcgaagggggtcctcggaggtggggtggacctactttagtgacactagtggagtcggacctacgaaactaaattccgtaacgactaaacgttcccggtaggaccggggcctactttacacccagtcctaccgagacaaccgtaaattaaccgaacgtaaaccttaccctttagaccctaagaaacaaaagtacgactaacgcctaagaaccgaccgaagaccgacgacgtctgttacttaacttagtcggacgacggtaaggaacgtacgacgaaccgaaccgaacctacgaccggtaactaacgtacgtacggtcggggttaccttgggtcccggtacgggtaccggtacggggtcccgtacgggtacaccgttacccgcccgttccccggaccgttaccccgtaccccgaacgggaacccggtccccgtacgtttcccccggttacccgttcccccgggacggtcccgtccccggttaccgg

SEQ ID NO: 22604 - DNA, 821 bp, Homo sapiens
  misc_feature: GYAE6OF01AKBMG.12.40.D07.1.454.CMB.1.raw
  modified_base (154)..(154): a, c, t, g, unknown or other
  misc_feature (154)..(154): n is a, c, g, or t
  modified_base (179)..(179): a, c, t, g, unknown or other
  misc_feature (179)..(179): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
  modified_base (275)..(275): a, c, t, g, unknown or other
  misc_feature (275)..(275): n is a, c, g, or t
  modified_base (814)..(814): a, c, t, g, unknown or other
  misc_feature (814)..(814): n is a, c, g, or t
tcagatacgacgtacacgaccggtgctcgatttagtgatagagcgtaacaacagagggctcaccatggagtttgggctgagcttgggttttcctcgttgcttacttttaaggaggtcgtccagtgtcagggcacgtggtgagtcgtgggggacnccgtgtccgagccgtgggccgtccngacacgtcgctgtacgtcnctntggtcttttccctataactttacattccatcgacacgttcgggaccnccgtaggcctcgagggacgacggggtntacgggaggttcggggaccgtacttacgtttagttaccgacgtacgtagtaggtacgttccggaactaactaaaacgttaacgtttacgaaccgttaacggtaaccttcggggtacggaaccggggttacctaacttaccgtaccttaacgtaccgacgtaacgggtaactaaacttaaacgttaaacccgaaacgtaccctttaaccgttaggtctaaaccgaagtaaacgttacggaacctacggtccttaaaacgggaccaaacggtaccgaaccgtaccggtacgtccggttagttaacgtttattacccgggtaacggtcgtaaccggagaccaacgtacggaaacccgtccgtaaaccgtcgtaaacgtactaacgttcggttaagggtcccggttacggtttacgggtaccgggtaacccgggtacgtaccgggtaccttacgggttccaaccgggtttccccaccgtaccgccgtacccgacgtaccggacgttacccccgtcggtaacccttccccgtacggcgttcccnccggtcg

SEQ ID NO: 22605 - DNA, 821 bp, Homo sapiens
  misc_feature: GYAE6OF01CM8M6.12.40.D07.1.454.CMB.1.raw
tcagatacgacgtacacgaccggtgctcgatttagtgatagagcgtaacaacagagggctcaccatggagtttgggctgagctgggttttcctcgttgcttcttttaagaggtgtccagtgtcgaggggcaccgtgggtggagtcgtggggggagccgtggtccagccgtgggccggtccctgacactcgcctgtgttcgcctctggtacttttcccttataattttctacttccgatgcctacgtcgggtcccgccaggcctccgaaggccggtaaggggctcggaggtggggtacggactacgtttagttcgacctacgtaagtagtacgttcgggtaccgtaacctaaaaccgtaaactttaccgaaccggtaaaccgttaaaaccgttttcccgggtaggggaaccgggggtaccctaacgttttaccccaaaccgttaccgtacccttaaccggaacggtaaacgtaaaccgtaaactttaaaccgaaacgtaaccccgtttaaacccttttagtaccgtaacgtaaactaaaacgttacgaacctacgtaccgtagaaaccgtaccggaaacgaccgacgtaccgtcttagttcttaagttacgtcgacgacgtagaacgcgaacaccgaccgtaacctacgacgtaactaacgtacgttaggggtcgggttattcgggtcggtaccggggaccgtaccggggtcctaggtccctacgtccggtacccctaccgtcccggtaccctacccgggaaccgtaccggtcccttaccggtacccccggttccctaccccggtccgtcccgtcccgtacg

SEQ ID NO: 22606 - DNA, 974 bp, Homo sapiens
  misc_feature: GYAE6OF01EIDPR.12.40.D07.1.454.CMB.1.raw
  modified_base (527)..(527): a, c, t, g, unknown or other
  misc_feature (527)..(527): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcaggggcacctggtggagtcgtgggggagccggtgtccagccgtgggccggtccctgacactcgcctgtgttcgcctcgtgtactttcctctaattttctattccatcgctacgtcggggtcccgccgacggtcctaccgagggccggtaaacgggggtctacgggtagggttgggggtcggtacctaaccgtttagttcggacctaacgaagttggtaacggttggggacccgttaaacctaaaaaccgtaaaacttttacccgtaaacgtaacccgttaaaaacggttttccccgggtaaggggaacgggggtaccccgttaacgtttacccaacccgttacgttccaaccgaaagtacgtaaacctaaaacttaaacgaaacgtaaacccttaccgtttancgtaacgaactaaaagtacgaactacggacctaacggaacgaaccgaaacggtaaccggaaccggtaacccggtacgttacggttaacgtttaacgtttaacgtttacgggaaccggtaacggtaaacgggaaaccggaaaccgaaacccgaaacccgtaaacccggtaaaaccccgtacggttaacccggtaaaccctaaacgtttaaccggttaacgggtttacgggggttaaccgttttcggggttaccgggttaccgggggtacccgggtaaccggggttaccccgttcggttaaccggtacccgttacccggttaccccgttacccccgtacccggtaccccttaaaccccggacccggtaaacccggggtccccttaacccggggtttcccgtttaccccccgttccccccggtcccggtcccccggtcccgttaccccgg

SEQ ID NO: 22607 - DNA, 627 bp, Homo sapiens
  misc_feature: GYAE6OF01CS0DG.12.40.D07.1.454.CMB.1.raw
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
  modified_base (442)..(442): a, c, t, g, unknown or other
  misc_feature (442)..(442): n is a, c, g, or t
  modified_base (567)..(567): a, c, t, g, unknown or other
  misc_feature (567)..(567): n is a, c, g, or t
  modified_base (575)..(575): a, c, t, g, unknown or other
  misc_feature (575)..(575): n is a, c, g, or t
tcagatacgacgtacacgaccggtgctcgatttagtgatagagcgtaacaacagaggactcaccatggagtttgggctgagctgggttttcctcgttgcttacttttaagaggtgtccagtgtcgaggggcaccgtggtggagtcgtgggggagccgtggtccagccgtgggcggtccctgacactcgctgtgttcgcctctggtactttccctataactttctattccatgctacgtcgggtcccgccgacggtcctaccggaggaccggaacgggggtcctcgggaggtggggtcggactacttattgcacatgagtggacgtacaaacaattcacgactaaacgttcggaggacgggcctatccaccntccacgaganaactaactacaataaccttaccttanctagtanaaactgacacgactgacgacagaaccgngacgtctagttactacttagtcgacgagaagacgacgaaccacaacgacctacgacgaactaatacgtgggtcggttccgttaggtcggacggtaccgacggtccgtagtcgtactaccgtcccncccgtacncccgtacgaccgaccggtccacgttcccgtacctccccgagcccgtccgtcg

SEQ ID NO: 22608 - DNA, 771 bp, Homo sapiens
  misc_feature: GYAE6OF01EAI68.12.40.D07.1.454.CMB.1.raw
  modified_base (156)..(156): a, c, t, g, unknown or other
  misc_feature (156)..(156): n is a, c, g, or t
  modified_base (252)..(252): a, c, t, g, unknown or other
  misc_feature (252)..(252): n is a, c, g, or t
  modified_base (474)..(474): a, c, t, g, unknown or other
  misc_feature (474)..(474): n is a, c, g, or t
tcagatacgacgtacacgaccggtgctcgatttagtgatagagcgtaacaacagagggctcaccatggagtttgggctgagcttgggttttcctcgttgcttcttttaagaggtcgtccagtgtcgaggggcaccgtggtggagtcgtagggggcnccgtggtccagccgtgggccgtccctgaccactcgcctgtgttcgcctacgtgtactttcctataatttctacgttcatcgactacgtcgggtccncgaggtcctaccggaggacgaaggggtctacgggtagggtggggtacgaccttacgtttaatcggacaacgtagtaggtaagtcggacctaaactaaaactaaagtttccaacggtaactaaaacgtttcccggaggggaccgggtacctacttaccacctaagttcctaccgaaagggactaaaccgtaaacttaaccgaaacgtaaccctttacctttanccgtaagaaataaactacgacgtacaccgtagggaaaccacgaacggaacgtacgccggtatttacgtacgttatttacgacggccggaacggaacgattaaccggactaaccgacggtaaacctaccggtagaaccttaagtacggtacgggttaggggtctttcggggaccgtacggggcgtaacccgggtcttaccgtgacccttaccgcccgttacccgaccgtaccccaccggaaaccggaccggtaccctaccggttccgttccccctacccggtgaccccgtcccgtacg

SEQ ID NO: 22609 - DNA, 579 bp, Homo sapiens
  misc_feature: GYAE6OF01BZYVS.12.40.D07.1.454.CMB.1.raw
  modified_base (277)..(277): a, c, t, g, unknown or other
  misc_feature (277)..(277): n is a, c, g, or t
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgcaggctccaggcaaggggctcgagtgggtggcacttatgcacntgatggcgtcaacaattcacgcaaattccgngaggggccattcaccatctccaganacaattacaagaactaccctttanctgactaaatcgacagccctagaacgacccaagaccgacgacggctcgtactattattgcgcggaagagagacacacgtaacctacgcgacaatactagtcgggggtcttaggttcgtcgggtccgacggggcctcggtcagtccgtacctccccgacgtccctcccgaccgaccggccctacgtcccggttcccttacccccggcggtcccgtcccgtccg

SEQ ID NO: 22610 - DNA, 1033 bp, Homo sapiens
  misc_feature: GYAE6OF01EEI7V.12.40.D07.1.454.CMB.1.raw
tcagatacgacgtacacgaccggtgctcgatttagtgatagagcgtaacaacagagggctcaccatggagtttgggctgagctgggtttcctcgttgctcttttaagaggtgtccagtgtcgaggggcaccgtgggcggaggtcgtggggggagccggtggtccagccgtggggccgtccctgaccactccgccttgtgttgccttcgtggtactttccattctaattttctattccatcgctacgttggggtcccgccacggtcctaccgagggaccgtaaagggggccttacgggagggttcggggggtcgggtaccttaacgttttaacgttccggaccaaacgtaagttcggaggtacggggtaccttaacaaaacttaaacgttttaccgtaaccgtaccttaaaaacggtttcccggggtagggggaaccggggtacccgttaaactttccccgaaaccttaccgttacccgttaccgaaacggtaaaaccggtaaaaccttaaaaacctttaaacgaaaaccggttaaaacccctttaaccccgtttttaataccggtaacgtaaacttaaaaacggtccgtaaaccgtacgtaccccggttaaaggaaaccgaaacccggaaacgggtacccggtaaacccggtaaccgggtacctttaacgggtttaacctttaaagttttaacgttcgggaaccgtaacgggaaacggaacggtaaaccgaccgtaaacccgtaaacccgggtaaacccttaacccgggcggttaaaacccgttaacgttaccgggttaacgggggtttacggggggttaccctttttaacggggggtttcccggtaacggggggggtttaccccgggaaccggggggtttaacccgttccgggtaccgtacccggtttccccggttcccccgttacccccgaaacccgggttcccctaacccggaaacccgggtaccccggggtacccctaccggtttccccggttaccccctttccccggggccggtcccccgtacccggg

SEQ ID NO: 22611 - DNA, 925 bp, Homo sapiens
  misc_feature: GYAE6OF01D35FM.12.40.D07.1.454.CMB.1.raw
tcagatacgacgtacacgaccggtgctcgatttagtgatagagcgtaacaacagagggctcaccatggagtttgggctgagcttgggttttcctcgttgcttcttttaagaggtgtccagtgtcgaggggctaccgtgggtggaggtcgtggggggacgccggttcggtccaggtccgtcgggggtccggtccctagacctacctccgtccgttgttcgttcgccttcgtcggtacttttcccttacttaactttctactccagtcgtactacggtcgggtcccgacgacggtcctaccggacggtaccggaacgggtcgttacgggagggttggggtacgacttaacgttagtcgactacgtagtggtacggtacggtaactaaccgtaaaacgttaaacttaccgtaaccgtaacgttaaccggttccgggagggtacccgggtaccttaccgtaacccacctacctaccgaacgaaacgtaactaaactaaaacgttaaaccgaaaccgttaaccctttaaccgttaacgtacgtaacgtaaaacgtaaacgtaaccgaacgtacccgtaccgaacgaaccgaaccggaacggtaaccgacgtacggtacttacgttacttacgttacgtacggaacgagaacggaacgaacctaaccgtaaccgtaacccgtaaccgtaacgtaccgtaacgttaacgggttacggttacggggttacggttacgttccggggttacccggggaccgggtacccggggttaaccgggtacccgggtaacggttacccgttcccggttaccccgttaccccgtaccccggtaccccgtaccccggtaaaccccggtaccccggtaacccggttcccgttacccgtttcccccggttccccggtaccccgggtcccgtcccgtccgtacccgg

SEQ ID NO: 22612 - DNA, 768 bp, Homo sapiens
  misc_feature: GYAE6OF01EJ5VO.12.40.D07.1.454.CMB.1.raw
  modified_base (93)..(93): a, c, t, g, unknown or other
  misc_feature (93)..(93): n is a, c, g, or t
  modified_base (152)..(152): a, c, t, g, unknown or other
  misc_feature (152)..(152): n is a, c, g, or t
  modified_base (193)..(193): a, c, t, g, unknown or other
  misc_feature (193)..(193): n is a, c, g, or t
  modified_base (753)..(753): a, c, t, g, unknown or other
  misc_feature (753)..(753): n is a, c, g, or t
tcagatacgacgtacacgaccggtgctcgatttagtgatagagcgtaacacagagggctcaccatggagtttgggctgagcttgggttttccncgttgcttcttttaagaggtgtccagtgtcaggggcaccgtggtggagtcgtggggganccggtggtccagcctgggccggtccctgacactcgcctgtnttgcctctggtactttcctcaatttctattccatcgctctcgggtccgaccagggctccgaggccaaggggtctcggaggtggtggctacgttattgcaacatgatggctacaaactaattcctacgctaaacttccggtaggacgggggcctagttaccaccgtaatccgtaccaaggaactaacgtaaacgtttaaccaaacggtaaaccctaaccgtttaactacttaaggacaaaaacgttcgaaccgtaggtaccctagggaaaccaaccgaacggtaaccgaactacgggtaccttggttacctaacgtttagttacggacggtaccggtaaagacgaaacggtaccaaacccgtaaaccgtaaacccttaacggtaccggaacctaaacgttaccgttaacggggtacgggttaccgttacgggttttaccgggtaccgggggtacccgtaacgggtaccccgttgggtaaccacgtttccgtacccctcccgaacgtcccttaccggacccggtaaaccggcccgtacgttccccggtcctttacccccggnggtcccgcccgtcgg

SEQ ID NO: 22613 - DNA, 799 bp, Homo sapiens
  misc_feature: GYAE6OF01B9YF5.12.40.D07.1.454.CMB.1.raw
  modified_base (158)..(158): a, c, t, g, unknown or other
  misc_feature (158)..(158): n is a, c, g, or t
  modified_base (261)..(261): a, c, t, g, unknown or other
  misc_feature (261)..(261): n is a, c, g, or t
  modified_base (455)..(455): a, c, t, g, unknown or other
  misc_feature (455)..(455): n is a, c, g, or t
tcagatacgacgtacacgaccggtgctcgatttagtgatagagcgtaacaacagagggctcaccatggagtttgggctgagcttgggttttcctcgttgcttacttttaagaggtgtccagtgtcgaggggcaccgtgggtggagtcgtggggggacnccggtggtccagcctggggccggtccctgacactcgcctggtgttcgcctcgtggtacttttccctactaattttctacttccattcgacacgttcgggtccnccgaggctccgaggcgtaagggctcggaggtggggtgctacgtttagtgacactagtgatcggacgtacaaactaacttccaacgtacgtaaacgttccgggaggacgggggtccctacttccaacgacttccaccgaagaacgtaactaaacttacaaacgtaacccttacctttaatccgtagaacctaaanacgaacacgtaccgtagaaccgtaaccgacggaaccgtaccgaacggtccgtttacgttactttaatttcgttcggacggaacgtaagaacggtcaaacctaacgaaccgtaaccgtacgtaccggaactaaagtttacggtaggttaccgggggtacttttacggggtaccggggtacgggggacccgttaacgggggttaacccttggggtaaccttccgggtcccttaccccggaccccgtacggttccccgtaacccggaaccgggtacccggtcccgtaacggtttcccccgggttaccccgtcccccgggtaacggtccccgtaccccggttacccgg

SEQ ID NO: 22614 - DNA, 777 bp, Homo sapiens
  misc_feature: GYAE6OF01BHW7B.12.40.D07.1.454.CMB.1.raw
  modified_base (157)..(157): a, c, t, g, unknown or other
  misc_feature (157)..(157): n is a, c, g, or t
  modified_base (552)..(552): a, c, t, g, unknown or other
  misc_feature (552)..(552): n is a, c, g, or t
  modified_base (623)..(623): a, c, t, g, unknown or other
  misc_feature (623)..(623): n is a, c, g, or t
tcagatacgacgtacacgaccggtgctcgatttagtgatagagcgtaacaacagagggctcaccatggagtttgggctgagctgggtttcctcgttgctcttttaagaggtgtccagtcgtcacggggcacctgggtcggaggttcgtggggggacncccggttggtcccgagcccgttgggggccggtcccctaggacctactccgtccgttggttcgttcgccctcgtacgggttaccttttcccgttactaacttttcctacttcccagtgaccgtaccgttcggggtacccgccaggcctaccgagggccgaacgggctcgggtaggtggggtaggcctaacgtttgttcgcacgtattggcgtaccggtcgaactaaacgtaaattccgtaacaacgttaacgttccgagggaccgggtccctagttacccacgtactccgacaggatactaactaacggaacaacttaccgtttacacgtgaaactaaacgaccgacaccgtacgcgaacgaccgagaccgcgaacgtctagtcttaattgtacgngacgtagacgacgtaaccaacgaccgtaaccgtagtacccgacgtaacgtacggttaaggacccggggttntttacccgggttcggtacgggtacccggtaaccggggtcccgttacggaccgttaccggtcccgtaaccccgttcccgaccgtccccggacgtacccggaccgggtcccctacgggttccccgtaccgtccccgttccggcccgtcccgtacgg

SEQ ID NO: 22615 - DNA, 826 bp, Homo sapiens
  misc_feature: GYAE6OF01EVUFT.12.40.D07.1.454.CMB.1.raw
  modified_base (601)..(601): a, c, t, g, unknown or other
  misc_feature (601)..(601): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtgatccagccgtgggcggtccctagacactcgtcctgttgttcgcctcgtggtactttcccttactaacttttctacttccatcggcctacgttcgggtccgcgacggtcctaccgtagggaccgtaagggggtcttacggggtaaggttggggtcgggaccttaaccgttttagttcggacctaaccgtaagttggtaacgttcgggaaccgttaaccaaaaacgttaaaacgttttccgtaacgacgttaaaacggtttcccggggtaggggaaccggggtcccgtaactttacccgacctacttccgtacccgaaggaacgtaaacttaaacgttaaccgaaacggtaaacccttacccgtttaagtccgtaaacgaaactaaaacggttcgaccgtaacgtacctaaggaaccggaaccaacgggtaccgaacggacccggtttntacgttaacttagtttaacgcggacggtacgaaggtaacgacgaccaacacccggtaactacgtacggaacctaagttccgtaaggggttcgggtacttggttcgggaccgggacggtaccgggtaccgtcgtcgacgttccggtcccgcccgaacggtccccaacgacccggaacggttccccaacggttccccggtaccccttccggtaccgtccgtaccccg

SEQ ID NO: 22616 - DNA, 876 bp, Homo sapiens
  misc_feature: GYAE6OF01E47Q0.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtcctgacactcgcctgtgttgcctctggactttcccttctaattttctattccatgcacgtgggtccgccgacggctccgaggccgaagggggctcggaggtggggtcggcctacgttattcggctacagtgatggcgtaccaaacaaacttcctaacggactaaaacgtttcccggtggacggggcccgtagtttccaaccctaacttccctacccgaaggaacgtaacctaaaacgtttaaccgaaaacgtaaaccccgttaacccctttttaatcccgtaacgaaccgtaaaaatacggtaacccaacggtacccgttaggaaccggtaaccccgaacggtaaaccgaacccggtaaccgggtccgttacggtttacgtttaacgttttacgttacgggacccgggacggtaacgggaacggtaacgaaccgaaacccgtaaaccggtaaacccccgttacgtacgggtaacccctaaagttaaccggttacgggttacggggggttcttttacgggttaccgggtcgggggtaccccgggttaacgggggtccccttacggggtacccgttaacgtccccggttacccctacccccggtaccggtacccccttaacccccgaacccggtaaccccgggtccccttaaccggttccccggttccccgttaccccccgggtcggtccccgtccccggttacccgg

SEQ ID NO: 22617 - DNA, 791 bp, Homo sapiens
  misc_feature: GYAE6OF01BRWBH.12.40.D07.1.454.CMB.1.raw
  modified_base (577)..(577): a, c, t, g, unknown or other
  misc_feature (577)..(577): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagccgtgggccggtccctgacactcgcctgtgttcgcctcgtgtactttccctctaatttctattccattcgctacgtcgggtccgccgaggtcctaccgaggaccgaagggggtctcggaggtggggaggacctacgtttattgaccacagtcggagtcggacgttacaaactaaacttccgtaacgtactaaacgttccgggtagggacggggtaccctattaccacctacgtacctccgtaagaacgtaaactaactttaaacgaaaccggtaaacccttaaccctttaagtccgttaacgaaactaaaacgtacgtaaccgtacgtaccgtaacgaacggaacccaaggacccgtaacgaccggtcttacggttactttagtttacgtcggtaccggacggaacggaacganaacccgtaacgaaacccgtaccttacggaacggacctaagttaccgtagggtcggggttctttcgggttagggtccggggaccggtacgggtacccgtgtaccggtactcccggtcccctacccgggcccgtacctaaccccgaacccgggtaacccggtcccctaccggttcccgtttcccccgaccccggtcggcccccgttacccgtccgg

SEQ ID NO: 22618 - DNA, 744 bp, Homo sapiens
  misc_feature: GYAE6OF01DARD7.12.40.D07.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtcgtggggggacgccgtggtccagccgtggggccggtccctgacactcgctgtgtgctntgtactttcccttntaatttctattccatcgcacgtcgggtcccgccgaggcctccgaggcgaggggctcggaggtcgggtgctaactttatcgcactagtgagtcggactaacaaactaaattccgacgtactaaacgttccggagggacggggacctattaccaacctctcctccgaagacgaaaccaaccgaccaaacgtacccttcccttagtttcagaacctaaagtggaactaagttggaagaggaagacgacgacgtacttagtactttgtgtagacgtacggtacgtcccgtcggacgtaaggtacgtacgtacggtaacctttaactaacgtttatttacgttaggttacggtacggttacggttccgggacggggaaccgtaacggggtacccgtaacggttacgtacgttcccgttacctaccccgtacggtaccccgtaacccgtaccccgaacccgggtaacccggaccccgtttacccggttaccccggttcccccgtttaccccccgtcgggtaacccccctaacccccg

SEQ ID NO: 22619 - DNA, 754 bp, Homo sapiens
  misc_feature: GYAE6OF01EM8L0.12.40.D07.1.454.CMB.1.raw
  modified_base (112)..(112): a, c, t, g, unknown or other
  misc_feature (112)..(112): n is a, c, g, or t
  modified_base (394)..(394): a, c, t, g, unknown or other
  misc_feature (394)..(394): n is a, c, g, or t
  modified_base (430)..(430): a, c, t, g, unknown or other
  misc_feature (430)..(430): n is a, c, g, or t
tcagatacgacgtacacgaccggtgctcgatttagtgatagagcgtaacaacgaggagggctcaccatggacgtttgggctgagctgggttttcctcgttgctcttttaagnggtgtccagttgtcaggggcaccgtgggtgagtcgtgggggagccgtggtccagcctgggcgtccctgactactcgccttgttgttcgccttcgtggtacttttcccttctaattttctattccgagtcgctacgtcgggtccgccaggcctacgaggaccgaaggggctggaggtcgggtgacctacttatgactaacgagtagacgtcggtactaacctaaacgtaaacttccgtaaccgactaaacgtttccggagggacggggcctatccactatacncctaagacaactaataacgaagtaacctacctttancgtacgaactaaatacgacacgtcgtaggaacgaaccgacgaccgacgacgtcgttcgtacttaacgtttactcggaccgtagtagtaacgacgtaacctaaccggtaaccgtaacctacgaccggtaacctaagtacgttacgggtcgggttactttcgggttcccggacggggtacccgaacggggtttccctgggttaccctcgttaccccggtaccctacccggaccgttaccccaaccgtaccccgggaaaccggttccccctaccggggttcccggttacccccttaccccgggcccggtccccgtccccgggtaccg

SEQ ID NO: 22620 - DNA, 808 bp, Homo sapiens
  misc_feature: GYAE6OF01E2RWO.12.40.D07.1.454.CMB.1.raw
  modified_base (184)..(184): a, c, t, g, unknown or other
  misc_feature (184)..(184): n is a, c, g, or t
tcagatacgacgtacacgaccggtgctcgatttagtgatagagcgtaacaacagagggctcaccatggagtttgggctgagctgggttttccctccgttgctcttttaagaggtgtccagtgtcaggggcaccgtggtggagtcgtgggggagccgtggtcaagccgtgggccggtccctgacnctcgcctgtgttgccctcgtggtactttccccttctaattttcctattccatcgactacgtcgggtcccgccaggcctcccgaagggtccgtaaagggggccttacggagggttggggtcggcctaacttagttgccacctagttggacgtcggacgttaaccaaactaaagtttccaccggactaaacgttcccggtaggaaccggggtccgtatttacccaacctactcccgttacccgaagaacgaaccctaaattaaccgaaacgtaaacccttacccgtttaataccctacggaacctaaaaaggtccgaacctagtacccctagaaacgacccaggacccgtacgtaccggaccttacgtccgtttaagttacgttcggacgacggtaacggaacgaccgacgtaacgaacccgtaacccgttaacgtactaaccgtaatacggtaggttacggggtccttacgggtaccgggtacggggaccgtaaccggggtacccgtcggtaccgtacgttaccgtccccgtacccccgcgtacccctaaccccgaccggaccccggtaccgttacccgttaccccgggtaccccttcccccgtcccgggtcccgtcccgtccgg

SEQ ID NO: 22621 - DNA, 616 bp, Homo sapiens
  misc_feature: GYAE6OF01AN5EG.12.40.D07.1.454.CMB.1.raw
  modified_base (151)..(151): a, c, t, g, unknown or other
  misc_feature (151)..(151): n is a, c, g, or t
  modified_base (359)..(359): a, c, t, g, unknown or other
  misc_feature (359)..(359): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctggtggagtctgggggganccgtggtccagcctgggcggtccctgacactcgcctgtgttgcctctggacttttcccttcaattttcctattccatgcactggggtccgccaggcctccgaggcaaggggctcggagtgggtgcacttattgcacatgatggccgtacaacaaattcctacgacctaaagttcccgtagacggggcctagttccaccatctccaganactaacttacaagaacctaccctttaagctagactaaatacgacaagcctgacgacccaaggacgaacaccggcgtacgtactatttatgtacgcgagagacgacacaaccgacctacgcggaccaatacgtagtcggggtcttcgttcgacgggcggtacgggccctggtaccagtcccgtccgtcccgcgtaccctacccacccgaacggcccgaacttcccggtacccttccccggtcggcccgtcccgtaccg

SEQ ID NO: 22622 - DNA, 909 bp, Homo sapiens
  misc_feature: GYAE6OF01E0A01.12.40.D07.1.454.CMB.1.raw
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtggggggagccggtggtccagccgtgggcgtccctgacactcgcctgtgttgcctctgtactttcccttntaatttctattccatnctacgtcgggtccgccgaggcctccgaggcgaagggctaggaggtggggtagctacttatgacacatgagtggcgtacaaactaattcctaacgactaaagtttcccggagggaccgggggcctaattcccaaccctagttcctacccgaaaggtacgaaacctaaattaaaccaaacgtaaacccttaccccgttttaatcctaacgaactaaaagtacgaactacggaccctaaggaaccgaacccgaacggaaccgaaccgtaccggtaccgtttacgttaaccgttaattttacggttacggaccgggtaacggaaagggtaaaccggtaacggaaaccccgtaaccgtaaaaccccggtaaacccgtttaaccgggtaaccggtaaaccccgttaaagttaaccggttacgggggtttaaccggggggtttacctttttacgggggtttacccggggtaaccgggggggtaccccggtaacccggggggttaccccgtttacgggtacccgttacccggtttaccccggtacccccgtaacccccggtaaccggttaccccccgttaaccccggaaaccccgggtaacccggggtaccccccttaacgggtttcccccggggtttacccccctttacccccccgggacgggttccccccgtccccggttacccggg

SEQ ID NO: 22623 - DNA, 921 bp, Homo sapiens
  misc_feature: GYAE6OF01ALW41.12.40.D07.1.454.CMB.1.raw
tcagatacgacgtacacgaccggtgctcgatttagtgatagagcgtaacaacagagggctcaccatggagtttgggctgagcttgggttttcctcgttgcttcttttaagaggtgtccagtgtcaggggcaccgtggtggagtcgtgggggacgccggttggtccagcccgtggggccggttccctgaccaccgtccgccttggttgttcgcccttctggtaccttttcccttactaattttcctacttccagtcgctaccgttcgggtcccgcccgagggtccctaccgagggtcgaacgggggtcctacggtagggtggggtacggcctacgtttagtcgacactagtgagttcggaccttaacaaacgtaaacttcctaacgaacgttaaacgtttcccgggaggacggggtaccctattacccgaaccgtactccgtacgaagaacgtaacctaaacgttaaccaaaccgtaaccctttacccttttacgtaccgaacgtaaacgtaaacgtagaaccgtaccgtccgtaacggaaaccgacccggtaacgaacccgaccgtacggttccttacgttaaccttaagtttacgcgtaccgggaacgtaacggaaggaacccgaacccgtaacccgtaaacccgttaaacccgtacgtaacccggaaacttaaaccggtttacggtaagggggtttaccccggggtttacgtttccggggttcccgggtttaaccggggggacccccgggtttaaacggggttaccccctttagggtccccttaacccgttccccggtaacccccgttcccccggaccgttaccccgtaccccggaaacccggtaccccggttacccccgaccgttttaccccgggtccccccttacccccgggccggtaccccgtcccgttaccccgg

SEQ ID NO: 22624 - DNA, 918 bp, Homo sapiens
  misc_feature: GYAE6OF01AYODW.12.40.D07.1.454.CMB.1.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgaggggcctaccgtgggtggagtcgtggggggacgccggtggtccgagccgtcggggccggtccctagaccnctccgcctgtgttcnctacgtggtactttccctataactttctatccatcnccacggtcggacccgccgacgggcctccggaggaccggaagggggtcctacgggtggtggggtcggtacctactttaagttcgacctagaagtgtaccggtaggccgttaactaaaaccgtaaattcccgaaaacgtacccgttaaacggtttcccgggttagggggaaccggggtacccgttaacttaacccaccccaactttaccgaccccggaagtaaacccgtaaacggtaaaaacctttaaacccgaaaccgtaaaacccgttttaccccctttaaaacgtccgaaacggtaaacctaaaaaccgtttacggaacccaaacggtttcccgaaaggaacccgtaacccgaaaccggacccgtaaaccgggtccggttacttacgttaccgtttaatttcggttacccgacgtacggaaagaccgttaaaccaacccggtaaccgaaaccccgtaacctacggtaccgtaaccttaaacggtacccggttagggttccggggttacgtttcgggttacccggggtacgggtacccggacggggttacctccgggtaactccggtccccgtacccgttaccccgacccgtaccctaaccgtacccgggtaacccggttcctacccgggttcccgttccccgttacccccgggtcgccggttccccgccg

SEQ ID NO: 22625 - DNA, 709 bp, Homo sapiens
  misc_feature: GYAE6OF01CAIR6.12.40.D07.1.454.CMB.1.raw
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctctggtacttttcccttcaattttctattccatacgactgggtccgccaggctccgaggcgaacggggcgtcgaggtgggtggctacttattgcacatgagtggcgtacaaactaaattcgtacgactaaagttccggtggacggggccgtattccaaccactccgtaccagaagaactaaacttaacaaacgtaacctaccctttatctagacaaatagacagccgtagacgaccacgaccgacgacggtcttgtacttacgtttagtcgacggtaggagaagacgtaaccaaccgtaaccgaaacctacgtacggacctaaacgtacgttacggtgggggttacctttggttacccggtcgggggtaccggaaccggggtacccttagggtcctacgttccgttcccgtaccccgacgtcccctaccccggaacggtaacccgggtcccctacgtttcccgggttacccccctttccccggcggaccccgtccccgttggcccgtacccggg

SEQ ID NO: 22626 - DNA, 828 bp, Homo sapiens
  misc_feature: GYAE6OF01AGKZ9.12.40.D07.1.454.CMB.1.raw
  modified_base (300)..(300): a, c, t, g, unknown or other
  misc_feature (300)..(300): n is a, c, g, or t
tcagatacgacgtacacgaccggtgctcgatttagtgatagagcgtaacaacaggagggctcaccatggagtttgggctgagctgggttttcctcgttgctcttttaagaggtgtccagtgtcaggggcacctggtggagtcgtggggggagcccgtgggtcccagcccgtggggccggtccctgacactcgcctgtgttgccttctggtacttttccctcaatttctacttccatcgcacgtcgggtccgccagggcctccaggcgaaggggctcggaggtggggtgctacttatgcanatgatggcgtacaaactaagtttcaacggacaaacgtttcccggtaggacggggtccctatttaccgaacctagtcctccgaaaggtacgaactaaaacgtttaaccaaacggtaacccctaacccgtttttagcctacggaaaccctaaaaacgttacgggaacctaacgggtccccttaaaggggaaaccgaacccctaagggaacccgtaaccgtacgggtctttacggtaccgtttaatttacggtacgggacccgtaggaaggtacggaacgtaaccgaaccgaacccgtaaacccgtacgtacccggtactaaacgtttaccgtacgggttccggggttactttcgggttacccgggttacgggggacccggtaacccgggggaccccgttagggtaccttaccggtttcccggtaccccttacccccgggaacgtttacccccgacggggtaccctacggtaccccaaccccggttacggaaacgggtacccgacctaaccgggcccgggttacccccggg

SEQ ID NO: 22627 - DNA, 1126 bp, Homo sapiens
  misc_feature: GYAE6OF01B1WHW.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccggtggtcaacgccgtggggccggtccctgacacctcgcctgtgttcgcctcgtggtacttttccccttataactttttctacttcccagttcgacctacggttcggggtacccgccgagggtcctaccgaagggaccggaagggggtcctacgggagggttcgggggtacggtacctacgttttagttcggaccgaacctagtacggttacggtacgggtacccgtaacaaaaccgttaaaccgttttacccgtaaaccggtaaccttaaaaaccgggtttttcccgggtaaagggggtaaccccgggggggtacccggttaaccttttaccccggaaacccctttacgttaccccgttaaccccggaaaggtaaccggaaaacctttaaaaacccgttaaaacccgtaaaaccgggttaaaaaccccccttttaacccggtttttaaacccttacgggttaaacccggtttaaaccaaaaaaacggttttaacccggggaaacccttaaccggggtaccccgttaacggggaaaaccctaaaccccggggaaaaccgggtaaccccgggtaaaaccgggaaccccgggttaccggtttacgttttaacccggtttaaacgtttttaacggtttaccccgggtacccgggtaacgggtaacgggtaaaccgggtaaaccgaaacccgacccgtaaaacccgtaaccccttaacccggtaacaaacccgttaaacgtaacgttaacgggttaggggttaccgtttaccggggtttaccgggtcccgggggtaaccgggtaacccgggggtaccccgttacgggttacccgttacccgttcccggtaacccccggtcccgtaccccggtccccgttaacccggaaaccccgggacccggtaacccccgttcccccggttccgggttacccccccgtttacccccgggtccggtcccccggtcccgttaccccgg

SEQ ID NO: 22628 - DNA, 937 bp, Homo sapiens
  misc_feature: GYAE6OF01A37SB.12.40.D07.1.454.CMB.1.raw
  modified_base (149)..(149): a, c, t, g, unknown or other
  misc_feature (149)..(149): n is a, c, g, or t
tcagatacgacgtacacgaccggtgctcgatttagtgatagagcgtaacaacgagaggactcaccatggagtttgggctgagctgggtttcctcgttgctctttaagaggtgtccagtgtcaggggcacctggtggagtcgtggggganccgtggtccagcctgggcgtcctgacactcgcctgtgttgcctctggtactttccctcaattttctacttccatcgctacgtcgggtcccgacaggtcctccgaggaccgaacgggggtcctacggtaaggtcggggtcggtcctaaccttacgttggacctacgtagtggaacgttcgggaccgtaacctaaaaccgtaaacgtttacctaaccggtacgttaaaacgtttccccgggtaggggtaaccggggggtacccttaactttacccggtaaccctacttacccgttaccccgaaagggtaacgaaaccttaaacgtttaaaccgaaaccggtaaacccttacccgttttaatacccttaggaaccctaaaagttaacgaccgtaaacggtcccgtaaggtaaaccgaaccgtacggtaaacccggtacgtaaccgggtcttaccggtttaacttaacggtttaccgttacggtacggtaaccggaaggttaaccgaacgtacccgtaacgtaaacccggtaaacccgtttacggtacccggtaacttaaaccggttacgttaaagggggttccggggtttaacgtttaccgggtttaccggggtacgggggtaaccccgtaacggggggttaccccgttggtaaccgtaacccggttccggtacccctccccggtaccggtaaccccgttcccgaaaccccgggtccggttaacccccgtacggtttaccccgttcccccggttaaccccggtccggggttcccccgtccccgttaccggg

SEQ ID NO: 22629 - DNA, 688 bp, Homo sapiens
  misc_feature: GYAE6OF01BD3QP.12.40.D07.1.454.CMB.1.raw
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
  modified_base (405)..(405): a, c, t, g, unknown or other
  misc_feature (405)..(405): n is a, c, g, or t
tcagatacgacgtacacgaccggtgctcgatttagtgatagagcgtaacacaggagggctcaccatggagtttgggctgagctgggttttcctcgttgctcttttaagaggtgtccagtgtcaggggcacctgggtggagtcgtggggggagccggtggtccagccgtgggcggtccctgacactcgcctgtgttcgcctctggtactttcccttctaattttctacttccatcgctacgtcgggtcccnccgaggcctccgaggcgaaggggctcggaggtgggtgctattatgcacntgatggcgtacaactaatctacgactaaacgttccggtaggacggggcctattccacctatcctacgagacgaactaacttaaccaaacgtaacctaccctttaanctagactaaatacgacagcctagaacgaaccagaccgaacgacggtcttaggtactttaagttacgtcggcgtacgaagagaacgaccaacgaaccgtaacctagtcgaacctagtacgtggtacggggtctttgggttccggtcgggacccggtacgggtaccgttcggtactaccgttcccgtcccgtaccccgtccgtacccctacccggacccggtaaccgggtcccctacggttaccccgttccccggtttcccccggcggtccccgtccccggtccg

SEQ ID NO: 22630 - DNA, 872 bp, Homo sapiens
  misc_feature: GYAE6OF01B6QOX.12.40.D07.1.454.CMB.1.raw
  modified_base (109)..(109): a, c, t, g, unknown or other
  misc_feature (109)..(109): n is a, c, g, or t
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
tcagatacgacgtacacgaccggtgctcgatttagtgatagagcgtaacaacagagggctcaccatggagtttgggctgagctgggttttcctcgttgctcttttaagnggtgtccagtgtcaggggcacctgggtggagtcgtggggggagccggtggtccagcccgtgggcggtccctgacactcgctgtgttgcctctgactttccctntaatttctattccatgcactgggtccnccaggctccgaggcgaaggggctcggaggtggggtgactactttattgctacagtgacgtcggacgtactaaacgtaactttacgaaccgtacttaaaacgtttccccgggtaggggtaacccggggggtacccttaagtttaccccctaacccgtaacttttcccgttaccccgaaagggtaaacgtaacttaaaacgtttaaacccaaaacgttaaacccctttaaccccgtttattaaccgtacggtaaacaaacggttaacgaacctaacggtcccgttaagaaccgaacccgtaaaggacccgaacgtaccggtcgtttacttacgtttaactttaggccggacggtaacggaagacgtaacgaacccgaaaccgtaacccggacctttaacgtaccgggtaacccaaagttacgggttacgggtaacggggtttccgtttcgggtttacccgggttagggggaccccgtaccgggggtaccccgttgggtacccttaccggttccgtaccccccggtacccgtcccggtccccctaaccccgaaacccggaccggttacccccgtaccggtttccccggttacccccgttcccccggtacccggggccccgtaccccggtacccggg

SEQ ID NO: 22631 - DNA, 779 bp, Homo sapiens
  misc_feature: GYAE6OF01D4PSA.12.40.D07.1.454.CMB.1.raw
  modified_base (156)..(156): a, c, t, g, unknown or other
  misc_feature (156)..(156): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (308)..(308): a, c, t, g, unknown or other
  misc_feature (308)..(308): n is a, c, g, or t
  modified_base (770)..(770): a, c, t, g, unknown or other
  misc_feature (770)..(770): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgaggggcaccgtgggtggagtcgtgggggganccgtgtccagccgtgggccgtcctgacactcgctgtgtncctntggtntttccctntatttctattccatgctacgtcgggtcccnccgaggcctaccgagggaccgaaggggtcttcggaggtggggtcgacctactttagtcgacctacngtgagtcggactacaaaactaacttccgtaacgaactaaacgttccggtagggacggggtcccaagttcccaacctattccctacgaaggaactaactaacttaaccgaaactaacccgttacccttttataccgtacgtaactaaaagtacggacctaacggtccgtagaaacgaacccggtaaggaacccgacgtacggtccttacggttactttagtttaacgttcggacgtacggaagtaacggaacgaacctaaccgaaaccgtaacccgttaacgaccgtaaacctaagttacggtcgggtttacgggggttactttcggggttaccgggacggggtacccgtaccgggggtacccttggtacctacgttcccgtacccgttccccgacgttaccccaccggtaaaccccggccggtaccctacggttcccggttacccttcccccggcggtcccncccgtccgg

SEQ ID NO: 22632 - DNA, 832 bp, Homo sapiens
  misc_feature: GYAE6OF01E0W58.12.40.D07.1.454.CMB.1.raw
  modified_base (147)..(147): a, c, t, g, unknown or other
  misc_feature (147)..(147): n is a, c, g, or t
  modified_base (176)..(176): a, c, t, g, unknown or other
  misc_feature (176)..(176): n is a, c, g, or t
  modified_base (545)..(545): a, c, t, g, unknown or other
  misc_feature (545)..(545): n is a, c, g, or t
  modified_base (636)..(636): a, c, t, g, unknown or other
  misc_feature (636)..(636): n is a, c, g, or t
tcagatacgacgtacacgaccggtgctcgatttagtgatagagcgtaacaacgaggagggctcaccatggagtttgggctgagctgggtttcctcgttgctcttttaagaggtgtcagtgtcagggcactggtggagtctggggganccgtggtcagcctggcgtcctgacactcnctgtgttgcctctggtatttcccgttacgaaacttttctaactttcccaagtcgacgtaacgttgggggtcccgaccgaagggccttccgaacggggtccaaaaggggggggtccttaccgggaaggggttcggggggttacgggtaccctaaccggttttaaagtttgggaacccaacccgtaagtttggaaaccgtttcgggggacccgtttaacgaaaaacctaaaaacgttttccccgtaaaccgtactaaaaacggtttccccgggttaaggggaaccgggggggtaccttacgtttaccgaccctaaggttcctccgaaggtaacgaactaaacgtttacgaaacggtaaactacccttttancgtagaactaaaatacgacgtagccctaaggaacgacctaaggaccgtacgacggtcttacgtacttaattagtcgacgtacgagaacganaacgactaacgaacctagtacgaccaatacttcggtagggtcctttggtaccggttacgggccgtaacggggacccttgggtaccaggttacccggtaccgttaaccccgagtaccccgttaccgaaccggtaaaccgggcccttaacggttcccggttacccgtacccccggtggtaccccggtcccgtaccggg

SEQ ID NO: 22633 - DNA, 820 bp, Homo sapiens
  misc_feature: GYAE6OF01EZU8C.12.40.D07.1.454.CMB.1.raw
  modified_base (151)..(151): a, c, t, g, unknown or other
  misc_feature (151)..(151): n is a, c, g, or t
  modified_base (286)..(286): a, c, t, g, unknown or other
  misc_feature (286)..(286): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcactgggtggagtcgtgggggganccggtggtccagccgtgggccggtccctgacactcgctgtgttgcctcgtggtactttcccttataatttctattccatcgctacgtcgggtccgccgaggtcctaccgaggacgaaggggctcggaggtcgggngtacacttattgacacatgactggacctacaaacgtaattccgtaacgactaaagttccggtacgggacgggtacctacttccgaacctactactacgaagtaacgaactaacgttaacaaacgtaaaccctacccttttaaancctaacggaaactaaaacgtanaaccgtacgtaccgtaggaaaccgtaccgaaacgaaccggtaaccggaaccgggttcttacgtttaccgttaagtttacggtacgacggtaacggaaggtaaacgaaccggtaaccgtaaacccgtaaaaccggtaaccccttaactaacgggtaaccctaaaacgtttacggttacggggttaacgggggtccttttacggggttacccgggtacgggggtaccgacccggggtaccgttacgggtcctaccggttacccgtacccgtaccccgtaacggtaaccccgtacccgtaaacgggaacccgttccccgtaacggtttccccgttacccccgttaccccggccggttccccgccgtacccg

SEQ ID NO: 22634 - DNA, 805 bp, Homo sapiens
  misc_feature: GYAE6OF01B7SPC.12.40.D07.1.454.CMB.1.raw
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
tcagatacgacgtacacgaccggtgctcgatttagtgatagagcgtaacaacagagggcttaccatggagtttgggctgagctgggttttcctcgttgctcttttaagaggtgtccagtgtcaggggcacctggtggagtcgtggggggagccgtggtccagcctgggcggtcctgacactcgctgtgttgcctcgtggatttcccttcaatttctattccatgcactgggtccnccaggctccaggcgaaggggatcggnggtgggtggcacttattgcactatgatggacgtacaactaaattctacgactaaagtttccgaggacggggcctattcaacctatccgtaccaagacgaactaattacaacgaaccttacctttagccttaagacctaaagtacgaacgtacgaccgtagaacgaaccctaaggaaccggaacctacgggtaccgttagtttaccgttaacgtttacgttacgggccgtacggaaggtacggtaagtaacccgaaccaaccggtaaaacccttacgtaccggtaacctaagttaaccgttaacgggttcgggggttacgttttacgggtttaccgggtacggggggtaccccgtaacgggggtaccccgtttagggtaccggtaccggttcccgtaccccgttaccccccggtaaccgttaccccccggttaccccggaaaccccggtaaacccgggggtccccccttaacgggtttaccccgggttccccggttttacccccccggtcggggttcccccgtaccccggtttcggtacccccgg

SEQ ID NO: 22635 - DNA, 708 bp, Homo sapiens
  misc_feature: GYAE6OF01BHD66.12.40.D07.1.454.CMB.1.raw
  modified_base (156)..(156): a, c, t, g, unknown or other
  misc_feature (156)..(156): n is a, c, g, or t
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (324)..(324): a, c, t, g, unknown or other
  misc_feature (324)..(324): n is a, c, g, or t
  modified_base (392)..(392): a, c, t, g, unknown or other
  misc_feature (392)..(392): n is a, c, g, or t
  modified_base (436)..(436): a, c, t, g, unknown or other
  misc_feature (436)..(436): n is a, c, g, or t
  modified_base (697)..(697): a, c, t, g, unknown or other
  misc_feature (697)..(697): n is a, c, g, or t
tcagatacgacgtacacgaccggtgctcgatttagtgatagagcgtaacaacagagggctcaccatggagtttgggctgagcgttgggttttcctcgttgcttcttttaagaggtgtccagtgtcgaggggcacgtgggtggagtcgtgggggacnccgtggccagccgtgggccggtcctgacnctcgcctgtgtcgcctntcggtactttcctataactttctacttcatgcctacggtcgggtccgcgacggtcctacggagggaccggtaagggggctacgggagggtcggggacgttcgaacttaggtccacgagtagngtgacgataactaactaacgttcgacgaacttaaggcccggtgaccgtcaactctcccatcggtacgnggtaaacgacttaacgaactataaccctaccttagcggttaaanaacgtaaacgcgaacgtacgtacgacgaacgaacgacgtaccgtaacgcgttcgtacttagttacgtacggtacgaacggcgtaacgaacgtaaccgaacgtaacgaaccgtaccggtacgaagtacgtaacggtaccgggtaggttacgggtcgtcggtaccgggtacggtaccggtacggtcgtacggtctccgacccgtccacgtaccccgcgacccggtaccgacccgtaccgaccttcccgaccgttcccggaccncccgtccgtcc

SEQ ID NO: 22636 - DNA, 799 bp, Homo sapiens
  misc_feature: GYAE6OF01C9YBA.12.40.D07.1.454.CMB.1.raw
  modified_base (222)..(222): a, c, t, g, unknown or other
  misc_feature (222)..(222): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcgagggcaccgtggtggagtcgtgggggacgccggtggtccagccgtcggggccggtccctgacacctcgccgtgtgttcgcctcgtgtacttttccctntaactttctactccatgacacgtcgggtcccgccgacggcctccgagggacgaacgggtccgtacgggaggtgggtcgacttacgttagtcgacaacgtagtaggtacgtcggtactaacaaactaacgttccgtaacgaacttaaaccggttccgggtagggaccgggtcctacttaccgaacctacttccaccgaagacgtaaacttaataacctaaacgtaacccttaccgtttaagactaacgaacgtaaaacgacgtaaccgtacgaccgtacgaacggaacctaaggaaccgacgtaccgtattacgttaacttattacgtcggagaacgaagaacgactaaccgaaccgtaaacctaccgttacgaacgtaccgttaagtacgtacggggttccggttccgtttaggggtccggtaccggggacccgttaacggggtcttaccggtccgttacgacccccgttccgtaaccccgtaaccgccccgttaaacccgtaacccgggacccgtccccgtaccgggttacccccttaccccggttccccggaccggtcccctcccggtaacccgg

SEQ ID NO: 22637 - DNA, 1136 bp, Homo sapiens
  misc_feature: GYAE6OF01CB2XM.12.40.D07.1.454.CMB.1.raw
  modified_base (155)..(155): a, c, t, g, unknown or other
  misc_feature (155)..(155): n is a, c, g, or t
tcagatacgacgtacacgaccggtgctcgatttagtgatagagcgtaacaacagagggctcaccatggagtttgggctgagcttgggttttcctcgttgcttacttttaagaggtgtccagtgtcgaggggcacgtgggtggtagtcgtgggggngccggtcggtccaggtccgtgggccggtcctgacgtacctcgccttggttcgttgccttacgtggttacctttcccttctaacgtttctagttccatcggaccacggttccgggccgtaccgtagccctaccggaacgggaccgggtaaggggtccttacgggagggtggggtcgtacttacgtttaacgttcgacacctagtacggtacggtacggtaccgtaacaaacgttaacgttaccgtacgtaacgtaacgttcccggtagggacgggggttaccactttacccgaacttactacccgtaaccgaagtaaaccgtaaactaaacgttaaaccgaaaccgttaaacccgttaccccttttaatacccggtaaacgaaaaccgttaaacgtaaccggtaaaccgttaccggtacccgtaaaacggttaccgggaaaaaccccgtacgggtaaaccccgtaaccgggtaacccggtttaccggttaaccggtttactttttaaaccgggtttcggtaaaccgggcccggtaaaagggtaaacgtaacgggtaaccgaaaaccccggtaaaccgggtttaaaccctaaacccgggttaaaccgtacccggggttaaacccttaaacggttaacggggttccggggggtttaacggggttttcccgggttttaaccgggggttaccggggggttaaccccggggtaacccggggttaaccccggggtttaacccggtttccggggtaaaccccggtttacccgggtttaacccccgtttacccccccgggtaaccccccgggttaaacccggtaaccccccgttaaaacccccggggggtaacccccgtttaaccccgggggttaacccccccgggttttaccccggtttaccccccggggtttacccccccccggttttttaacccccgggggccccccggggttccccccggtttttcccccccgggttaaacccggg

SEQ ID NO: 22638 - DNA, 194 bp, Homo sapiens
  misc_feature: GYAE6OF02HT4NT.12.40.D07.1.454.CMB.1.raw
  modified_base (193)..(194): a, c, t, g, unknown or other
  misc_feature (193)..(194): n is a, c, g, or t
tcagatacgacgtacacgaccggtgctcgatttagtgatagagcgtaacaacagaggactcaccatggagtttgggctgagctgggttttcctcgttgctccaggagcacctccgagagcacagcggccctgggctgcctggtcaaggactacttcctacgtcgtatctgagcgggctggcaaggcgcatagnn

SEQ ID NO: 22639 - DNA, 193 bp, Homo sapiens
  misc_feature: GYAE6OF02FRYV1.12.40.D07.1.454.CMB.1.raw
  modified_base (193)..(193): a, c, t, g, unknown or other
  misc_feature (193)..(193): n is a, c, g, or t
tcagatacgacgtacacgaccggtgctcgatttagtgatagagcgtaacaacagaggactcaccatggagtttgggctgagctgggttttcctcgttgctccaggagcacctccgagagcacagcggccctgggctgcctggtcaaggactacttcctacgtcgtatctgagcgggctggcaaggcgcatagn

SEQ ID NO: 22640 - DNA, 536 bp, Homo sapiens
  misc_feature: GYAE6OF02IY5UB.12.40.D07.1.454.CMB.1.raw
  modified_base (490)..(490): a, c, t, g, unknown or other
  misc_feature (490)..(490): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacacccttatctgcaaatagacagcctgagaccagacgacacggctgtctattattgcgcgagagagacacgacgaacctactggccaatactagtggggcttgttctggggccaggggacctggtcatcgtctccccgngcctccaccgacggcccatccggtccttccccgtcggccgccctcg

SEQ ID NO: 22641 - DNA, 510 bp, Homo sapiens
  misc_feature: GYAE6OF02HPTC9.12.40.D07.1.454.CMB.1.raw
  modified_base (172)..(173): a, c, t, g, unknown or other
  misc_feature (172)..(173): n is a, c, g, or t
  modified_base (180)..(180): a, c, t, g, unknown or other
  misc_feature (180)..(180): n is a, c, g, or t
  modified_base (186)..(187): a, c, t, g, unknown or other
  misc_feature (186)..(187): n is a, c, g, or t
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (197)..(198): a, c, t, g, unknown or other
  misc_feature (197)..(198): n is a, c, g, or t
  modified_base (201)..(203): a, c, t, g, unknown or other
  misc_feature (201)..(203): n is a, c, g, or t
  modified_base (205)..(206): a, c, t, g, unknown or other
  misc_feature (205)..(206): n is a, c, g, or t
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (232)..(233): a, c, t, g, unknown or other
  misc_feature (232)..(233): n is a, c, g, or t
  modified_base (235)..(235): a, c, t, g, unknown or other
  misc_feature (235)..(235): n is a, c, g, or t
  modified_base (237)..(242): a, c, t, g, unknown or other
  misc_feature (237)..(242): n is a, c, g, or t
  modified_base (244)..(245): a, c, t, g, unknown or other
  misc_feature (244)..(245): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctggagccggnngcaggcnatagcnngntctnattnntcnnncnnggcncngcncngnaggntgngngngnntntnnnnnngnnanatnananatcgtgnggcgatcacatctcanananatacaacaactaccttactctnanaatagacacgactagacgacgacgacgacgacgacgtacgtactattatgtcgacgagagagacacacgaactacacgacaactactagtacgggtcgttcgttcgtcgggtacgacgggaccgtacgtacgtacgtcgtccgtccgacgtcctaccgaccgacgaccgtacgtccggtccgttcccgtccgtccgtcccgtccg

SEQ ID NO: 22642 - DNA, 545 bp, Homo sapiens
  misc_feature: GYAE6OF02IIHHP.12.40.D07.1.454.CMB.1.raw
  modified_base (230)..(230): a, c, t, g, unknown or other
  misc_feature (230)..(230): n is a, c, g, or t
  modified_base (282)..(282): a, c, t, g, unknown or other
  misc_feature (282)..(282): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
tcagatacgacgtacacgaccggtgctcgatttagtgatagagcgtaacacagagggctcaccatggagtttgggctgagcggtggtttcgcgtaggctctttaagaggtgtcagtgtcaggggcacctggtggagtctggggggagccgtggtccagcctgggcgtcctgacactcgcctgtgttgcctctggatttcccttcaatttctattccatgcactgggtccncaggctccaggcaaggggctgagtgggtgcacttattgcacatgatggcgtnaacaaattctacgcaaattccgtgaggggccattcaccatctccaganactaatacaanaactaccttanctnanaatagacancngagacacgacgacgacgctcgtctattatgcgcgagagagacacacgaactactcgacaactacgtagtgggtcgttcgttcggtcgggccggacgggaccgtcgtcgtcgtcgtcctccgcgcctaccgaccgaccggaccgtacgtccgtcccgtcccgtccggtccgtccgtcg

SEQ ID NO: 22643 - DNA, 567 bp, Homo sapiens
  misc_feature: GYAE6OF02I5BRF.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaacaaattctacgcaaattccgtgaggggccattccaccatctccagagacaattacaagaacacccttatctgacaaatagacagcctgagaccagacgacacgctgctatattgcgcgagagagacacacgaactacgtgaccaatactaagtcggggctttagttcgtcgggaccgaggggtaccctggtcagtccgtaccgtccccgacggcccttaccgaacccgaacgggccccacgttcccgggtccttccccccgtggtcccgcccctcgg

SEQ ID NO: 22644 - DNA, 534 bp, Homo sapiens
  misc_feature: GYAE6OF02GFGF3.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttatctgcaaatagacagcctgagaccagacgacacggctgtctattattgcgcgagagagacacacgaacctactggccaatactatggggcttgttctggggccagggaccctggtcatcgtctcccgagcctccaccacgggcccagtccggtccttcccccgtggccgccctcg

SEQ ID NO: 22645 - DNA, 542 bp, Homo sapiens
  misc_feature: GYAE6OF02I1E4S.12.40.D07.1.454.CMB.1.raw
  modified_base (416)..(416): a, c, t, g, unknown or other
  misc_feature (416)..(416): n is a, c, g, or t
  modified_base (499)..(499): a, c, t, g, unknown or other
  misc_feature (499)..(499): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccgccaggctccaggcaaggggctcgagtgggtgcacttatgcacatgatggcgtcaacaaattctacgcaaattccgtgaggggccattcaccatctccagagacaattacaagaaccaccctttatctgacaaatagacagcctgagaccagacacacggctgtctattatgcgcgagaganacacacgaacctatcggaccaatactagtgggggtctttgttcgtggggccaggggaccctgggtcacgtcgtcctaccccgngtccctaccgaggacgcaccgtccgagacgccacgacgcccgg

SEQ ID NO: 22646 - DNA, 534 bp, Homo sapiens
  misc_feature: GYAE6OF02HTVZS.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattcacgcaaattccgtgagggccgattcaccatctccagagacaattacaagaacaccctttatctgcaaatagacagcctgagaccagacgacacggctgtctatattgcgcgagagagacacacgaacctactggaccaatactatggggcttgttcgtgggccaggggaccctggtcatcgtctccccgagccctccaccaacggcccagtccggtccttccccctggccgcctcg

SEQ ID NO: 22647 - DNA, 550 bp, Homo sapiens
  misc_feature: GYAE6OF02HR5Z5.12.40.D07.1.454.CMB.1.raw
  modified_base (362)..(362): a, c, t, g, unknown or other
  misc_feature (362)..(362): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccgccaggctccaggcaaggggctcgagtgggtggcacttattgcacatgatggcgtcaacaaattctacgcaaattccgtgaggggccattcaccatctccagagacaattacaagaaccaccctttanctgacaaatagacagcctgagaccagacgacacggctgtctattattgcgcgagagagacacacgaactactggccaatactagtggggcttgttcgtggggccgacggggaccctggtcagtccgtcctcccgacgccctccaccgaacggcccacgtccggtccttcccccgtggcccgccctcgg

SEQ ID NO: 22648 - DNA, 557 bp, Homo sapiens
  misc_feature: GYAE6OF02GS563.12.40.D07.1.454.CMB.1.raw
tcagatacgacgtacacgaccggtgctcgatttagtgatagagcgtaacaacagaggactcaccatggagtttgggctgagcgtggtttcgtcgttaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctcagagacaattacagaacaccctttatctgcaaatagacagcctgagaccagacgacacggctgtctattattgcgcgagagagacacacgaacctacgtgaccaatactaagtgggggctttgttcgtggggccaggggccctggtcacgtcgtcctccccgagtccctaccgacccgaacggccctacgtccggtccttacccccgtggtcccgcccgtccgg

SEQ ID NO: 22649 - DNA, 542 bp, Homo sapiens
  misc_feature: GYAE6OF02GR5IV.12.40.D07.1.454.CMB.1.raw
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagcgtggtttcgtcgtaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggcccattcaccatctccagagacaattacaagaacaccctttanctgcaaatgacagcctgagaccagacgacacggctgtctattatgcgcgagagagacacacgaacctactggccaatactagtgggggcttggttcgtggggccacggggaccctggtcatcgtcctcccgagccctccaccgtacggcccagtccggtaccttcccccgtggccgccctcg

SEQ ID NO: 22650 - DNA, 543 bp, Homo sapiens
  misc_feature: GYAE6OF02F1N8U.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttatctgacaaatagacagcctgagaccagacgacacggctgtctattattgcgcgagagagacacacgaacctactgaccaatactatggggcttgttcgtggggccaggggaccctgggtcagtcgtctccccgagccctccgaccacgggcccagtccggtccttcccccgtcggccgccctcg

SEQ ID NO: 22651 - DNA, 546 bp, Homo sapiens
  misc_feature: GYAE6OF02GLL3I.12.40.D07.1.454.CMB.1.raw
  modified_base (234)..(234): a, c, t, g, unknown or other
  misc_feature (234)..(234): n is a, c, g, or t
  modified_base (360)..(360): a, c, t, g, unknown or other
  misc_feature (360)..(360): n is a, c, g, or t
  modified_base (532)..(532): a, c, t, g, unknown or other
  misc_feature (532)..(532): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtcaacaaattctacgcaaattccgtgaggggccattcaccatctccagagacaattacaagaacaccctttanctgcaaatgacagcctgagaccagacgacacgctgtctattattgcgcgagagagacacacgaacctactggccaatactagtggggacttgttcgtggggccaggggaccctggtcagtcgtctccccgagccctccaaccgaacggcccacgtccggtcccttcccccgnggtcccgccctcgg

SEQ ID NO: 22652 - DNA, 194 bp, Homo sapiens; identical to SEQ ID NO: 22638
  misc_feature: GYAE6OF02HQGXB.12.40.D07.1.454.CMB.1.raw
  modified_base (193)..(194): a, c, t, g, unknown or other
  misc_feature (193)..(194): n is a, c, g, or t

SEQ ID NO: 22653 - DNA, 541 bp, Homo sapiens
  misc_feature: GYAE6OF02HQRPT.12.40.D07.1.454.CMB.1.raw
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
tcagatacgacgtacacgaccggtgctcgatttagtgatagagcgtaacaacagagggctcaccatggagtttgggctgagcggtggtttcgcgtaggctctttaagtaggtgtcagtgtcaggggcacctggtggagtctgggggagccgtggtccagcctgggcgtccctgacactcgcctgtgttgcctctggatttcccttcaattttctattccatgcactgggtccgccaggctccaggcaaggggctgagtgggtggcacttattgcacatgatggcgtcaanaaattcacgcaaattccgngaggggccattcaccatctcagagacaattacaagacacccttanctagcaataanacancagacgacacgacgacgacgcgtgtactatatgcgacgagagagacacacaacacacgacatagtagtggtcgtcgtcgtcggcgacggacgtcgtcgtcgtcgtccgtcccgccgtcctaccgaccgaccgaccgtacgtccggtcccgttcccgtccgtccgtcccgtcg

SEQ ID NO: 22654 - DNA, 534 bp, Homo sapiens
  misc_feature: GYAE6OF02JA5M7.12.40.D07.1.454.CMB.1.raw
  modified_base (234)..(234): a, c, t, g, unknown or other
  misc_feature (234)..(234): n is a, c, g, or t
  modified_base (487)..(487): a, c, t, g, unknown or other
  misc_feature (487)..(487): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtcaacaaattctacgcaaattccgtgagggccgattcaccatctccagagacaattacaagaacaccctttatctgcaaatagacagcctgagaccagacgacacggctgtctattattgcgcgagagagacacacgaacctactgccaatactatggggcttgttctggggccaggggaccctggtcatcgtctcccgngccctccaccacggcccacgtccggtccttccccgtggccgccctcg

SEQ ID NO: 22655 - DNA, 538 bp, Homo sapiens
  misc_feature: GYAE6OF02IRLN5.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacacccttatctgcaaatagacagcctgagaccagacgacacggctgtctattattgcgcgagagagacacacgaacctactggaccaatactagtgggggctttgtctggggccaggggaccctggtcatcgtcctccccgagcctccaccgacgggcccagtccgtacctccctccggcgcctccg

SEQ ID NO: 22656 - DNA, 542 bp, Homo sapiens
  misc_feature: GYAE6OF02HOW23.12.40.D07.1.454.CMB.1.raw
  modified_base (361)..(361): a, c, t, g, unknown or other
  misc_feature (361)..(361): n is a, c, g, or t
  modified_base (431)..(431): a, c, t, g, unknown or other
  misc_feature (431)..(431): n is a, c, g, or t
  modified_base (529)..(529): a, c, t, g, unknown or other
  misc_feature (529)..(529): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttanctgcaaatagacagcctgagaccagacgacacggctgtctatattgcgcgagagagacacacgaactacngaccaatactagtggggcttgttcgtgggccaggggaccctggtcagtccgtctccccgagccctccaccgaacggcccagtccggtccttcccccgnggtcccgccctcg

SEQ ID NO: 22657 - DNA, 533 bp, Homo sapiens
  misc_feature: GYAE6OF02F4MGI.12.40.D07.1.454.CMB.1.raw
  modified_base (361)..(361): a, c, t, g, unknown or other
  misc_feature (361)..(361): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttanctgcaaatagacagcctgagaccagacgacacggctgtctattattgcgcgagagagacacacgaacctactggaccaatactatgggggcttgttcgtgggccagggaccctggtcatcgtctcccagcctccaccacggcccagtccggtccttcccctggccgccctcg

SEQ ID NO: 22658 - DNA, 556 bp, Homo sapiens
  misc_feature: GYAE6OF02GCLCO.12.40.D07.1.454.CMB.1.raw
  modified_base (360)..(360): a, c, t, g, unknown or other
  misc_feature (360)..(360): n is a, c, g, or t
  modified_base (549)..(549): a, c, t, g, unknown or other
  misc_feature (549)..(549): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttanctgacaaatagacagcctgagaccagacgacacggctgtctattatgcgcgagagagacacacgaacctactaggccaatactagtggggcttgttcgtggggccgaggggaccctgggtcagtccgtcctccccgagccctccgacccgaacgggccccacgttccggtccttccccccgtggtcccncccgtcg

SEQ ID NO: 22659 - DNA, 557 bp, Homo sapiens
  misc_feature: GYAE6OF02FK2Y1.12.40.D07.1.454.CMB.1.raw
  modified_base (361)..(361): a, c, t, g, unknown or other
  misc_feature (361)..(361): n is a, c, g, or t
tcagatacgacgtacacgaccggtgctcgatttagtgatagagcgtaacaacagagggctcaccatggagtttgggctgagcggtggtttcgtcgtaggctctttaagaggtgtccagtgtcaggggcacctggtggagtcgtgggggagccgtggtccagcctgggcggtccctgacactcgcctgtgttgcctctggatttcctttcaatttctattccatgcactgggtccgccaggctccaggcaaggggctcgagtgggtggcacttatgcacatgatggctcaaacaaattctacgcaaattccgtggaggggccattcaccatctccagagacaattacaagaacaccctttanctgacaaatagacagcctagagaccagacgacagctgtctattattgcgcgagagagacacacgaactactgaccaatactaagtgggggcttgttcgtcggggccgaggggaccctgggtacagtcgtcctccccgaagccctaccgacccgaacgggcccacgtccggttaccttccccgtggcccgtccctcg

SEQ ID NO: 22660 - DNA, 624 bp, Homo sapiens
  misc_feature: GYAE6OF02J1TL7.12.40.D07.1.454.CMB.1.raw
  modified_base (244)..(244): a, c, t, g, unknown or other
  misc_feature (244)..(244): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgccctcgtggtactttcccttactaatttctattccatgctacgtcgggtcccnccaggcctccgaggcgaaggggcctcggaggtgggtcggctacttatgcactatgatggcgtacaaactaattcctacgactaaacgttccggtagggacggggcctatttcccaacctattcctaccgaagacgaactaaattaacaaacgaaccctaccctttatctagaacaaatacgacacgtcctagaacgaccagaccgacgacgtctgtacttattatgcgcgagagagacacacgaacctcgtcgaccatactggtcgggtcttgtcggtcgggaccgacgggtcctgtctacgtccgtcctacccgacgtccctaccgaacccgacggccctacgttccggtaccccttccccgcggtcccgtcccgtccg

SEQ ID NO: 22661 - DNA, 525 bp, Homo sapiens
  misc_feature: GYAE6OF02G6EKJ.12.40.D07.1.454.CMB.1.raw
  modified_base (361)..(361): a, c, t, g, unknown or other
  misc_feature (361)..(361): n is a, c, g, or t
  modified_base (490)..(490): a, c, t, g, unknown or other
  misc_feature (490)..(490): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttanctgcaaatagacagcctgagaccagacgacacggctgtctattattgcgcgagagagacacacgaacctactgccaatactatgggggacttgttcgtgggccaggggaccctggtcatcgtctcccgngccctcaccaggccatcgtctccccngcnccctcg

SEQ ID NO: 22662 - DNA, 544 bp, Homo sapiens
  misc_feature: GYAE6OF02IWLH0.12.40.D07.1.454.CMB.1.raw
  modified_base (378)..(378): a, c, t, g, unknown or other
  misc_feature (378)..(378): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttatgcacatgatggcgtcaacaaattctacgcaaattccgtgaggggccgattcaccatctccagagacaattacaagaacacccttatctgcaaatagacagcctganaccagacgacacggctgtctattattgcgcgagagagacacacgaacctactcggcccaatactagtgggggtctttggttcgtggggccaggggaccctggtcagtcgtctccccgagccctccaccacggcccacgtccggtccttcccccgtggccgccctcg

SEQ ID NO: 22663 - DNA, 545 bp, Homo sapiens
  misc_feature: GYAE6OF02IW6SY.12.40.D07.1.454.CMB.1.raw
  modified_base (362)..(362): a, c, t, g, unknown or other
  misc_feature (362)..(362): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaaccaccctttancctgacaaatagacagcctgacaccagacgacacggctgtctattattgcgcgagagagacacacgaacctactgaccaatactagtggggcttgttcgtggggccaggggccctggtcatcgtctccccgagccctaccaccgaacgggcccacgtccggtccttccccgtggcccgcctcg

SEQ ID NO: 22664 - DNA, 542 bp, Homo sapiens
  misc_feature: GYAE6OF02IRSCQ.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgacaaatagacagcctgagaccagacgacacggctgtctattattgcgcgagagagacacacgaacctactgaccaatactatgggggcttgttcgtggggccaggggaccctggtcatcgtctccccgagccctccaccaacggcccacgtccggtccttccccgtcggccgccctcg

SEQ ID NO: 22665 - DNA, 573 bp, Homo sapiens
  misc_feature: GYAE6OF02F5VJI.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaacaaattctacgcaaattccgtgaggggccattcaccatctcagagacaattacaagaactaccctttatctagcaaaatgaacagcctagacgaccagacgacacggctgtctattattgcgcgagagagacacacgaacctactgaccaatactagtgggggtactttggttcgtacggggccgacggggacccgtggtacgattccgtctccccgagccctacccacccgaacgggccccacgttccggtcccttcccccgtcggcccgtccccgtccgg

SEQ ID NO: 22666 - DNA, 556 bp, Homo sapiens
  misc_feature: GYAE6OF02FO7QU.12.40.D07.1.454.CMB.1.raw
tcagatacgacgtacacgaccggtgctcgatttagtgatagagcgtaacaacagagggctcaccatggagtttgggctgagctgggttttcctcgttgctcttttaataggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaaacaaattctacgcaaattccgtgaggggccattcaccatctccagagacaattacaagaacaccctttatctgacaaatagacagcctgagaccagacgacacggctgtctattattgcgcgagagagacacacgaacctactgccaaatactagtggggcttgttcgtggggccaacggggacccttgggtccagttccgtctccccgagccctccaacccgacgggccccagttccggtccttcccccgtggtccgcccctcg

SEQ ID NO: 22667 - DNA, 573 bp, Homo sapiens
  misc_feature: GYAE6OF02H6K3I.12.40.D07.1.454.CMB.1.raw
  modified_base (359)..(359): a, c, t, g, unknown or other
  misc_feature (359)..(359): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctcagagacaattacaagaacaccctttanctgacaaatagacagcctgacgaccagacgacacggctgtctattattgcgcgagagagacacacgaacctactggaccaaatactagtgggggtctttgttcgtggggccacggggaccctgggtcacgtccgtcctccccgagtcccctaccgaacccgaacgggccccacgttcccgggtccctttccccccgtcggccccgtccctccgg

SEQ ID NO: 22668 - DNA, 553 bp, Homo sapiens
  misc_feature: GYAE6OF02GIMEJ.12.40.D07.1.454.CMB.1.raw
  modified_base (356)..(356): a, c, t, g, unknown or other
  misc_feature (356)..(356): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaacaattctacgcaaattccgtgagggccattcaccatctcagagacaattacaagaacaccctttanctgacaaatagacagcctagagaccagacgacacgctgtactattattgcgcgagagagacacacgaacctactcgaccaatactagtggggtcttgttcgtcgggccgagggacccgtggtacagtcgtcctccccgacgccctaccgacccgaacggccccacgtccggtcccttcccccgtcggtccgccctcg

SEQ ID NO: 22669 - DNA, 541 bp, Homo sapiens
  misc_feature: GYAE6OF02IJT2A.12.40.D07.1.454.CMB.1.raw
  modified_base (357)..(357): a, c, t, g, unknown or other
  misc_feature (357)..(357): n is a, c, g, or t
  modified_base (492)..(492): a, c, t, g, unknown or other
  misc_feature (492)..(492): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaacaaattctacgcaaattccgtgaggggccattcaccatctcagagacaattacaagacaccctttanctgacaaatagacagcctgaacgaccagacgacacggctgtctattatgcgcgagagagacacacgaacctactggaccaatactagtggggtcttgttcgtgggccaggggccctggtcatccgtcctcccganccctcacccgacggccctacgtccggtccttccccgtggccgcccgtcg

SEQ ID NO: 22670 - DNA, 594 bp, Homo sapiens
  misc_feature: GYAE6OF02IUFDB.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaaccacccttatctgacaaatagacagcctgacgaccagacgacacggctagtctattattgcgcgagagagacacacgaacctactgaccaatactagtgggggtctttggttcgtcggggtacccagggggtaccccttgggtaccacgttccgtcctcccccgacggtccctacccgaacccgaaccgggtccccaacggttcccgggttcccttcccccggtcgggcccgtccccgttccgg

SEQ ID NO: 22671 - DNA, 571 bp, Homo sapiens
  misc_feature: GYAE6OF02JD2X5.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtcaacaattctacgcaaattccgtgaggggccattcaccatctccagagacaattacaagaacaccctttatctgacaaatagacagcctgagaccagacgacacggctgtctattattgcgcgagagagacacacgaacctactcggaccaatactagtacgggggtcttgttcgtcggggcctagggggacccctggtcacttcgtcctccccgtacggtccctccgacccgaacgggtccccaacgttccggtaccttcccccgtcgggtcccgtccctcgg

SEQ ID NO: 22672 - DNA, 541 bp, Homo sapiens
  misc_feature: GYAE6OF02GHF00.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtggggcttgttctggggccaggggaccctggtcagtcgtcctcccgagccctccgaccaacgggcccatccggtccttcccccgtggccgccctcg

SEQ ID NO: 22673 - DNA, 538 bp, Homo sapiens
  misc_feature: GYAE6OF02HSTWE.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttatctgcaaatagacagcctgagaccagacgacacggctgtctattattgcgcgagagagacacacgaacctactgccaatactatgggggcttgttcgtggggccaggggacctggtcagtcgtctccccgagccctccaccaacggcccagtccggtccttcccccgtggccgccctcg

SEQ ID NO: 22674 - DNA, 597 bp, Homo sapiens
  misc_feature: GYAE6OF02I0YM7.12.40.D07.1.454.CMB.1.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcgtccctgacactcgcctgtgttgcctctggtatttcccttnaatttctattccatgcactgggtccnccaggctccaggcaaggggctcgagtgggtgcacttattgcacatgatggcgtcaaacaaattctacgcaaattccgtggaggggccattcaccatcctcagagacaattacaagaacctacccttatctgacaaatagacagcctagacgaccagacgacacggctgtctatatgcgagagagagacaacacgaacctacgtacgacctaatacgtagtacgggggtacttcggtttcgtcggggtccgtaacggggtacccgtgggtaccgacgttccgttaccgtccccgaacgtcccctaccgacccgaaccgggccctacggtccggttcccttcccccgtcggcccgtcccgtccg

SEQ ID NO: 22675 - DNA, 581 bp, Homo sapiens
  misc_feature: GYAE6OF02HZUYD.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaacaattcacgcaaattccgtgaggggccattcaccatctccagagacaattacaagaacaccctttatctgacaaatagacagcctgacgaccagacgacacggctgtctattatgcgcgagagagacacacgaactactcggaccaatacgtagtggggtactttgttcgtcggggtccgacgggggtaccctgggtccagttccggtcctacccgacggtccctaccgaaccgaacgggccccgtaacgttcccggttcccttcccccgtcggtcccgtccccgtccgg

SEQ ID NO: 22676 - DNA, 601 bp, Homo sapiens
  misc_feature: GYAE6OF02JHV4K.12.40.D07.1.454.CMB.1.raw
  modified_base (430)..(430): a, c, t, g, unknown or other
  misc_feature (430)..(430): n is a, c, g, or t
tcagatacgacgtacacgaccggtgctcgatttagtgatagagcgtaacaacagagggctcaccatggagtttgggctgagctgggtttcctcgttgctcttttaagaggtgtccagtgtcaggggcacctggtggagtctgggggagccgtggtccagcctgggcggtccctgacactcgcctgtgttgcctctggactttcccttcaatttctattccatgcactgggtccgccaggcctccaggcaagggggctcgaggtgggtgcacttatgcacatgatcggcgtcaacaattctacgctaaacttccgtggaggggccctattccaccatctccagagactaattacaacgaactacccctttatacctgactaaaatagactacgcctagaagacccaagacacacggctagtactatatcgngcgagagagactacacgaacctactggacccaattacagttggggctttgtcgtcgggggacccagggggtaccctgggtacctagtcccggtctccccgaaggtcccttccgaaacccggacggacccctaggtcccgttacccgttcccccgtaggcccgtcccctcgg

SEQ ID NO: 22677 - DNA, 529 bp, Homo sapiens
  misc_feature: GYAE6OF02I0G9W.12.40.D07.1.454.CMB.1.raw
  modified_base (489)..(489): a, c, t, g, unknown or other
  misc_feature (489)..(489): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtggggcttgttcgtgggccaggggaccctggtcatcgtctcccngcctcaccaggcccatccggtccttccccnggccncctcg

SEQ ID NO: 22678 - DNA, 536 bp, Homo sapiens
  misc_feature: GYAE6OF02H22D4.12.40.D07.1.454.CMB.1.raw
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaaattccgtgaggggccattcaccatctccagagacaattacaagaacaccctttanctgcaaatgacngcctgagaccagacgacacggctgtctatattgcgcgagagagacacacgaactactggaccaatactatggggcttgttctggggccaggggacctggtcatcgtctccccgagccctccaccaacgggcccagtccggtccttcccccgtggccgccctcg

SEQ ID NO: 22679 - DNA, 539 bp, Homo sapiens
  misc_feature: GYAE6OF02GIZ9G.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttatctgcaaatagacagcctgagaccagacgacacggctgtctattattgcgcgagagagacacacgaacctactggccaatactagtgggggctttgttcgtggggccaggggaccctggtcatcgtctcccagccctccaccaacggcccagtccggtccttcccccgtggccgccctcg

SEQ ID NO: 22680 - DNA, 561 bp, Homo sapiens
  misc_feature: GYAE6OF02I7PWR.12.40.D07.1.454.CMB.1.raw
  modified_base (234)..(234): a, c, t, g, unknown or other
  misc_feature (234)..(234): n is a, c, g, or t
  modified_base (359)..(359): a, c, t, g, unknown or other
  misc_feature (359)..(359): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttattgcacatgatggctcaacaaattctacgcaaattccgtgaggggccgattcaccatctccagagacaattacaagaacaccctttanctgacaaatgacagcctgacgaccagacgacacggctgtctattattgcgcgagagagacacacgaacctacgtgaccaatactagtggggcttgttcgtggggccaggggaccctggtcagtccgtcctcccgacgccctaccaccgaacgggcccctaacgtcccggttcccttcccccgtcgggcccgtccccgtccgg

SEQ ID NO: 22681 - DNA, 597 bp, Homo sapiens
  misc_feature: GYAE6OF02JK1XA.12.40.D07.1.454.CMB.1.raw
  modified_base (234)..(234): a, c, t, g, unknown or other
  misc_feature (234)..(234): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcggagtgggtgcacttatgcacatgatggcgtcaacaaattctacgcaaattccgtgagggccattcaccatctccagagacaattacaagaacaccctttatctgactaaatagactagcctagagaccagacgacacggctgctatattgcgcgagagagacacgacgaacctatacggaccaagtactaagtcgggggtctttacggttaccgtaggggacccgtacgggggacccttgggtcctacgttcggtacccttccccgaaggtccctcccgaaccgaacgggacccctagtccccgggttccttaccccccggcggtaccgcccccgtacgg

SEQ ID NO: 22682 - DNA, 539 bp, Homo sapiens
  misc_feature: GYAE6OF02GK02J.12.40.D07.1.454.CMB.1.raw
  modified_base (361)..(361): a, c, t, g, unknown or other
  misc_feature (361)..(361): n is a, c, g, or t
  modified_base (434)..(434): a, c, t, g, unknown or other
  misc_feature (434)..(434): n is a, c, g, or t
  modified_base (528)..(528): a, c, t, g, unknown or other
  misc_feature (528)..(528): n is a, c, g, or t
tcagatacgacgtacacgaccggtgctcgatttagtgatagagcgtaacaactagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttanctgacaaatagacagcctgagaccagacgacacggctgtctattattgcgcgagagagacacacgaacctacngccaatactagtggggctttgttcgtggggccgagggaccctggtcatcgtctcccgagcctccaccgaacggcccagtccggtccttccccgnggccgccctcg

SEQ ID NO: 22683 - DNA, 882 bp, Homo sapiens
  misc_feature: GYAE6OF02GI6MU.12.40.D07.1.454.CMB.1.raw
tcagatacgacgtacacgaccggtgctcgatttagtgatagagcgtaacaacagagggctcaccatggagtttgggctgagcgtggtttccgtcgttaggctctttaagaggtgtccagtgtcaggggcacctggtggagtctggggggagccgtggtccagcctggggggtccgtcgacactcgtccgtcgtgttgtcctcctggtagtttcctttcctaactttactttacttacctactagtcgactcgggttccgggcccacggcgtccacggcgaacggggacggtccgaggtggggtgggcgaccttagtttgcacatagtataggtcggtctaaacaaaactttacttaccgaccgtaaaactttaccggttcggaagggggccgggaccttttacgtacccaacttccttacccgaacgaaggaacctaaatttaaacctaaacggaaacctaacccctttttaacttctacggaccaaaattaagaacgaacgaccgttacgaaggaacccaacggaaccggaaccgaaccgggtaccgttacggttacctttaaacgttttaagttttacggtccggccgggaaacgggaaggaacgggaaacctaaccgaaaccggtaaacccgttaaccgttacggtacccgaaacttaaacggttacgttacgggggggtcgtttacggttttaccggttacgggggacccgggtaaccggggtaacccgggttacccggttacgtaacgttccgtttacccgttacccccgtaccggtaaccccgttaccccgtaaccccggaaccggggttaacccgccgttacccggtttccccgtttacccccgttccggacccggtccccgttaccgttcccgg

SEQ ID NO: 22684 - DNA, 558 bp, Homo sapiens
  misc_feature: GYAE6OF02I6B2I.12.40.D07.1.454.CMB.1.raw
  modified_base (362)..(362): a, c, t, g, unknown or other
  misc_feature (362)..(362): n is a, c, g, or t
  modified_base (435)..(435): a, c, t, g, unknown or other
  misc_feature (435)..(435): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtggaggggccattcaccatctccagagacaattacaagaacaccctttanctgacaaatagacagcctgacgaccagacgacacggctgtctattattgcgcgagagagacacacgacctacngaccaatactagtaggggcttgttcgtggggccaaggggtccctggtcagtccgtcctcccgagccctccgacccgacgggccccacgtccggttcccttcccccgtcggtcccgcccgtccg

SEQ ID NO: 22685 - DNA, 783 bp, Homo sapiens
  misc_feature: GYAE6OF02FFK0B.12.40.D07.1.454.CMB.1.raw
  modified_base (151)..(151): a, c, t, g, unknown or other
  misc_feature (151)..(151): n is a, c, g, or t
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
tcagatacgacgtacacgaccggtgctcgatttagtgatagagcgtaacaacagagggctcaccatggagtttgggctgagctgggtttcctcgttgctctttaagaggtgtccagtgtcaggggccaccgtggtggagtcgtgggggacnccgtggtccagccgtgggccgtccctgaccactcgtcctgtgtcgcctctgtactttcctatattcatcatcgcgtacgtccgggtccnccgacggtccaccggaggcgagggtctcggtaggtggtcgctacgttntgacactgtacgacgtcggtacctaactaactacgttcaacgtaccgtaacgttccggagggtaccggtacctactacccgtaactacctaccgtaacgaaagtacctaaaccttaaactaaaccgtaaaccgttaacccttacgttacacgtaacaaacgtaacgacgtacgacgacgaaccgaaccgaccgaacgtacgaccggttaccgttgtaacgtttacgtacgttacggaccgacgggtaaaccgacgaaccgaacctaccgaaccaaccggttaaccgccggtaaccgtaacgttacgggttacggttaccggggtccggtttaccggttaccgggtcggggaaccccggtaccgggtacccttcggtaccgtacccgtcccgttccccgaaccccgtcccggtaacccgcccgtaaccccggtaaccgtccccgtaacgttccccgttcccgttacccccgcgccccggtacctcccgtaacccgg

SEQ ID NO: 22686 - DNA, 589 bp, Homo sapiens
  misc_feature: GYAE6OF02I3WZO.12.40.D07.1.454.CMB.1.raw
  modified_base (91)..(91): a, c, t, g, unknown or other
  misc_feature (91)..(91): n is a, c, g, or t
  modified_base (148)..(148): a, c, t, g, unknown or other
  misc_feature (148)..(148): n is a, c, g, or t
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (323)..(323): a, c, t, g, unknown or other
  misc_feature (323)..(323): n is a, c, g, or t
  modified_base (392)..(392): a, c, t, g, unknown or other
  misc_feature (392)..(392): n is a, c, g, or t
  modified_base (499)..(499): a, c, t, g, unknown or other
  misc_feature (499)..(499): n is a, c, g, or t
tcagatacgacgtacacgaccggtgctcgatttagtgatagagcgtaacaacagagggctcaccatggagtttgggctgagcgtggtttcncgttagctcttttaagaggtgtccagtgtcaggggcacctggtggagtctggggganccgtggtccagcctgggcggtccctgacactcgcctgtgttgcctctggatttcccttcaatttcattccatgcacgtcgtcgcagctcngcgaggcncgagtggtgcactatgcanatnatgcgtacaactaatactacgactaacttcgtgaggccgactcacactctcaganacaataacaacaactaccttactactacgacaatacgacacgactacgacgacacgacgacgacgactntactattagtagacgacgagagagacacgacaacctacgtacgacaactacgtagtaggtcgttcgttcgtcggcggacggtaccgtacgtacgtacgtaccgtccncgtccgtaccgtacccgtaccggtaacccggaacccggtaaccggtaccggttaccccggttacccggttacccggtaccccggtcccgg

SEQ ID NO: 22687 - DNA, 548 bp, Homo sapiens
  misc_feature: GYAE6OF02HW9DH.12.40.D07.1.454.CMB.1.raw
  modified_base (359)..(359): a, c, t, g, unknown or other
  misc_feature (359)..(359): n is a, c, g, or t
  modified_base (431)..(431): a, c, t, g, unknown or other
  misc_feature (431)..(431): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacacttgcctgtgttgcctctggatttcccttcaatttctattccatgcactgggtccgccaggctccaggcaaggggctcgagtgggtggcacttatgcacatgatggcgtcaacaaattctacgcaaattccgtgaggggccattcaccatctccagagacaattacaagaacaccctttanctgcaaatagacagcctagagaccagacgacacggctgtctattattgcgcgagagagacacacgaactacnggaccaatactaagtggggcttgttcgtcggggccaggggaccctgggtcacgtcgtcctcccgaagccctccgaaccacggcccacgtccggtccttccccgtggcccgtccctcg

SEQ ID NO: 22688 - DNA, 559 bp, Homo sapiens
  misc_feature: GYAE6OF02HE8AN.12.40.D07.1.454.CMB.1.raw
  modified_base (233)..(233): a, c, t, g, unknown or other
  misc_feature (233)..(233): n is a, c, g, or t
  modified_base (357)..(357): a, c, t, g, unknown or other
  misc_feature (357)..(357): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttattgcacatgatggcgtcaacaattctacgcaaattccgtgaggggccattcaccatctccagagacaattacaagaacaccctttanctgacaaatgacagcctgacaccagacgacacggctgtctattattgcgcgagagagacacacgaacctactggccaagttactagtgggggtcttgttcgtggggccacggggaccctggtcagtcgtactccccgagtccctaccaccgaacgggccctaacgttccggtccctttcccccggtaggtcccgccctacgg

SEQ ID NO: 22689 - DNA, 577 bp, Homo sapiens
  misc_feature: GYAE6OF02FZY6D.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgacgaccagacgacacggctgtctattattgcgcgagagagacacacgaacctactcggaccaataactagtgggggtctttggtttcgtggggaccgaggggtacccgtgggtcatccgtcctccccgacgtccctacccaacccgaaccggcccgtacgttccggtacccgttccccccgtcggcccgtcccctcgg

SEQ ID NO: 22690 - DNA, 563 bp, Homo sapiens
  misc_feature: GYAE6OF02GAPCA.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaaacaaattctacgcaaattccgtggaggggccattcaccatctccagagacaattacaagaaccaccctttatctgacaaatagacagcctgacgaccagacgacacggctgtctattattgcgcgagagagacacacgaacctactcgaccaatactagtcggggtctttgttcgtggggccgacggggaccctgggtcagtcgtcctccccgacgccctaccgaccgaacggcccacgtccggttccttcccccgtcggcccgcccgtccg

SEQ ID NO: 22691 - DNA, 583 bp, Homo sapiens
  misc_feature: GYAE6OF02HFKW1.12.40.D07.1.454.CMB.1.raw
  modified_base (234)..(234): a, c, t, g, unknown or other
  misc_feature (234)..(234): n is a, c, g, or t
  modified_base (362)..(362): a, c, t, g, unknown or other
  misc_feature (362)..(362): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtcaacaaattctacgcaaattccgtgagggccgattcaccatctccagagacaattacaagaacctaccctttanctgacaaatagacagcctgagaccagacgacacggctgtctattatgcgcgagagagacacaaccgaacctactcggaccaatacgtagtggggtctttgttcgtggggccgacggggaccctggtcacgtccgtctcccccgacgtccctacccgaaccgaacgggcccctaacgttcccgggttccctttccccccggtcggtccccgtccccgtccgg

SEQ ID NO: 22692 - DNA, 619 bp, Homo sapiens
  misc_feature: GYAE6OF02G8M98.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagccgtgggcggtccctgacactcgcctgtgttgcctctggtactttcccttactaattttctattccatgcacgtcgggtcccgccaggcctccgaggcgaaggggctcggaggtgggtggcacttattgcacatgatggcgtacaaactaattctacgactaaattccggtggacgggggcctagttccaaccagttcctccagacgactaattaacaaagaacctaccctttatctagacaaatagacacgcctagaacgactacgacgacgacggctagtactattatgcgcgagagagacacgaaccgaacctacgtcgacctaatactaggtcggggtctttcgttcggtcggggaccgacggggtaccctgggtactacgtccgtcctcccgacgccctaccggaggaccgtaccgtacccgtaccggacgacgacccgacgtaccgcccggg

SEQ ID NO: 22693 - DNA, 541 bp, Homo sapiens
  misc_feature: GYAE6OF02FR99R.12.40.D07.1.454.CMB.1.raw
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtggggcttgtcgtgggccaggggaccctggtcatcgtctcccagccctccaccaacggcccagtccggtccttcccccgtggccgtccctgtcccg

SEQ ID NO: 22694 - DNA, 575 bp, Homo sapiens
  misc_feature: GYAE6OF02H6MCB.12.40.D07.1.454.CMB.1.raw
  modified_base (334)..(334): a, c, t, g, unknown or other
  misc_feature (334)..(334): n is a, c, g, or t
  modified_base (365)..(365): a, c, t, g, unknown or other
  misc_feature (365)..(365): n is a, c, g, or t
  modified_base (441)..(441): a, c, t, g, unknown or other
  misc_feature (441)..(441): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaattttctattccatgcactgggtccgccaggctccaggcaaggggctcgagtgggtggcacttattgcacatgatggcgtcaacaaattctacgcaaattcagtgagggccattcaccatttcnccagagacaattacaagaacctaccttttanctagacaaaatacgacagcctggacaccagacgacacggctgtctattattgcgcgagagagacacacgaacctancggaccaatactagtggggcttgtcgtcgggccgagggaccctggtcacgttccgtcctccccgacgtccctacccgaacccgaacgggcccctaacggttcccggttcccttcccccgtcgggcccgtccccg

SEQ ID NO: 22695 - DNA, 529 bp, Homo sapiens
  misc_feature: GYAE6OF02JDCZ5.12.40.D07.1.454.CMB.1.raw
  modified_base (432)..(432): a, c, t, g, unknown or other
  misc_feature (432)..(432): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatgacagcctgagaccagacgacacggctgtctattattgcgcgagagagacacacgaacctacngccaatactatggggcttgtctggggccaggggaccctggtcatcgtctcccgagccctcaccaggcccacgtcgtccttccccgtggccgccctcg

SEQ ID NO: 22696 - DNA, 563 bp, Homo sapiens
  misc_feature: GYAE6OF02IU5PA.12.40.D07.1.454.CMB.1.raw
  modified_base (359)..(359): a, c, t, g, unknown or other
  misc_feature (359)..(359): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaacaaattctacgcaaattccgtgaggggccattcaccatctcagagacaattacaagaacaccctttanctgacaaatagacagcctgagaccagacgacacggctgtctattattgcgcgagagagacacacgaacctactgaccaatactagtggggcttggttcgtggggccgacggggtaccctggtcacgtcgtcctccccgacgtccctccgaacccgaacgggccccacgttccggtcccttcccccgtcggtcccgtccccgtcg

SEQ ID NO: 22697 - DNA, 583 bp, Homo sapiens
  misc_feature: GYAE6OF02GWW2J.12.40.D07.1.454.CMB.1.raw
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagacacctttanctgcaaatnacagcctgagaccagacgacacggctgtctattatgcgcgagagagacacaacgaacctactcggaccaatactagtgggggactttggttcgtcggggacccgagggggtacccctgggtaccacgttccgttcctccccgaggtcccctaccacccgaacgggccccagttacccggttcccttccccccgtcgggcccgtccccgtcgtcccg

SEQ ID NO: 22698 - DNA, 553 bp, Homo sapiens
  misc_feature: GYAE6OF02IKSMJ.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtcaacaattctacgcaaattccgtgaggggccattcaccatctccagagacaattacaagaacctacccttatctgacaaatagacagcctgacgaccagacgacacggctgtctattattgcgcgagagagaaccacacgaacctacacgccaatacagtggggcttgtcgtgggccacggggacctggtctagtcgtacctcccgacgtccctccgaacccgaacgggccctacgtccggtcccttccccgtcgcccggccctcg

SEQ ID NO: 22699 - DNA, 556 bp, Homo sapiens
  misc_feature: GYAE6OF02GKE22.12.40.D07.1.454.CMB.1.raw
  modified_base (138)..(138): a, c, t, g, unknown or other
  misc_feature (138)..(138): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(556): a, c, t, g, unknown or other
  misc_feature (537)..(556): n is a, c, g, or t
tcagatacgacgtacacgaccggtgctcgatttagtgatagagcgtaacaacagagggctcagcccaaactcctagtggtgagtccctcgttcgtgtttcagtcgaatgatccacccgaatggaacacgacgcggccnggctgccgtggtcacggtctacgttccgtacggtcgtacgtccgtacggacggaccggggaccgtacgggaccgaaacgggtccggtaccgtacggtacggtcgtacgttacgtcgtacgttacgtacgttacgtacgtaacgtacgtaccgactacgtaacgtacgacgtacgtacgtacgtacggtacggtcgtcggttgttcggtcgttcggttagtccgggttacctcgtaccggttaccgacgtaccgtcgaccgccggacggtccgaccggtcgaccggtcggccgaccggtccgtccggtaaccggtcgtaacgtccgttaacgtacgtccgtcgttaacggtcgtacggtacgcggtcggacgacgtgaacgggcaggcgcgagngngngnnnnnnnnnnnnnnnnnnnn

SEQ ID NO: 22700 - DNA, 552 bp, Homo sapiens
  misc_feature: GYAE6OF02H2FDG.12.40.D07.1.454.CMB.1.raw
  modified_base (365)..(365): a, c, t, g, unknown or other
  misc_feature (365)..(365): n is a, c, g, or t
tcagatacgacgtacacgaccggtgctcgatttagtgatagagcgtaacaaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgcaggctccaggcaaggggctcgagtgggtggcacttattgcacatgatggcgtcaaacaaattctacgcaaattccgtgacggggccattcaccatcctccagagacaattacaagaaccaccctttaanctgacaaatagacagcctgagaccagacgacacggctagtctattattgcgcgagagagacacacgaacctactcgaccaatactagtgggggctttgttcgtgggccgtacgggaccctggtcactcgtcctccccgcgccctaccgaccgaacggcccacgtcggtccttccccgtgccgcctcg

SEQ ID NO: 22701 - DNA, 575 bp, Homo sapiens
  misc_feature: GYAE6OF02JFG8Y.12.40.D07.1.454.CMB.1.raw
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
tcagatacgacgtacacgaccggtgctcgatttagtgatagagcgtaacaacagagggctcaccatggagtttgggctgagcggtggtttcgtcgtaggctctttaagaggtgtccagtgtcaggggcacctgggtggagtctggggggagccgtggtccagcctgggcggtccctgacactcgcctgtgttgcctctggatttcccttcaatttctattccatgcacgtgggtccgccaggctccaggcaaggggctgagtgggtgcattatgcacatgatggctnaacaaattcagcaattccgngagggcatcacatcncngagactaatacaagactaccttanctgacaaatagacagtccngacgacagacgacacggctntntattatgcgcgagagagacacacgaactacgtacgacaactacgtagtagggtcgttcgttcggtcgggaccggtacgggtaccggtcggtacgtacgtccgtccgtcccgtaccgtaccctacccgacccgtaaccggacccgtaccgtcccggttcccgttccccgtccggtccgtcccgtccg

SEQ ID NO: 22702 - DNA, 543 bp, Homo sapiens
  misc_feature: GYAE6OF02GJ0SM.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttatctgcaaatagacagcctgagaccagacgacacggctgtctattattgcgcgagagagacacacgaacctactggaccaatactagtgggggcttgttcgtggggccaggggaccctggtcagtcgtctcccgagccctccaccgaacggcccacgtccggtccttcccccgtggccgccctcg

SEQ ID NO: 22703 - DNA, 572 bp, Homo sapiens
  misc_feature: GYAE6OF02JYTKR.12.40.D07.1.454.CMB.1.raw
  modified_base (235)..(235): a, c, t, g, unknown or other
  misc_feature (235)..(235): n is a, c, g, or t
  modified_base (309)..(309): a, c, t, g, unknown or other
  misc_feature (309)..(309): n is a, c, g, or t
  modified_base (357)..(357): a, c, t, g, unknown or other
  misc_feature (357)..(357): n is a, c, g, or t
  modified_base (431)..(431): a, c, t, g, unknown or other
  misc_feature (431)..(431): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaacaattcacgcaaattccgngagggccattcaccatctccagagacaattacaagaaccaccctttanctagacaaatcgacagcctagagaccagacgacacggctgtctattatgcgcgagagacgacacacgaactacncgaccaatacgtagtaggggtctttcggttcgtacgggccgacggggtaccctgggtcacgttcgtacctccccgacgtccctaccgaacccgaacggccctacgttcccggtccttcccccgtcggcccgtcccgtccgg

SEQ ID NO: 22704 - DNA, 573 bp, Homo sapiens
  misc_feature: GYAE6OF02H5NH0.12.40.D07.1.454.CMB.1.raw
  modified_base (236)..(236): a, c, t, g, unknown or other
  misc_feature (236)..(236): n is a, c, g, or t
tcagatacgacgtacacgaccggtgctcgatttagtgatagagcgtaacaacagagggctcaccatggagtttgggctgagctgggttttcctcgttgctctttttaagaggtgtccagtgtcaggggcacctggtggagtctgggggagccgtggtccagcctgggcggtccctgacactcgcctgtgttgcctctggatttcccttcaattttctattccatgcactgggtccnccaggctccaggcaagggggctcgagtgggtggcacttattgcacatgatggcgtcaacaaattctaacgcaaattccgtgagggccgattcaccatctccagagacaattacaagaacaccctttatctgacaaatagacagcctgagaccagacgacacggctgtacttattattgcgcgagagagaacacacgaacctactgaccaagtactagtggggctttgttccgtgggccgacggggaccctggtcagtccgtcctcccgacgccctacccaccgaacggccccgtaagtcccggttcccgttcccccgtcggaccccgtcccgtccgg

SEQ ID NO: 22705 - DNA, 548 bp, Homo sapiens
  misc_feature: GYAE6OF02G1HR4.12.40.D07.1.454.CMB.1.raw
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgacaaatagacagcctagacgaccagacgacacggctgtctattattgcgcgagagagacacacgaacctactcgaccaatactagtggggtcttgttcgtgggccgacggggacctggtcactcgtcctcccgacgtccctccgaccgacggccacgtccggtccttcccccgtggccgccctcg

SEQ ID NO: 22706 - DNA, 546 bp, Homo sapiens
  misc_feature: GYAE6OF02FKQJ5.12.40.D07.1.454.CMB.1.raw
  modified_base (432)..(432): a, c, t, g, unknown or other
  misc_feature (432)..(432): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaaagaacaaccctttatctgcaaatagacagcctgagaccagacgacacggctgtctattatgcgcgagagagacacacgaacctacngccaatactatgggggcttgttcgtggggccgaggggaccctgggtcagtcgtcctccccgagccctccacccgaacggcccacgtccggtccttcccccgtggccgccctcgg

SEQ ID NO: 22707 - DNA, 539 bp, Homo sapiens
  misc_feature: GYAE6OF02ITDH2.12.40.D07.1.454.CMB.1.raw
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgagggccgattcaccatctccagagacaattacaagaacaccctttanctgcaaatagacagcctgagaccagacgacacggctgtctattattgcgcgagagagacacacgaacctactagccaatactagtggggcttgttcgtggggccaggggaccctggtcatcgtctcccgagcctccaccaacgggcccagtccggtccttcccccgtggtccgccctcg

SEQ ID NO: 22708 - DNA, 590 bp, Homo sapiens
  misc_feature: GYAE6OF02GPG5S.12.40.D07.1.454.CMB.1.raw
  modified_base (242)..(242): a, c, t, g, unknown or other
  misc_feature (242)..(242): n is a, c, g, or t
  modified_base (467)..(467): a, c, t, g, unknown or other
  misc_feature (467)..(467): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcgaggggcacctggtggagtcgtggggggagccgtggtccagccgtgggcggtccctgacactcgcctgtgttgcctctggactttcccttcaattttctattccatgcacgtgggtccnccaggcctccgaggcgaaggggctcggaggtggggtggcacttattgcacatgatggcgtacaaacaaatttctaacgactaaaagtttccggtggacgggggcctattccaaccatcctccaagagacaattacaagaacctaccctttatctgacaaatagacagcctagacgacagacgacacggctgtactattatgcgcgagagagacacacgactacgngacctaatacgtagtcggggtcttgttcgtcggggccgaggggtccctggtcacgtcgtcctcccgcgtccctccgaacccgacgggcccagttccggtccttccccgtcggcccgtcctccg

SEQ ID NO: 22709 - DNA, 569 bp, Homo sapiens
  misc_feature: GYAE6OF02IYF88.12.40.D07.1.454.CMB.1.raw
  modified_base (436)..(436): a, c, t, g, unknown or other
  misc_feature (436)..(436): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaactggtggagtctgggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaacaaattcacgcaaattccgtgaggggccgattcaccatctccagagacaattacaagaactacccttatctagacaaatagacagcctagacgaaccagacgacacggctgtctattattgcgcgagagagacacacgaacctacncggaccaatactagtggggtcttgttcgtggggacccgaggggtacccgtggtcacgttcgtcctccccgagccctccaaccgaacgggcccctacgttccggtcccgttcccccgtcggtcccgcccgtccg

SEQ ID NO: 22710 - DNA, 562 bp, Homo sapiens
  misc_feature: GYAE6OF02HXZR6.12.40.D07.1.454.CMB.1.raw
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
tcagatacgacgtacacgaccggtgctcgattttagtgatagagcgtaacaacaggggactcaccatggagtttgggctgagcgtggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaagggggctcgagtgggtggcacttattgcacatgatggcgtcaacaaattctacgcaaattccgtgaggggccgattcaccatctcagagacaatacaagactaccttatctgcaatagacagcctgacgacagacgacacggctgtactattattgcgngaganagacacacgaacctacgngaccaatacgtagtcggggcttgtcgtcgggccgacggggaccctggtcactccgtcctacccgacgccctaccaccgaacggccccagttccggttcccttcccccgtcggcccgtccccgtgtccccg

SEQ ID NO: 22711 - DNA, 574 bp, Homo sapiens
  misc_feature: GYAE6OF02GOCY1.12.40.D07.1.454.CMB.1.raw
  modified_base (361)..(361): a, c, t, g, unknown or other
  misc_feature (361)..(361): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttanctgacaaatagacagcctgacgaccagacgacacggctgtctattatgcgcgagagagacacacgaacctactgaccaatactagtgggggctttgttcgtggggccgacggggaccctgggtcacgttccgtcctccccgacgccctacccgaacccgtaacgggcccctacgtccgggttcccttccccccggtcggtcccgcccctccgg

SEQ ID NO: 22712 - DNA, 579 bp, Homo sapiens
  misc_feature: GYAE6OF02HUO0Q.12.40.D07.1.454.CMB.1.raw
  modified_base (233)..(233): a, c, t, g, unknown or other
  misc_feature (233)..(233): n is a, c, g, or t
  modified_base (410)..(410): a, c, t, g, unknown or other
  misc_feature (410)..(410): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgaggtgggtggcacttattgcacatgatggcgtcaacaaattactacgacaaattccggtggaggggaccgattacaccatcctccagagacaatacaacgaacaccctttatctgcaaatagacagcctagagaaccagacgacacggactgtntattattgcgcgagagagacacacgaacactcgaccaatactacgtaggggcgttgttcgtcgggccgacggggaccgtaggtacacttcgtcccgtcccgaccgcccgttaccaccgtaaccggcccgacgttccggtccgttccccccgtcggtcccggccctccgg

SEQ ID NO: 22713 - DNA, 564 bp, Homo sapiens
  misc_feature: GYAE6OF02HAWCM.12.40.D07.1.454.CMB.1.raw
  modified_base (235)..(235): a, c, t, g, unknown or other
  misc_feature (235)..(235): n is a, c, g, or t
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
  modified_base (439)..(439): a, c, t, g, unknown or other
  misc_feature (439)..(439): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccnccaggctccaggcaaggggctcgagtgggtggcacttattgcacatgatggcgtcaacaaattctacgcaaattccgtgagggccgattcaccatctccagagacaattacaaagaaccaccctttanctagacaaatagacagcctaganaccagacgacacggctgtactattattgcgcgagagagacacacgaacctacncgaccaatactagtcggggcttgtcgtgggccgaggggaccctggtacacgttccgtcctccccgacgccctaccgacccgacgggcccacgtccggtccttcccccgtcggcccgtcccgtccg

SEQ ID NO: 22714 - DNA, 557 bp, Homo sapiens
  misc_feature: GYAE6OF02GQVEI.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacacccttatctgacaaatagacagcctgacgaccagacgacacgctgtctattatgcgcgagagagacacacgaacctactcgaccaatactagtcggggtcttgttctggtcgccgagggaccctggtcagtccgtccgtccccacgccctaccacccgaacggccctacgtcccggttacccttcccccgtcggcccgtccccg

SEQ ID NO: 22715 - DNA, 564 bp, Homo sapiens
  misc_feature: GYAE6OF02JAS75.12.40.D07.1.454.CMB.1.raw
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtcaacaaattctacgcaaattccgtgaggggccgattcaccatctccagagacaattacaagaacaccctttanctgacaaatagacagctgacgaccagacacacgctgtctattattgcgcgagagagacaacacgaacctacgacgaccaatactagtgggggtctttgttcgtggggaccaggggaccctggtcgagttcgtcctccccacgccctaccgaaccgaacgggccctacgtccggttcccttacccccgtcggtcccgtcccgtcg

SEQ ID NO: 22716 - DNA, 595 bp, Homo sapiens
  misc_feature: GYAE6OF02G5OUC.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccgccaggctccaggcaaggggctcggaggtgggtggcacttattgcacatgatggcgtcaaactaaattctacgctaaattccgtggaggggccattcaccatctccaagagacaattaacaagaacctaccctttatctagactaaatagacagcctagacgaccagacgacgacgctgtatattatgcgcgagagagacacacgaacctacgtgaccaatacgtagtacggggtacttgttcgtacggggccgaacggggaccctggtacacgttccgtccgtccccgaggtccctacccgacccgaaccgggcccacggttcccggtcccgttacccccgtcggtcccgcccgtaccgg

SEQ ID NO: 22717 - DNA, 575 bp, Homo sapiens
  misc_feature: GYAE6OF02F9VUI.12.40.D07.1.454.CMB.1.raw
  modified_base (235)..(235): a, c, t, g, unknown or other
  misc_feature (235)..(235): n is a, c, g, or t
  modified_base (359)..(359): a, c, t, g, unknown or other
  misc_feature (359)..(359): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtggcacttattgcacatgatggctcaacaattctacgcaaattccgtgaggggccattcaccatctacagagacaattacaagaacaccctttanctagacaaatagacagcctgaacgaccagaccgacacggctgtactattattgcgcgagagagacacacgaacctactcggacaatactagtggggtcttggttcgtggggccgaacggggacccgttgggtcagtccgttcctccccgacgtccctacccaaccgaaccggccctacgttccggttcccttcccccgtcggtcccgtcccgtccg

SEQ ID NO: 22718 - DNA, 592 bp, Homo sapiens
  misc_feature: GYAE6OF02HLODK.12.40.D07.1.454.CMB.1.raw
  modified_base (379)..(379): a, c, t, g, unknown or other
  misc_feature (379)..(379): n is a, c, g, or t
  modified_base (452)..(452): a, c, t, g, unknown or other
  misc_feature (452)..(452): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaattttctattccatgcactgggtccgccaggctccaggcaaggggctcgagtgggtgcacttattgcacatgatggcgtcaaacaaattctacgactaaagttccgtaggacggggccgatttccacctatcctccaagagactaaattacaaagaacctaccctttanctgacaaaatgacagcctgacgaccagacgacacgctgtctattatgacgcgagagagacacacgaacctacngaccaatacaggtggggtcttggttcgtcggggaccgtacggggtaccctggtacacgtcgtccctaccccgacgccctaccgaacccgaaccgggcccctacgtcccggttccccttcccccgtggccccgtccctcgg

SEQ ID NO: 22719 - DNA, 542 bp, Homo sapiens
  misc_feature: GYAE6OF02G57ET.12.40.D07.1.454.CMB.1.raw
  modified_base (360)..(360): a, c, t, g, unknown or other
  misc_feature (360)..(360): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttanctgacaaatagacagcctgagaccagacgacacggctgtctattattgcgcgagagagacacacgaacctactaggccaatactaagtgggggcttgttcgtggggccaggggaccctggtcagtcgtctccccgagcctccaccaacggcccagtccggtccttccccgtggccgccctcg

SEQ ID NO: 22720 - DNA, 546 bp, Homo sapiens
  misc_feature: GYAE6OF02HK7K6.12.40.D07.1.454.CMB.1.raw
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtgatccagcctgggcggtccctgacactcgcctgtgttgcctctggatttcccttcaatttctattccatgcactgggtccgccaggctccaggcaaggggctcgagtgggtgcacttatgcacatgatggcgtcaacaaattctacgcaaattccgtgaggggccattcaccatctccagagacaattacaagaacaccctttanctgacaaatagacagcctaganaccagacgacacgctgtctattattgcgcgagagacgacacacgaacctactggaccaatactagtgggggcttggttcgtcggggccgagggaccctgggtcacgtcgtcctcccgacgccctccgaccacgggcccacgtccgtccttccccgtggccctcccg

SEQ ID NO: 22721 - DNA, 554 bp, Homo sapiens
  misc_feature: GYAE6OF02GDEBB.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttatctgacaaatagacagccctgagaccagacacacggctgtctattattgcgcgagagagacacacgaacctactgaccaatactagtggggctttgttcgtggggccgaggggaccctgggtcagtcgtcctccccgagccctacccaaccgaacgggcccaacgttccggtccttcccccgtggcccgccctcg

SEQ ID NO: 22722 - DNA, 546 bp, Homo sapiens
  misc_feature: GYAE6OF02JD7M9.12.40.D07.1.454.CMB.1.raw
  modified_base (234)..(234): a, c, t, g, unknown or other
  misc_feature (234)..(234): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtactattattgcgcgagacgagacaacacgaacctactggccaatactatggggcttggttcgtggggccaggggaccctgggtcacgtcgtctccccgagcctcgacccaacggcccacgtccggtccttccccgtggccgcctccg

SEQ ID NO: 22723 - DNA, 549 bp, Homo sapiens
  misc_feature: GYAE6OF02H59GK.12.40.D07.1.454.CMB.1.raw
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccgccaggctccaggcaaggggctcgagtgggtggcacttattgcacatgatggcgtcaacaaattctacgctaaattccgtggaggggccgattcaccatctccagagacaattacaagaactacccttatctagcaaatagacagcctgagaccagacgacacggctgtcttattattgcgcgagagagacacacgaacctactgaccaatactagtgggggtcttgttcgtcggggccgacggggacccgtgggtcatcgtcctcccgacgcctccaaccgacggcccatccggtccttccccgtggccgcctcg

SEQ ID NO: 22724 - DNA, 565 bp, Homo sapiens
  misc_feature: GYAE6OF02H3QSL.12.40.D07.1.454.CMB.1.raw
  modified_base (412)..(412): a, c, t, g, unknown or other
  misc_feature (412)..(412): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtcccgcaggctccaggcaaggggctcgagtgggtggcacttattgcacatgatggcgtcaacaaattctacgcaaattccgtgaggggccattcaccatctccagagacaattacaagaacctacccttatctgacaaatagacagcctgacgaccagacgacacggctgtctattatgcncgagagagaacacaccgaactacgtaggaccaagtactagtggggcttgttcgtggggccgaggggaccctgggtcacgtcgtcctcccgagtccctccaacccgaacgggcccgacgttaccggtcccgttcccccgtggcccgcccgtcgg

SEQ ID NO: 22725 - DNA, 581 bp, Homo sapiens
  misc_feature: GYAE6OF02JKR3G.12.40.D07.1.454.CMB.1.raw
  modified_base (234)..(234): a, c, t, g, unknown or other
  misc_feature (234)..(234): n is a, c, g, or t
  modified_base (310)..(310): a, c, t, g, unknown or other
  misc_feature (310)..(310): n is a, c, g, or t
  modified_base (328)..(328): a, c, t, g, unknown or other
  misc_feature (328)..(328): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgaggtgggtgcacttatgcacatgatggctacaacaattctacgcaaattccgngagggccattcaccatcnccagagacaattacaagaaccacccttatcctagacaaatacgacagcctagaacgaccaagaccgacacggctgtactattatgcgcgagagagacacaacgaacctacgtacgacctaatacgtagtacggggtcttgttcgtcggggaccgacgggtacctggtcacgtccgtcctcccgaacgtcctaccgaacccgtaacggcccgtacgttcccggttcccgttcccccgtcggtcccgccccgtcg

SEQ ID NO: 22726 - DNA, 629 bp, Homo sapiens
  misc_feature: GYAE6OF02GLZI2.12.40.D07.1.454.CMB.1.raw
  modified_base (241)..(241): a, c, t, g, unknown or other
  misc_feature (241)..(241): n is a, c, g, or t
  modified_base (420)..(420): a, c, t, g, unknown or other
  misc_feature (420)..(420): n is a, c, g, or t
tcagatacgacgtacacgaccggtgctcgatttagtgatagagcgtaacaacgagagggctcaccatggagtttgggctgagctgggttttccctcgttgctcttttaagaggtgtccagtgtcaggggcacctggtggagtctggggggagccggtggtccagcctgggcggtccctgacactcgcctgtgttgcctctggatttcccttgaatttctattcccatgcacgtggggtccnccaggctccgagggcaaggggctcgagtggggtggcacttatgcacatgatcggcgtacaacaaatttctaacaactaaagttcccggtaggacgggggccctaatttcccaacctacgtcctacccgaaggaacgaacctaaactttaccgaaacggtaaacctaacccctttttaanccgtaggactaaaacgttagaacaagccctaggacgaccagaccgacacggctgtctattattgcgagagagagacacacgtaactactgacctaatacgtagtaggggtcttagttcgtgggtccgtacgggtaccgtgtcgacgtcgtcctccgcgcctaccgacgacggccctacgtccggtccttccccgtcggcccgtccgtcg

SEQ ID NO: 22727 - DNA, 555 bp, Homo sapiens
  misc_feature: GYAE6OF02H20JF.12.40.D07.1.454.CMB.1.raw
  modified_base (363)..(363): a, c, t, g, unknown or other
  misc_feature (363)..(363): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtcaacaaattctaacgcaaatttccgtggaggggccattcaccatctccagagacaattacaagaactaccctttanctgacaaatacgacagcctagacgaccagacgacacggctgtctattatgcgcgagagagacacacgaacctactgacctaatactagtggggtcttgttcgtgggccgacggggaccctggtcattccgtctccccagccctaccgaccgacggcccagtccggtccttccccgtggcccgtccctgcccg

SEQ ID NO: 22728 - DNA, 568 bp, Homo sapiens
  misc_feature: GYAE6OF02I9892.12.40.D07.1.454.CMB.1.raw
  modified_base (356)..(356): a, c, t, g, unknown or other
  misc_feature (356)..(356): n is a, c, g, or t
tcagatacgacgtacacgaccggtgctcgatttagtgatagagcgtaacaacagaggactcaccatggagtttgggctgagcgtggtttcgtcgtaggctctttaagaggtgtccagtgtcaggggcacctggtggagtctgggggagccgtggtccagcctgggcggtccctgacactcgcctgtgttgcctctggatttcccttcaatttctattccatgcactgggtccgcaggctccaggcaaggggctcgagtgggtggcacttattgcacatgatggctcaacaaattctacgcaaattccgtgaggggccattcaccatctcagagacaattacaagaacaccctttanactgacaaatagacagcctagacgaccagacgacacggctgtctattattgcgcgagagagacacacgaacctactggaccaatactagtggggtacttgttcgtcggggcctaagggggccctggtacgactcgtacctccccgaggccctacccgaccgaacgggcccctacgtccgggttcccttacccccgtcggcccgcccgtccgg

SEQ ID NO: 22729 - DNA, 590 bp, Homo sapiens
  misc_feature: GYAE6OF02JMPOY.12.40.D07.1.454.CMB.1.raw
  modified_base (234)..(234): a, c, t, g, unknown or other
  misc_feature (234)..(234): n is a, c, g, or t
  modified_base (369)..(369): a, c, t, g, unknown or other
  misc_feature (369)..(369): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtacaacaaattctaacgcaaattccgtagaggggcctattccgaccatctccaggagactaattacaaagaacctaccctttancctagacaaaatcgacagcctagacgaccagaccgacacgctgtctattatgcgcgagagagacacacgaacctacgtcgaccaatacgtagtcggggcttgtcgtacggggccacggggtaccctggtacacgttccggtcctacccgtaacgccctacccgaaccgaacggtccccgtacgttcccggtcccttacccccgtcggtcccgcccttccgg

SEQ ID NO: 22730 - DNA, 555 bp, Homo sapiens
  misc_feature: GYAE6OF02IJJ9C.12.40.D07.1.454.CMB.1.raw
  modified_base (149)..(149): a, c, t, g, unknown or other
  misc_feature (149)..(149): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (358)..(358): a, c, t, g, unknown or other
  misc_feature (358)..(358): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcggtccctgacactcgcctgtgttgcctctggatttcccttnaatttctattccatgcactgggtccnccaggctccaggccaaggggctcgagtgggtgcacttattgcacatgatggcgtcaacaaattcacgcaaattccgtgaggggccattcaccatctccagagacaattcaagacacccgtttanctgacaaatgacagcctagagaccagacgacacggctgtctatattgcgacgagagagacacacgaacctactgaccaatactagtggggtcttagttcgtgggccaggggtaccctggtacagtccgtctccccgatcccgtaccgaccgtaacggtcccacgtccggtacccttccccgtggcccgtccctccgg

SEQ ID NO: 22731 - DNA, 555 bp, Homo sapiens
  misc_feature: GYAE6OF02F8LIQ.12.40.D07.1.454.CMB.1.raw
  modified_base (234)..(234): a, c, t, g, unknown or other
  misc_feature (234)..(234): n is a, c, g, or t
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaacaaattctacgcaaattccgtgaggggccattcaccatctccagagacaattacaagaacctaccctttanctgacaaatgacagcctgacgaccagacgacacgctgtctattatgcgcgagagagacacacgaacctactgaccaatactagtggggtcttgttcgtcgggccgacgggaccctggtcgacgtcgtcctcccgacgccctaccgacccgaacgggcccacgttcccggtcccttccccgtcggcccgcccgtcg

SEQ ID NO: 22732 - DNA, 541 bp, Homo sapiens
  misc_feature: GYAE6OF02GRIB9.12.40.D07.1.454.CMB.1.raw
  modified_base (234)..(234): a, c, t, g, unknown or other
  misc_feature (234)..(234): n is a, c, g, or t
  modified_base (361)..(361): a, c, t, g, unknown or other
  misc_feature (361)..(361): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtcaacaaattctacgcaaattccgtgaggggccattcacatctccagagacaattacaagaacctaccctttanctagacaaatagacagcctagacgaccagacgacacggctgtctattatgcgcgagagagacacacgaacctactgaccaatactagtgggtcttgttcgtgggccagggaccctggtcagtcgtcctcccgagccctccgaccacggcccagtccggtccttccccgtggccgccctcg

SEQ ID NO: 22733 - DNA, 649 bp, Homo sapiens
  misc_feature: GYAE6OF02JD95Z.12.40.D07.1.454.CMB.1.raw
  modified_base (233)..(233): a, c, t, g, unknown or other
  misc_feature (233)..(233): n is a, c, g, or t
tcagatacgacgtacacgaccggtgctcgatttagtgatagagcgtaacaacagagggctcaccatggagtttgggctgagctgggttttcctcgttgctctttaagaggtgtccagtgtcaggggcacctggtggagtctgggggagccgtggtccagcctgggcggtccctgacactcgcctgtgttgcctctggatttcccttcaatttctattccatgcactgggtccnccaggctcaggcaaggggctcggagtggggtgcacttatgcacatgatggctacaaataattctacgacaaattccgtaggacggggccattcacctatctaccagacgacaattacaagaacctacctttatctagactaaatacgacagacctaggacacccagaaccgacacggactgtactattatgacgtacgagagagacaacgaaccgtaacctacgtagacctaataacgtagtacggggtactttcggttacggtacgggggtacccgtacgggggtaaccctacgggttaccgacgttccggtacccgtaccccgacgtaccccgttacccgtaacccgaaccgggtcccctaacggttcccgggttacccctttcccccggtacgggtccccgtccccttcccgg

SEQ ID NO: 22734 - DNA, 587 bp, Homo sapiens
  misc_feature: GYAE6OF02I32IB.12.40.D07.1.454.CMB.1.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (382)..(382): a, c, t, g, unknown or other
  misc_feature (382)..(382): n is a, c, g, or t
  modified_base (463)..(463): a, c, t, g, unknown or other
  misc_feature (463)..(463): n is a, c, g, or t
  modified_base (492)..(492): a, c, t, g, unknown or other
  misc_feature (492)..(492): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctgggtggagtctgggggagccgtggtccagcctgggcggtccctgacactcgcctgtgttgcctctggatttcccttnaatttctattccatgcactgggtccnccaggcctccaggcaaggggctcggagtgggtgcacttatgcacatgatggcgtacaactaattcacgctaaaattccggtaggagggggccctagttcacctatcctacaggcaactaagttaccaaagtaacctacccttttaancctagacaaaactgactagcctgaacgaccagaccgaacacgctgtctattatcgcgacgagagacgacacacgaacctancgaccaatacgtagtggggtcttgttcgngggaccgacgggtaccgtggtctagtcgtcctcccacggtccctaccaccgaacggtcccagtccggttccttccccgtggcccgtccctgcccg

SEQ ID NO: 22735 - DNA, 606 bp, Homo sapiens
  misc_feature: GYAE6OF02HRPU7.12.40.D07.1.454.CMB.1.raw
  modified_base (234)..(234): a, c, t, g, unknown or other
  misc_feature (234)..(234): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
tcagatacgacgtacacgaccggtgctcgatttagtgatagagcgtaacaacagaggactcaccatggagtttgggctgagctgggtttcctcgttgctcttttaagaggtgtccagtgtcaggggcacctggtggagtcgtgggggagccgtggtccagcctgggcgtccctgacactcgcctgtgttgcctctggattcccttcaattttctattccatcgcactgggtccnccaggctccaggcaaggggctcggagtgggtggacacttatgcacatgatggctcaactaattcaacgcctaaattccgtgagggccattcacatcacanagtacaattacaanaaccaccctttaanctanactaaatanacacgactagacgacagtaccacacgctagtactatagtgcgacgagacgaacaacaacgactaaccgtacgacgtacaactaacgtaagtacggggtcgttcgttacggtacggggaccgtaacggggacctcgggtactcgttaccgtccgtacccgcgtaccctaccaacccggtaaccggcccgtaacgtcccggttccccttaccccggtccggtccgtcccgtcg

SEQ ID NO: 22736 - DNA, 593 bp, Homo sapiens
  misc_feature: GYAE6OF02JVOBG.12.40.D07.1.454.CMB.1.raw
  modified_base (454)..(454): a, c, t, g, unknown or other
  misc_feature (454)..(454): n is a, c, g, or t
  modified_base (527)..(527): a, c, t, g, unknown or other
  misc_feature (527)..(527): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtactttcccttcaatttctattccatgcacgtgggtccgccaggcttcaggcaaggggctcgaggtgggtggctacttatgcacatgatggctacaacaattctacgacaaattccggtgacgggccattcaccatcctcaagacgaacaattaacaaagtaacctaccctttatctagactaaatacgacacgcctagacaccagacgacacgctgtacttattagtcgacgacgagagacgacacacgactacncgacaatacgtaggtcgggtcttcgtcgtcggggaccgacgggtacccgtggtactacgtccgtacctcccgngtacccctaccgacccggacggcccgtacgttaccggtcccttccccggcggtcccgtcccgtccg

SEQ ID NO: 22737 - DNA, 582 bp, Homo sapiens
  misc_feature: GYAE6OF02GNLWO.12.40.D07.1.454.CMB.1.raw
  modified_base (235)..(235): a, c, t, g, unknown or other
  misc_feature (235)..(235): n is a, c, g, or t
  modified_base (366)..(366): a, c, t, g, unknown or other
  misc_feature (366)..(366): n is a, c, g, or t
tcagatacgacgtacacgaccggtgctcgatttagtgatagagcgtaacgaacagagggctcaccatggagtttgggctggagctgggttttcctcgttgctcttttaagaggtgtccagtgtcaggggcacctggtggagtctgggggagccgtggtccagcctgggcggtccctgacactcgcctgtgttgcctctggatttccctcaatttctattccatgcactgggtccnccaggctccaggcaaggggctcgagtgggtgcacttatgcacatgatggcgtcaactaattctacgctaaattccgtggacggggccagttccaccatctaccagacgacaattacaagaactacctttanctagactaaagtgacacgcctagacgaccagacgacgacgctgtactattacgtcgacgcgagagactacaacaccgaactacgcgacctaagtacgtaggtacgggtctttcggttcggcgggaccgacgggtcctggtcacgtcgtcctacccgcgacctaccgaacgaccggtcccacgttcccggtacctccccgtaggtccctaccgtccg

SEQ ID NO: 22738 - DNA, 826 bp, Homo sapiens
  misc_feature: GYAE6OF02FSVSC.12.40.D07.1.454.CMB.1.raw
  modified_base (149)..(149): a, c, t, g, unknown or other
  misc_feature (149)..(149): n is a, c, g, or t
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
tcagatacgacgtacacgaccggtgctcgatttagtgatagagcgtaacaacgaggagggctcaccatggagtttgggctgagctgggtttcctcgttgctctttaagaggtgtccagtgtcaggggcacctggtggagtctggggganccggtggtccagcctgggcggtccctgacactcgcctgtgttgcctctggactttccctnaatttctattccatgcactgggtcccncaggctccgaggcaaggggctcggagtgggtgctacttatgcacagtgagtcggcgtacaaactaaattctacgactaaagtttccggtaggacgggggccctaagttccaacctattcctaccgaggacgtaactaaactttaacgaaacggtaaccctacccttttagccgttaggaactaaaagtacggaacacggtaccctacggaacgaacccgaaggaacccgaacgaccgggtactacggttaccttaagtttaacgttcggaccggtaccgggtaaggtaacgggtaacgtaaccgtaaaccgtaacccgtaaacccgttaccgtaacgggaacccgtaaagttaacccggttaagggttaccgggggggttaccttttcggggttaccgggttaccggggggtacccggtaaccggggggtacccggttacggggttaccgtacgggtttacccggtacccggtacccccggtaacgggtacccccgttaaccccggaacccggtaacccggggtaccccgtacggttccccgggttccccgtttaccccccggtccgggtaccccggtccccgttcccgg

SEQ ID NO: 22739 - DNA, 585 bp, Homo sapiens
  misc_feature: GYAE6OF02FVJTS.12.40.D07.1.454.CMB.1.raw
  modified_base (234)..(234): a, c, t, g, unknown or other
  misc_feature (234)..(234): n is a, c, g, or t
  modified_base (362)..(362): a, c, t, g, unknown or other
  misc_feature (362)..(362): n is a, c, g, or t
  modified_base (435)..(435): a, c, t, g, unknown or other
  misc_feature (435)..(435): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaaacaaattcacgacaaattccgtggaggggccattcaccatctccagagacaattacaagaacctaccctttanctagacaaatagacagcctgacaccagacgacgacgctgtctattatgcgcgagagagacacacgaacctacncgaccaatactagtcggggtcttgttcgtcggggccgacggggtacccgtggtaccacgttccgtcctccccgtacggtccctacccgaaccgtaaccgggaccctacgttcccggttcccttcccccggtcggtccccgcccgtaccgg

SEQ ID NO: 22740 - DNA, 542 bp, Homo sapiens
  misc_feature: GYAE6OF02I0TP8.12.40.D07.1.454.CMB.1.raw
  modified_base (495)..(495): a, c, t, g, unknown or other
  misc_feature (495)..(495): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtcaacaaattctacgcaaattccgtgaggggccattcaccatctccagagacaattacaagaacaccctttatctgacaaatagacagcctagagaccagacgacacggctgtctattattgcgcgagagagacacacgacctactcggaccaatactagtcggggtcttgttcgtggggccaggggaccctggcagtcgtctccccgngcctccaccgacggccacgtccggtccttccccgcggtccgccctcg

SEQ ID NO: 22741 - DNA, 577 bp, Homo sapiens
  misc_feature: GYAE6OF02I3LFB.12.40.D07.1.454.CMB.1.raw
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttanctgcaaatagacagcctgagaccagacgacacggctgtctattattgcgcgagagagacacacgaacctactgaccaatacgtatcgggggcttggttcgtcggggccacggggaccctgggtccacgttccgtcctccccgagtccctacccgaacccgaacgggccccaacgttcccgggttcccttccccccgtcgggtcccgtccccgtccgg

SEQ ID NO: 22742 - DNA, 580 bp, Homo sapiens
  misc_feature: GYAE6OF02FKJIL.12.40.D07.1.454.CMB.1.raw
  modified_base (383)..(383): a, c, t, g, unknown or other
  misc_feature (383)..(383): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattcacgcaaattccgtggagggccgattcaccatctccagagacaattacaagaactacccttatctagacaaatagacagcctaganaccagacgacacgctgtctattattgcgcgagagagacacgacgaacctactacggccaatactagtcggggtacttggttcgtcggggccgacggggtaccctgggtacagtcgtcctccccgagcccttcccgaaccgtaaccgggcccaacggttccggtcccgttccccccgtcgggtcccgtccccgtccgg

SEQ ID NO: 22743 - DNA, 645 bp, Homo sapiens
  misc_feature: GYAE6OF02JYOX6.12.40.D07.1.454.CMB.1.raw
  modified_base (234)..(234): a, c, t, g, unknown or other
  misc_feature (234)..(234): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttccctcaatttctattccatgcactgggtccnccaggctccaggcagggctcgagtggtggcacttatgcacatgatggctcaanaaattcacgnaaattccgnggagggccattcaccatcnccagngacaatacaanaccacctttaanctgacaaatacgacacgcctagacgtaccagaccgacaccggctacgtctacttatcgtcgacggagaggtagacctaacaaccgtaactaaccacgggtacctaaagtaaccgtacggttaggggtcccgttttagggttaccgttaggggggtaccctaacgggggtcccgtacgggttaccgtcgttcccgtaccgtaccccgacggttcccgtccctaacccggtaaccggccccgtaacggttcccggtccccgttacccccggtccggtcccggtccccgttccgg

SEQ ID NO: 22744 - DNA, 566 bp, Homo sapiens
  misc_feature: GYAE6OF02HD0A6.12.40.D07.1.454.CMB.1.raw
  modified_base (383)..(383): a, c, t, g, unknown or other
  misc_feature (383)..(383): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccatttcaccatctccagagacaattacaagaacaccctttatctagcaaatagacagcctaganaccagacgacacggctgtctattattgcgcgagagagacacacgaacctactgccaaatactagtggggcttggttcgtggggccagggggaccctgggtcagtcgtcctccccgacgccctacccaccgaacgggcccctacgttcccggtcccttcccccgtcgggtcccgacccctccgg

SEQ ID NO: 22745 - DNA, 589 bp, Homo sapiens
  misc_feature: GYAE6OF02IBRHQ.12.40.D07.1.454.CMB.1.raw
  modified_base (313)..(313): a, c, t, g, unknown or other
  misc_feature (313)..(313): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccgccaggctccaggcaaggggctcgagtgggtggcacttattgcacatgatggcgtcaacaaattctacgcaaattccgnggagggccattcacatctccagagacaattacaagaactaccctttatctagacaaatagaacagcctagacgaccagacgacacgctgtctatattgcgcgagagagacacacgaactactgaccaatacgtagtggggtcttcggttcgtcggggaccgacggggtaccctggtacctacgtccgtacctccccgacgccctacccgaacccgaaccgggcccctaacggttcccggtaccctttcccccggtcggtaccccgtcccgtaccgg

SEQ ID NO: 22746 - DNA, 554 bp, Homo sapiens
  misc_feature: GYAE6OF02GEPS9.12.40.D07.1.454.CMB.1.raw
  modified_base (411)..(411): a, c, t, g, unknown or other
  misc_feature (411)..(411): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgagggccattcaccatctccagagacaattacaagaacaccctttatctgacaaatagacagcctgacgaccagacgacacggctgtctattattgcgngagagagacacacgaacctactcgaccaatactagtggggtctttgttcgtggggccgaggggaccctggtacatccgtcctcccgacgccctaccaaccgaacgggcccacgtccggtaccttcccccgtggcccgccctcg

SEQ ID NO: 22747 - DNA, 638 bp, Homo sapiens
  misc_feature: GYAE6OF02JHL4K.12.40.D07.1.454.CMB.1.raw
  modified_base (234)..(234): a, c, t, g, unknown or other
  misc_feature (234)..(234): n is a, c, g, or t
  modified_base (359)..(359): a, c, t, g, unknown or other
  misc_feature (359)..(359): n is a, c, g, or t
  modified_base (410)..(410): a, c, t, g, unknown or other
  misc_feature (410)..(410): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaacaaattctacgcaaattccgtgaggggccattccaccatcctcagagacaattacaagaactacccttanctgacaaatagacagcctagacaccagacgacacgctagtctatacttgcncgtagagagacacaacgaacctacgtacggacccaagtaacctagtacgggggtcttttaggttccgtacgggggaccctaacgggggtaccccttggggtacctaacgttccggttacccttacccccggacggtacccttacccggaacccgtaaaccggggtccccctaacgtttcccgggttcccctttaccccccggtcgggtaccccgtcccccgttaccgg

SEQ ID NO: 22748 - DNA, 576 bp, Homo sapiens
  misc_feature: GYAE6OF02F2YFI.12.40.D07.1.454.CMB.1.raw
  modified_base (234)..(234): a, c, t, g, unknown or other
  misc_feature (234)..(234): n is a, c, g, or t
  modified_base (356)..(356): a, c, t, g, unknown or other
  misc_feature (356)..(356): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggctcaaacaaattctacgcaaattccgtgagggccattcaccatctcagagacaattacaagaacaccctttanctgacaaaatagacagcctagacgaccagacgacacggctgtctattattgcgcgagagagacacacgaacctactgaccaatactagtaggggtcttgttcgtcggggaccgaggggtaccctggtaccgagttccgtccgtaccccgagcccttacccgaacccgtaaccgggccctacgttcccggttcccttcccccgtcggtcccgtcccgtcgg

SEQ ID NO: 22749 - DNA, 577 bp, Homo sapiens
  misc_feature: GYAE6OF02HOOHA.12.40.D07.1.454.CMB.1.raw
  modified_base (289)..(289): a, c, t, g, unknown or other
  misc_feature (289)..(289): n is a, c, g, or t
  modified_base (438)..(438): a, c, t, g, unknown or other
  misc_feature (438)..(438): n is a, c, g, or t
tcagatacgacgtacacgaccggtgctcgatttagtgatagagcgtaacaacagagggctcaccatggagtttgggctgagcgtggtttcgtcgtagctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggctcaanaaattctacgcaaattccgtagaggggccattcaccatctcagagacaattacaagaacctaccctttatctacgacaaaatagacagcctagacgaccagacgacacggctgtctattattgcgacgagagagacacacgacctacgngacctaatactagtggggtcttagtcgtacgggccgaggggaccctggacacgttcgtcctccccgctcccttaccgaacccgaacgggcccctacggtcccggtacccgttccccccgtcggcccgtaccccgtccgg

SEQ ID NO: 22750 - DNA, 553 bp, Homo sapiens
  misc_feature: GYAE6OF02H7EDC.12.40.D07.1.454.CMB.1.raw
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtgggtccagcctgggcggtcccgtcgacgacctacggcctcgtagttggcctctggatttcccttcaatttctattccatgcactgggtccgccaggctccaggcaagggggctcgaggtgggtggcacttattgcacatgatggcgtcaacaaaatttctacgacaaatttccggtgaggggccgatttcaccatcctccagagacaattaacaagaacctacccctttatctgacaaatagacacgctgagaccagacacgacggctgtcttatattgcgcganaganacacaacacactgacatactagagggctgtcgtcgggcgacgggcctggcatcgtccacccncgccnctaccgaacggccctactccggtccttccccgtcgccgcctccg

SEQ ID NO: 22751 - DNA, 588 bp, Homo sapiens
  misc_feature: GYAE6OF02JUPEV.12.40.D07.1.454.CMB.1.raw
  modified_base (149)..(149): a, c, t, g, unknown or other
  misc_feature (149)..(149): n is a, c, g, or t
  modified_base (234)..(234): a, c, t, g, unknown or other
  misc_feature (234)..(234): n is a, c, g, or t
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
  modified_base (523)..(523): a, c, t, g, unknown or other
  misc_feature (523)..(523): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcggtccctgacactcgcctgtgttgcctctggatttcccttcaatttctattccatgcactgggtccnccaggctccaggcaaggggctcgagtgggtgcacttatgcacatgatggctacaacaaattctacgcaaattccgngacgggccattcaccatctccagagacaattacaagaaccaccctttanctagacaaatgacagcctagacaccagacgacacggctcgtactaattatgcgcgagagacgacacacgaacctagtcggaccaaagttactaggtcgggggactttaggttccgtacggggaccgagggggtacccctgggtacacgttccgtcctaccccgngtccctaccgaacccgaacgggtcccacgttcccggtccttacccccgtacggcccgtccctcgg

SEQ ID NO: 22752 - DNA, 587 bp, Homo sapiens
  misc_feature: GYAE6OF02ITN07.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtgcacttattgcacatgatggcgtacaacaaattcctaacgcaaaattccgtaggagggggccattccacctatcctaccagacgacaacgccaaagaacctcactgtaatctagacaaaataacagctaggaaacgccgaggacacggctagtgttatttcgtgtgacgaggacgtccgtaggtgaactaaatttactacaaaccagaactaaagttcgttacgaccaacgccgtacacctacttacttggacagtcgtcggggccacgggaaccctcggtaccacccggtctacccgtcacgtccctaccaccgaaccggg

SEQ ID NO: 22753 - DNA, 590 bp, Homo sapiens
  misc_feature: GYAE6OF02HOXZR.12.40.D07.1.454.CMB.1.raw
  modified_base (235)..(235): a, c, t, g, unknown or other
  misc_feature (235)..(235): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcaggggcaccgtggtggagtctgggggagcccgtggtccagcctgggcggtccctgacactcgcctgtgttgcctctggatttcccttcaatttctattccatgcactgggtccnccaggctccaggcaaggggctcgagtgggtgcacttattgcacatgatggcgtacaaacaaattctacgcaaattccgtggaggggccattcaccntctcaganacaattacaagaacctaccctttancctagacaaaatagacagcctagacgaccagacgacacggctgtctattattgcgcgagagagacacacgaacctactacgccaaatactaaggtcggggtctttgttcggtcggggccgacgggggtaccctgggtcctagtccgtccgtaccccagtcccctaccgacccgtaaccgggccccgtacgttccggtcccttcccccgtcggtcccgccccgtccg

SEQ ID NO: 22754 - DNA, 546 bp, Homo sapiens
  misc_feature: GYAE6OF02GZYQB.12.40.D07.1.454.CMB.1.raw
  modified_base (235)..(235): a, c, t, g, unknown or other
  misc_feature (235)..(235): n is a, c, g, or t
  modified_base (361)..(361): a, c, t, g, unknown or other
  misc_feature (361)..(361): n is a, c, g, or t
  modified_base (536)..(536): a, c, t, g, unknown or other
  misc_feature (536)..(536): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtcaacaaattctacgcaaattccgtgaggggccattcaccatctccagagacaattacaagaacaccctttanctgacaaatagacagcctgagaccagacgacacggctgtctattattgcgcgagagagacacacgaacctactgaccaatactagtggggtcgttgttcgtcggggccgacggggacctggtcgatcgtctcccgacgccctccaccgaacggcccacgtccggtccttccccgnggccgcctcg

SEQ ID NO: 22755 - DNA, 553 bp, Homo sapiens
  misc_feature: GYAE6OF02FQQ23.12.40.D07.1.454.CMB.1.raw
  modified_base (235)..(235): a, c, t, g, unknown or other
  misc_feature (235)..(235): n is a, c, g, or t
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
  modified_base (539)..(539): a, c, t, g, unknown or other
  misc_feature (539)..(539): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtggcacttatgcacatgatggcgtcaacaattcacgcaaattccgngagggccattcacatctcagagacaattacaagaaccaccctttanctagacaaatagacagccctagacgaccagacgacacggctgtactattattgcgcgagagagacacaccgaacctactacggaccaatactagtggggtcttgttcgtggggccgagggaccctggtcacgtcgtcctcccgacgccctccaccgacggcccacgtccggtcccttccccgnggtcccgcccgtcg

SEQ ID NO: 22756 - DNA, 638 bp, Homo sapiens
  misc_feature: GYAE6OF02I9SQY.12.40.D07.1.454.CMB.1.raw
  modified_base (147)..(147): a, c, t, g, unknown or other
  misc_feature (147)..(147): n is a, c, g, or t
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (324)..(324): a, c, t, g, unknown or other
  misc_feature (324)..(324): n is a, c, g, or t
  modified_base (387)..(387): a, c, t, g, unknown or other
  misc_feature (387)..(387): n is a, c, g, or t
tcagatacgacgtacacgaccggtgctcgatttagtgatagagcgtaacaacagagggctcaccatggagtttgggctgagctgggtttcctcgttgctctttaagaggtgtccagtgtcaggggcacctggtggagtctggggganccgtggtccagcctgggcggtccctgacactcgcctgtgttgcctctggatttccctnaatttctattccatgcactgggtccncaggctccaggcagggctcgagtgggngcacttattgcacatgtgaattggacgttanaaccaaaagttctaaacggccgaaaattcccggtnaagggggtcccaatttcaccctaatctaccaagagtaccaaattacaaagtaacaccctttancctagcaaatgacagcctagagaccagacgacacggctagtctatacttgacgacgagagagaacaccacgaacctactacggaccaaataccgtattagggggacttacgggttcctaggggaccctaggggaacccctgggtacctacgtcccggtacgtcccccacggtaccctacccgacccgtaaacgggtcccccgtaacgttccccggggttactttacccccccgtagggtcccgtacccccg

SEQ ID NO: 22757 - DNA, 562 bp, Homo sapiens
  misc_feature: GYAE6OF02G7DKP.12.40.D07.1.454.CMB.1.raw
  modified_base (235)..(235): a, c, t, g, unknown or other
  misc_feature (235)..(235): n is a, c, g, or t
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtacaaacaaattctaacgcaaattcagtgaggggccattcacatctcaganacaatacaagaacacctttanctgacaaaatgaacagcctagacgaccagacgacacggctgtctattattgcgcgagagagacacgacgaacctactacggaccaatactagtggggtcttggttcgtcggggaccgtacggggtaccctggtacacgtccgtccgtcccagcccgtccaccgaacggccctacgtccggtccctccccgtcgaccctaccccg

SEQ ID NO: 22758 - DNA, 540 bp, Homo sapiens
  misc_feature: GYAE6OF02FMR5O.12.40.D07.1.454.CMB.1.raw
  modified_base (233)..(233): a, c, t, g, unknown or other
  misc_feature (233)..(233): n is a, c, g, or t
  modified_base (310)..(310): a, c, t, g, unknown or other
  misc_feature (310)..(310): n is a, c, g, or t
  modified_base (358)..(358): a, c, t, g, unknown or other
  misc_feature (358)..(358): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttcattccatgcactgggtccnccaggctccaggcaaggggctcgagtgggtggcacttattgcacatgatggcgtcaacaaattcacgcaaattccgngaggggccattcaccatctccagagacaattacaagaacaccctttanctgacaaatagacagcctgacgaccagacgacacggctgtctattattgcgcgagagagacacacgaacctactgaccaatactagtgggggtcttggttcgtggggccaggggaccctgtcagtccgtctccccgacgcctaccaccgacggcccagtccggtcctccccgagccgcctcg

SEQ ID NO: 22759 - DNA, 576 bp, Homo sapiens
  misc_feature: GYAE6OF02H3W1H.12.40.D07.1.454.CMB.1.raw
tcagatacgacgtacacgaccggtgctcgatttagtgatagagcgtaacaacagagggctcaccatggagtttgggctgagctgggtttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaactaaattctacgcaaattccgtgaggggccattcaccatcctccagagacaattacaagaactaccctttatctagacaaatagacagcctgacgaccagacacacgctgtctattattgcgcgagagagaacacaacgaaactactaggactaatactagtggggtcttgttcgtcggggaccgacggggacccgtggtctacgtccgtcctccccgacgtccctaccgaacccgaacggccctacgttcccggttcccttaccccgtcggcccgtcccgtcg

SEQ ID NO: 22760 - DNA, 574 bp, Homo sapiens
  misc_feature: GYAE6OF02F042I.12.40.D07.1.454.CMB.1.raw
  modified_base (234)..(234): a, c, t, g, unknown or other
  misc_feature (234)..(234): n is a, c, g, or t
  modified_base (359)..(359): a, c, t, g, unknown or other
  misc_feature (359)..(359): n is a, c, g, or t
  modified_base (422)..(422): a, c, t, g, unknown or other
  misc_feature (422)..(422): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaacaaattcacgacaaattccgtgaggggccattcacatctccagagacaattacaagaacctaccctttancctagacaaatacgacagcctagacgaccagacgacacggctgtctattattgcgcgagaganacacacgaacctactcgaccaatactagtggggcttgttcgtggggaccaggggtaccctggtaccagttccgtcctccccgagccctaccgaacccgaacgggcccctacgtcccggttcccttccccccgtcggtcccgtccccgtccgg

SEQ ID NO: 22761 - DNA, 554 bp, Homo sapiens
  misc_feature: GYAE6OF02F7H2W.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttatctgacaaatagacagcctagacgaccagacgacacggctgtctattattgcgcgagagagacacacgaacctactaggccaatactagtagggggcttggttcgtcggggccgaggggacccgtggtcagtcgtctccccgagccctaccaccgaacggcccacgtccggtcccttccccgtggcccgccctcg

SEQ ID NO: 22762 - DNA, 563 bp, Homo sapiens
  misc_feature: GYAE6OF02IYT1V.12.40.D07.1.454.CMB.1.raw
  modified_base (235)..(235): a, c, t, g, unknown or other
  misc_feature (235)..(235): n is a, c, g, or t
  modified_base (360)..(360): a, c, t, g, unknown or other
  misc_feature (360)..(360): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccnccaggctccaggcaaggggctcgagtgggtgcacttatgcacatgatggctcaaacaaattctacgcaaattccgtgaggggccattcaccatctccagagacaattacaagaactaccctttanctgacaaatacgacagcctagaacaccagacgacacgctgtactattattgcgngagaganacacacaactacncgaccaatactagtcggggtcttaggttcgtcgggaccgtacggggacctcggtacacgtccgtccctacccgcgaccctaccgaaccgacggacctcgttccggtcccttcccgcggcccgtcctccg

SEQ ID NO: 22763 - DNA, 588 bp, Homo sapiens
  misc_feature: GYAE6OF02HTHG6.12.40.D07.1.454.CMB.1.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (378)..(378): a, c, t, g, unknown or other
  misc_feature (378)..(378): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggatttcccttnaatttctattccatgcactgggtccnccaggctccaggcaaggggctcgagtgggtgcacttatgcacatgatggcgtacaaactaaattctaacgactaaattccggtaggaggggcccattccacctatcctaccagagactaaattacaaagaacctaccctttanctgacaaatacgacagcctagacgaccagacgacacgctgtactatatgcgngagaganacacacgaacctactcgacaatacgtagtcggggtacttggttcgtcggggaccgtacggggcctacggtcacgtccgtaccgtcccgacgtaccctccgaccgaacggccctacgtccggttaccctccccggtcggcccgtccctccgg

SEQ ID NO: 22764 - DNA, 575 bp, Homo sapiens
  misc_feature: GYAE6OF02FUI5E.12.40.D07.1.454.CMB.1.raw
  modified_base (150)..(150): a, c, t, g, unknown or other
  misc_feature (150)..(150): n is a, c, g, or t
  modified_base (235)..(235): a, c, t, g, unknown or other
  misc_feature (235)..(235): n is a, c, g, or t
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggganccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaacaaattctacgcaaattccgngagggccattcaccatctcagagacattacaagacaccctttanctgcaaatgaacagcctgacgaccaagacgacacggctgtctattattgcgcgagagagacacacgaacctactggccaaatactagtgggggcttagttcgtggggccagggggaccctgggtccagtccgtcctccccgtaagtcccgtcccaaccgaaccggggtcccctacgttcccggttacccttccccccggtacgggtcccggtcccctcgg

SEQ ID NO: 22765 - DNA, 563 bp, Homo sapiens
  misc_feature: GYAE6OF02ICBMR.12.40.D07.1.454.CMB.1.raw
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttanctgacaaatagacagcctgacgaccagacgacacggctgtctattattgcgcgagagagacacacgaaactactgccaaatactagtcggggcttgttcgtggggccgaggggccctggtcacttccgtcctccccgagccctaccacccgaacgggccccacgttcccgggttcccttcccccgtgggcccgtcccgtccgg

SEQ ID NO: 22766 - DNA, 556 bp, Homo sapiens
  misc_feature: GYAE6OF02IDQOJ.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctaacacaaattccgtgagggccgattcaccatctccagagacaattacaagaacacccttatctgacaaatagacagcctagacgaccagacgacacgctgtctatattgcgcgagagagacacacgaacctactgaccaatactagtggggtcttgtcgtggggccgacgggacccgtggtacagtcgtcctccccgacgtaccctccacccgaacggacccacgtccggtccttcccccgtcggcccgtcccgtcg

SEQ ID NO: 22767 - DNA, 611 bp, Homo sapiens
  misc_feature: GYAE6OF02HYEUM.12.40.D07.1.454.CMB.1.raw
  modified_base (150)..(150): a, c, t, g, unknown or other
  misc_feature (150)..(150): n is a, c, g, or t
  modified_base (235)..(235): a, c, t, g, unknown or other
  misc_feature (235)..(235): n is a, c, g, or t
  modified_base (385)..(385): a, c, t, g, unknown or other
  misc_feature (385)..(385): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccgtggtccagcctgggcggtccctgacactcgcctgtgttgcctctggatttcccttcaatttctattccatgcactgggtccnccaggctccaggcaaggggctcggagtgggtgcacttatgcacatgatcggcgtacaaactaaaattcctaacgctaaaagtttccggtaggacggggcctatttccacctatcctaccagagaacaattacaaagaacctaccctttanctagacaaatagacacgctagaacgaccagacgacgacggcttagtacttattattgcgacgagagagaccacaccgaacctacgtagacctaatacgtaggtacggggtctttcggtcgtcggggccgtacggggtacctggtacacgtcgtccgtcccgacgccctaccgaccgtacgggtcccacgttcccggtccccgttccccgtcggtcccgtccctccg

SEQ ID NO: 22768 - DNA, 604 bp, Homo sapiens
  misc_feature: GYAE6OF02HZ14J.12.40.D07.1.454.CMB.1.raw
  modified_base (211)..(211): a, c, t, g, unknown or other
  misc_feature (211)..(211): n is a, c, g, or t
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctgggtggagtcgtggggggagccgtggtccagcctgggccggtccctgacactcgcctgtgttgcctctggatttccctnaatttctattccatgcactgggtccgccaggctccagggcaagggggctcggaggtggggtggctacttagtgcacatgatggctacaaacaaattcacgcaaaattccgngagggccattcaccatctccagagacaatacaaagaaccncctttaancgtnacaaaatnaactgcctnacgaccagcacagctgtctatatgcngagagagacacaacaactacagaccaaatacgtagtaggggtctacgttcgtcggggaccgtacgggggaccctacgggtcgtactccggttacttccccgaacgaccccgttcccaaaccggaaccgggtaccccaacggttcccggtcccgtttcccccccgtagggtccccgtcccgtacccgg

SEQ ID NO: 22769 - DNA, 625 bp, Homo sapiens
  misc_feature: GYAE6OF02JDTN0.12.40.D07.1.454.CMB.1.raw
  modified_base (469)..(469): a, c, t, g, unknown or other
  misc_feature (469)..(469): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaattttctattccatgcactgggtcccgccaggcctccagggcaagggggcctcggagtgggtggccacttatgcacatgatgggcgtacaacaattctacgcaaattccgtggaacggggcccgtattccgaaccagttcctacccaggacgaacctaaactttaacaacgtaaacctaccctttatactgacaaatacgacagccctagacacagacgacacgctgctatatgcgacgagagagacacacgaactacncgaccaatacgtagtacgggtcgttacgttcggacggggtaccgacggggaccctacggtcgtacgtccgtacctacccgtacgtcccttaccgacccgtaccggaccctacggttcccggtacccgttcccccggtcggtacccgcccgtaccgg

SEQ ID NO: 22770 - DNA, 601 bp, Homo sapiens
  misc_feature: GYAE6OF02IYAZ4.12.40.D07.1.454.CMB.1.raw
  modified_base (149)..(149): a, c, t, g, unknown or other
  misc_feature (149)..(149): n is a, c, g, or t
  modified_base (234)..(234): a, c, t, g, unknown or other
  misc_feature (234)..(234): n is a, c, g, or t
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggganccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaaacaattctaacacaaattccgnggacgggccattcaccatctaccgagacgactaattacaaacgaacctacccttttancctagacctaaatacgacacgcctagacacccaagacgacacgctcgtactattactgacgacgagaganacacacgaactacngaccaatactagtcggggtacttcgtcgtacggggaccgacggggtaccctggtactagtcccgtaccgtaccccgtagtaccctacccgaaccgacggacccctacgttcccggtacccttcccccggtggtaccccgtcccgtccg

SEQ ID NO: 22771 - DNA, 541 bp, Homo sapiens
  misc_feature: GYAE6OF02F72QN.12.40.D07.1.454.CMB.1.raw
  modified_base (361)..(361): a, c, t, g, unknown or other
  misc_feature (361)..(361): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaaccaccctttanctgacaaatagacagcctgagaccagacacacggctgtctattattgcgcgagagagacacacgaacctactgaccaatactagtggggctttggttctggggccagggaccctggtcatcgtctccccgagccctccaaccacggcccacgtccggtccttcccccgtggccgccctcg

SEQ ID NO: 22772 - DNA, 576 bp, Homo sapiens
  misc_feature: GYAE6OF02GKCDF.12.40.D07.1.454.CMB.1.raw
  modified_base (234)..(234): a, c, t, g, unknown or other
  misc_feature (234)..(234): n is a, c, g, or t
  modified_base (310)..(310): a, c, t, g, unknown or other
  misc_feature (310)..(310): n is a, c, g, or t
  modified_base (358)..(358): a, c, t, g, unknown or other
  misc_feature (358)..(358): n is a, c, g, or t
  modified_base (433)..(433): a, c, t, g, unknown or other
  misc_feature (433)..(433): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttatgcacatgatggcgtcaacaattctacgcaaattccgngaggggccattccacatctccagagacaattacaagaacaccctttanctgacaaatagacacgctagagaccagacgacacggctgtctattattgcgcgagagagacacacgaacctacgngaccaatacgtagttggggcttgttcgtcggggccaggggaccctggtacacgtcgtcctccccgaggtccctaccgaacccgtaacgggcccctaacgttccggttaccccttcccccggtaggccccggtccccgttacgg

SEQ ID NO: 22773 - DNA, 564 bp, Homo sapiens
  misc_feature: GYAE6OF02GMM5L.12.40.D07.1.454.CMB.1.raw
  modified_base (234)..(234): a, c, t, g, unknown or other
  misc_feature (234)..(234): n is a, c, g, or t
  modified_base (366)..(366): a, c, t, g, unknown or other
  misc_feature (366)..(366): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtacaactaaattctaacgactaaaattccgtggacggggccattcaccatctccagagacaattacaagaactacccttanctagacaaatgacagcctagacaccagacgacacggctgtctattatgcgcgagagagacacacgaacctacgtcgacaatacagtggggtcttgtcgtggggaccgaggggtaccctggtactacgtcgtcctcccgacgccctaccgaaccgacggccctacgtccggtcccttccccggtcggtcccgccctcgg

SEQ ID NO: 22774 - DNA, 564 bp, Homo sapiens
  misc_feature: GYAE6OF02JG00W.12.40.D07.1.454.CMB.1.raw
  modified_base (234)..(234): a, c, t, g, unknown or other
  misc_feature (234)..(234): n is a, c, g, or t
  modified_base (357)..(357): a, c, t, g, unknown or other
  misc_feature (357)..(357): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttattgcacatgatggctcaacaattctacgcaaattccgtgaggggccattcaccatctccagagacaattacaagaacaccctttanctgacaaatacgacagcctagacgaccagacgacacggctgtctattatgcgcgagagagacacacgaacctactcggaccaatactagtggggcttgttcgtcgggccgacggggtaccctggtctacgtccgtcctaccccgagccctaccgacccgtaacgggccccacgttccggttacccttccccgtcggtcccgccctcg

SEQ ID NO: 22775 - DNA, 560 bp, Homo sapiens
  misc_feature: GYAE6OF02HCKXX.12.40.D07.1.454.CMB.1.raw
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
  modified_base (359)..(359): a, c, t, g, unknown or other
  misc_feature (359)..(359): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccncaggctccaggcaaggggctcgagtgggngcacttattgcacatgatggcgtcaacaaattctacgcaaattccgtgaggggccattcaccatctccagagacaattacaagaactaccctttanctagacaaatagacagcctgacaccagacgacacgctgtctattatgcgacgagagagacacacgaacctactacggccaatactagtcggggctttgttcgtgggaccgtacgggacccgtggtacacgtccgtcctacccgacgccctaccgaaccgacggaccctacgtccggtcccttccccgtcggccgtccctcg

SEQ ID NO: 22776 - DNA, 563 bp, Homo sapiens
  misc_feature: GYAE6OF02H4CBL.12.40.D07.1.454.CMB.1.raw
  modified_base (413)..(413): a, c, t, g, unknown or other
  misc_feature (413)..(413): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaattcacgcaaattccgtggagggccgattcaccatctccagagacaattacaagaacaccctttatctagcaaatacgacagcctagacgaccagacgacacggctgtctattattgcgngagagagacacacgaacctacgtcgaccaatacgtatcgggggtctttggttcgcggggaccaggggacccttggtcacttcgtacctcccgacgccctccgaccgaacggcccacgtccggtcccttacccccgtcggtccgcccgtcg

SEQ ID NO: 22777 - DNA, 597 bp, Homo sapiens
  misc_feature: GYAE6OF02HRBUR.12.40.D07.1.454.CMB.1.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (452)..(452): a, c, t, g, unknown or other
  misc_feature (452)..(452): n is a, c, g, or t
  modified_base (518)..(518): a, c, t, g, unknown or other
  misc_feature (518)..(518): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttnaatttctattccatgcactgggtccnccaggctccaggcaaggggctcggagtgggtgcacttattgcacatgatggctacaaacaattctaacgcaaagtttccgtaggacggggccattccaccatcctaccagacgacaaattacaaagaacctaccctttaatctagacaaatagacagcctagacgaccagacgacacggctgtactatattgcgacgagagagacacacgaactacngaccaatactagtggggcttagttcgtggggaccgacggggaccctagggtaccacgtccgtaccnccccgtacgtcccctaaccgacccgaacgggcccctaacgttcccggttcccgttccccccgtcggcccgtcccgtccg

SEQ ID NO: 22778 - DNA, 599 bp, Homo sapiens
  misc_feature: GYAE6OF02IGVXQ.12.40.D07.1.454.CMB.1.raw
  modified_base (371)..(371): a, c, t, g, unknown or other
  misc_feature (371)..(371): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtacaaacaaattctacgcaaaattccggtgaggggccatttccacctatctaccagacgacaattaacaagaaccaccctttanctagacaaatagacagcctagagaccaagaccgacacggctgtactaatattgcgcgagagagacaacacgaacctactacggacaaatactagtacgggggcttggttcgtcggggaccgaacggggaccgtggtaccagtcgtcctaccccgacgtccctacccgaacccgaaccggacccgacgtccggttacccgttcccccgtcggtcccgtaccccgtccgg

SEQ ID NO: 22779 - DNA, 588 bp, Homo sapiens
  misc_feature: GYAE6OF02INR3E.12.40.D07.1.454.CMB.1.raw
  modified_base (178)..(178): a, c, t, g, unknown or other
  misc_feature (178)..(178): n is a, c, g, or t
  modified_base (235)..(235): a, c, t, g, unknown or other
  misc_feature (235)..(235): n is a, c, g, or t
  modified_base (364)..(364): a, c, t, g, unknown or other
  misc_feature (364)..(364): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacnctcgcctgtgttgcctctggatttcccttcaattttctattccatgcactgggtccncaggctcaggcaaggggctcgagtgggtgcacttatgcacatgatggcgtacaaactaattctacgcaaattccgtggacggggccattccaccatcctccagacgacaattacaagaactacccttanctagacaaatagacagcctagacgaccagacgaacgaggtctgtactattagttgcgacgaagagacgacaacaccgtaacctacgtcggacaatactagtggggtcttggtcgtacggggccgtacggggacctggtcgtacgttccgtcctccccgacgcccctaccgaaccgaccggccctacgtcccggttacccttcccccgtagggcccctcccgtcg

SEQ ID NO: 22780 - DNA, 574 bp, Homo sapiens
  misc_feature: GYAE6OF02GSAYP.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctaacgcaaattccgtgaggggccattcaccatctccagagacaattacaagaacaccctttatctgacaaatagacagcctagagaccagacgacacggctgtctattatgcgcgagagagacacacgaacctacgcggaccaaatacgtaagtgggggtactttggttcgtcggggaccacggggaccctgggtccagtccgtcctccccgagtccctacccacccgaacgggcccaacgtccggttcccttccccccgtggcccgtcccgtccg

SEQ ID NO: 22781 - DNA, 591 bp, Homo sapiens
  misc_feature: GYAE6OF02JUVCS.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggcctccaggcaaggggctcggagtgggtgcacttattgcacatgatggcgtcaactaaattctacgacaaattccggtggaggggccattcaccatctccagagacaaattacaaagtaactacccttatctgacaaatagacagcctgaacaccagacgacacggactcgtctattatcgcgacagagagacacacgaacctacgacgaccaatacgtagtggggtacttgttcgtcggggtccgacggggtacccgtggtctacgtccgtccgtacccgcggtaccctacccacccggaacggtcccgacgttcccggtaccttcccccggtcggcccgtacccgtccgg

SEQ ID NO: 22782 - DNA, 561 bp, Homo sapiens
  misc_feature: GYAE6OF02IG4QM.12.40.D07.1.454.CMB.1.raw
  modified_base (237)..(237): a, c, t, g, unknown or other
  misc_feature (237)..(237): n is a, c, g, or t
  modified_base (319)..(319): a, c, t, g, unknown or other
  misc_feature (319)..(319): n is a, c, g, or t
  modified_base (347)..(347): a, c, t, g, unknown or other
  misc_feature (347)..(347): n is a, c, g, or t
  modified_base (431)..(431): a, c, t, g, unknown or other
  misc_feature (431)..(431): n is a, c, g, or t
tcagatacgacgtacacgaccggtgctcgatttagtgatagagcgtaacaacagagggctcaccatggagtttgggctgagctgggttttcctcgttgctctttttaagaggtgtccagtgtcaggggcacctggtggagtctggggggagccgtggtccagcctgggcggtccctgacactcgcctgtgttgcctctggatttcccttcaattttctattccatgcactgggtccnccaggctccaggcaaggggctcgagtgggtgcacttattgcacatgatggcgtcaaacaaatttctaacgcaaaatttccgnggacggggccattccaccatctccaganacaattacaagaacctaccctttaatctagactaaagtagaacagacctagaacgaccagacgacacggctgtctatattgcgngagagagacacacgactacagccaatactagtgggtcttgtcgtcgggccgagggaccgtggtcatccgtcctcccagccctccaaccgacggccctacgtccggttaccctccccgtcggccgccctcg

SEQ ID NO: 22783 - DNA, 609 bp, Homo sapiens
  misc_feature: GYAE6OF02IUYRG.12.40.D07.1.454.CMB.1.raw
  modified_base (234)..(234): a, c, t, g, unknown or other
  misc_feature (234)..(234): n is a, c, g, or t
  modified_base (316)..(316): a, c, t, g, unknown or other
  misc_feature (316)..(316): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
  modified_base (421)..(421): a, c, t, g, unknown or other
  misc_feature (421)..(421): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgaggtgggtggcacttattgcacatgatggcgtcaactaaattctaacgcaaatttccgngaggggccattcaccatctccagagacaatacaagacacctttatctgcaaatagacagcctaganaccagacgacacgntgtctattatgcgagagagagacanaacgaacctactacgccaactactaagttgggggacctttaggtttccgtacggggtcccgaaccgggggtacccttcgggtaccagttcccgtcctccccgaacgccccgttaccgaacccgtaaccgggacccgtacgttacccggttacccttcccccgttcggccccggtccctaccggtcccg

SEQ ID NO: 22784 - DNA, 562 bp, Homo sapiens
  misc_feature: GYAE6OF02FTI0T.12.40.D07.1.454.CMB.1.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
  modified_base (499)..(499): a, c, t, g, unknown or other
  misc_feature (499)..(499): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgttggtccagcctgggcggtccctgacactcgcctgtgttgcctctggatttcccttnaatttctattccatgcactgggtccnccaggctccaggcaaggggctcggagtgggtgcacttattgcacatgatggcgtcaaacaattctacgcaaattccgtggaggggccattcaccatctccagagacaattacaagaacctaccctttanctgacaaaatagacagcctgacgaccagacgacacggctgtctattattgcgngagagagacacacgaactactcggaccaatactagtggggtcttgttcgcgggtccgacgggacccgtggtcagtcgtccncccgcgccctcccaaccgacggcccacgttccggttcccttcccccgtggtcccgcccgtcgg

SEQ ID NO: 22785 - DNA, 732 bp, Homo sapiens
  misc_feature: GYAE6OF02GUALE.12.40.D07.1.454.CMB.1.raw
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcggagtgggtggcacttattgcacatgatggcgtcaactaattctacgcaaattccgtgagggccattcaccatctccagagacaattacaagaactaccctttatctagacaaatacgaacacgacctagaacgaccagaaccgacgaccgggtactacgttacttaatttacgttggaccgacgtaacggacggaacgaaccgaaccgaacccgtaaacccttaaccgtacgggtaaccctaaagtttaaccgttaacgggttacggggggttaccttttcgggtttccgggtaccggggggtcccgtaaccggggggttaccccgttacggggtaccgtaccgttaccggttccccgttaccccgaaccggtccccgttaaccccgtaaccccggaaaccgggtcccccgtaacggttccccgggttcccccgtttacccccccggttcgggacccccggtccccgtaccccggg

SEQ ID NO: 22786 - DNA, 568 bp, Homo sapiens
  misc_feature: GYAE6OF02I11TP.12.40.D07.1.454.CMB.1.raw
  modified_base (432)..(432): a, c, t, g, unknown or other
  misc_feature (432)..(432): n is a, c, g, or t
  modified_base (559)..(559): a, c, t, g, unknown or other
  misc_feature (559)..(559): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaattcacgcaaattccgtgaggggccattcaccatctccagagacaattacaagaacacccttatctgacaaatagacagcctagacgaccagacgacacggctgtctattattgcgacgagagagacacacgaacctancggaccaatacgtagtggggtcttggttcgtagggccgtacggggacccttggtacacgtcgtcctcccgacgtcctcccgaaccgaccgggccctacgttcccggtcccttcccccgtgggtcccncccgtccgg

SEQ ID NO: 22787 - DNA, 561 bp, Homo sapiens
  misc_feature: GYAE6OF02GD1X3.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaaacaaattctaacgctaaattccggtgacggggccattcaccatctccagagacaattacaagaaccaccctttatctgacaaatagacagcctgacgaccagacgacacgctgtctattattgcgcgagagagacacacgaacctactgaccaatactagtcggggcttgttcgtcgggccgacggggtaccctggtacagtccgtcctccccgcgcctacccaccgaaccggcccacgtccggttcccttccccgtcggcccgccctcg

SEQ ID NO: 22788 - DNA, 795 bp, Homo sapiens
  misc_feature: GYAE6OF02IE9CL.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccnccaggctccaggcaagggggctcgaggtggggtgctacttattgcacatgatggctacaactaaattcctacgactaaactttcccggtaggagggggccctatttaccgacctaattcctcccaaggtaacgaacctaaattaaccaaagtaaaccctacccttttaatccgtagaaccaaaattacgaactacgacccgtagaacgaacccaaggaccgaaaccgacggcttacggtaccttaagtttaacttggacccgacggaaggtaacggaacgaacctaaccgaaccgaaacccttaccgtacggtacccaaagttaccgttaacgggtcgggggttacctttacggtttccgggtacggggggtaccccgtaacggggggtacccctagggggttaccctaacggttacccgttcccgtaccccccggtaacgtaccccccgttacccggaaaccccggtaaacccggggtccccccttaaggttacccccgggtttacccccgtttaccccccccgggtcggggttccccccgtacccccgttacccgggg

SEQ ID NO: 22789 - DNA, 615 bp, Homo sapiens
  misc_feature: GYAE6OF02JIDS6.12.40.D07.1.454.CMB.1.raw
  modified_base (233)..(233): a, c, t, g, unknown or other
  misc_feature (233)..(233): n is a, c, g, or t
  modified_base (285)..(285): a, c, t, g, unknown or other
  misc_feature (285)..(285): n is a, c, g, or t
  modified_base (359)..(359): a, c, t, g, unknown or other
  misc_feature (359)..(359): n is a, c, g, or t
  modified_base (382)..(382): a, c, t, g, unknown or other
  misc_feature (382)..(382): n is a, c, g, or t
tcagatacgacgtacacgaccggtgctcgatttagtgatagagcgtaacaacagagggctcaccatggagtttgggctgagctgggttttcctcgttgctctttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggctnaacaattcaacgcaaattccgtgacggggccattcgacctatctccagagacaattacaagaactaccctttanctgactaaatcgacagcctaganacccagacgtacacgctgtcctattatagtcgacgtagacgtagacacgaacgaacctactcgacccaataccgtaagtcggggactttgttacggcgggggtaccacgggggtacccttcgggctaacgttcccggtacctccccggtaaccgtcccttcccgaacccgaaccggggtccccaacgttcccgggttcccttaccccccggtgggccccgtacccccgtccgg

SEQ ID NO: 22790 - DNA, 556 bp, Homo sapiens
  misc_feature: GYAE6OF02FMO7T.12.40.D07.1.454.CMB.1.raw
  modified_base (358)..(358): a, c, t, g, unknown or other
  misc_feature (358)..(358): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgcaggctccaggcaaggggctcgagtgggtggcacttattgcacatgatggcgtcaacaaattctacgcaaattccgtgaggggccattcaccatctccagagacaattacaagaacacctttanctgacaaatagacagcctgacgaccagacgacacggctgtctattattgcgcgagagagacacacgaacctactgccaatactagtggggacttgttcgtggggccaggggaccctggtcagtcgtcctccccgacgtccctcccaacccgaacgggccctacgtccggttccttcccccgtcggtcccgcccctcgg

SEQ ID NO: 22791 - DNA, 572 bp, Homo sapiens
  misc_feature: GYAE6OF02G7WAJ.12.40.D07.1.454.CMB.1.raw
  modified_base (234)..(234): a, c, t, g, unknown or other
  misc_feature (234)..(234): n is a, c, g, or t
  modified_base (353)..(353): a, c, t, g, unknown or other
  misc_feature (353)..(353): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggctcaacaattcacgcaaattccgtgagggccattcaccatctcagagacaattacaagaacaccctttanctgacaaatagacagcctgacaccagaacgacacgctgtactattattgcgacgagagagacaccgaacgaacctacgtcgaccaatacgtaagtcggggtctttggttcgtcggggcctacgggggaccctgggtccacgtcgtcctccccgacgtccctaccgacccgaacgggtcccacgttcccggtccttcccccgtacggtccgtcccctcgg

SEQ ID NO: 22792 - DNA, 580 bp, Homo sapiens
  misc_feature: GYAE6OF02IZRSY.12.40.D07.1.454.CMB.1.raw
  modified_base (195)..(195): a, c, t, g, unknown or other
  misc_feature (195)..(195): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctntggatttcccttcaatttctattccatgcactgggtcccgccaggctccaggcaaggggctcgagtgggtggcacttattgcacatgatggcgtcaacaattctacgcaaattccgtgaggggcattcaccatctccagagacaattacaagaactaccctttaatctgacaaagtacgacagcctagacgaccagaacgacgacggactgtactattattgcgcgagacgagacaacgaacgaacctacgtacggaccaataactagtcgggggtcttgttcgtcggggccgacgggacccgtggtacacgtcgtcctacccgacgtccctaccgaccgaacggaccgacgtccggttaccgttcccccgtcggcccgcctccg

SEQ ID NO: 22793 - DNA, 602 bp, Homo sapiens
  misc_feature: GYAE6OF02IT2E0.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgcaggctccaggcaaggggctcgagtgggtggcacttattgcacatgatggcgtcaacaaattctacgacaaattccgtgagggggccgattccaccatcctcccagagacaaattacaaacgaactaaccctttatctgacaaatagacagcctgagaccagacgacacggctcgtctattatgcgcgagagagacacgaccgaacctactcgaccaagttacgtagtgggggtcttcgttcggtcgggaccgtaggggacccgttggtccgtagtccgtacctccccgtaacgtccctacccgaaccgaacgggcccctaacgttccggttaccccttcccccggtggtaccccgtcccgtacccgg

SEQ ID NO: 22794 - DNA, 595 bp, Homo sapiens
  misc_feature: GYAE6OF02FLC4A.12.40.D07.1.454.CMB.1.raw
  modified_base (149)..(149): a, c, t, g, unknown or other
  misc_feature (149)..(149): n is a, c, g, or t
  modified_base (235)..(235): a, c, t, g, unknown or other
  misc_feature (235)..(235): n is a, c, g, or t
  modified_base (362)..(362): a, c, t, g, unknown or other
  misc_feature (362)..(362): n is a, c, g, or t
  modified_base (438)..(438): a, c, t, g, unknown or other
  misc_feature (438)..(438): n is a, c, g, or t
tcagatacgacgtacacgaccggtgctcgatttagtgatagagcgtaacaacagagggctcaccatggagtttgggctgagcgtggtttcgtcgttaggctctttaagaggtgtccagtgtcaggggcacctggtggagtctggggganccgtggtccagcctgggcggtccctgacactcgcctgtgttgcctctggatttcccttcaatttctagttccatgcactgggtccnccaggctccaggcaaggggctcgagtgggtgcacttatgcacatgatggcgtcaaacaattctacgcaaattccgtgaggggccaattcaccatctcagacgacaattacaagaacctaccctttanctgacaaatgacagcctgacgaccagacgtacacggctgtctattattgcgacgagagagacacaacgaacctacncgaccaatacgtagtacggggtcttagttcgtcggggaccgacggggtaccctggtccgtatccgtacctacccgacgacccttacccgaaccgaaccggcccctacggttcccgggttaccctttccccccggtcgggtccccgtccccgtaccgg

SEQ ID NO: 22795 - DNA, 588 bp, Homo sapiens
  misc_feature: GYAE6OF02HK85D.12.40.D07.1.454.CMB.1.raw
  modified_base (149)..(149): a, c, t, g, unknown or other
  misc_feature (149)..(149): n is a, c, g, or t
  modified_base (376)..(376): a, c, t, g, unknown or other
  misc_feature (376)..(376): n is a, c, g, or t
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcgtccctgacactcgcctgtgttgcctctggacttttcccttcaattttctatttcccattgcactgggtccctgaggctccaggcaaggggctcggagtgggtgcactttatgcacatgatggcgtcaaacaaattcacgcaaatttcccggtggacggggtccatttcgacctattcctccaagagacaattacaagacaccctttanctgacaaatgacagcctagacgaccagacgagacgtctgtctattattgcgcgagagagacacacgaactacngacaactactagtcggggtnttcgttgtcgggccgacggggtcctggtctacgtccgtccgtcccgacgtcccgtaccgacccgaacgggcccctacggtccggttcccttcccccggtacggtcccggtcccgtccgg

SEQ ID NO: 22796 - DNA, 664 bp, Homo sapiens
  misc_feature: GYAE6OF02HZV8U.12.40.D07.1.454.CMB.1.raw
  modified_base (208)..(208): a, c, t, g, unknown or other
  misc_feature (208)..(208): n is a, c, g, or t
  modified_base (393)..(393): a, c, t, g, unknown or other
  misc_feature (393)..(393): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttntaatttctattccatgctacgtgggtccgccaggctccaggcaaggggctcgaggtgggtgcacttatgcacatgatggctacaactaaattctacgctaaagttccgaggtacggggcctatttccaaccgacttcctaccgaagaacgactaaagttaacaaagtaaaccctacccgttttanaccttagaactaaatagaactacgccctagacgaacccaggaaccgacgacgctagtntattagtgacgngaagagacgacacaaccgaactacgacgacctaactaacgtacggtcggggacctttcggttaccggtcggggtaccgaaccggggtaacccgttcggtaccgtacgtccgttaccccgtcccgaaccgtaccctcccgaacccgaaccgggtcccctacgtcccggttcccgttcccccgtcggtcccgtccccgtccgg

SEQ ID NO: 22797 - DNA, 915 bp, Homo sapiens
  misc_feature: GYAE6OF02ICGZ5.12.40.D07.1.454.CMB.1.raw
tcagatacgacgtacacgaccggtgctcgatttagtgatagagcgtaacaacagaggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccgccaggctccaggcaaggggctcgaggtgggtggctacttattgcacatgatggcgtacaaactaaattcctaacgacctaaaatttcccggtaggaacgggggccctaatttccaacctacttcctaccgaagaacggaacctaaaattaaccaaaacggtaaacccttaacccccttttaatacccgtagtaacctaaaaaacgttagaaacctacggtacccttagggaaaccggtaacccaaacgggaacccggaaaccgaaccggggtaccgtttacggtttaacccgttttaaagttttaaacggtttacggtacccgggtaccgggtaaacgggtaaacgggaaacggtaaacccgaaaacccggtaaaccccggtaaaaccccttaaccggttaaccgggaaaccccgtaaaacgtttaaccggtttaaacgggttacggggggggttacccttttacggggttttaccggttaccgggggggtacccggtaacccgggggggtaccccgttaccggggttaccgtaacggttccccgggttacccgtaccccccgtaaccgggtacccccttaaccccggaacccccggtaacccggggtacccccgtaacggtttccccgggttaccccgtttccccccccggtacgggtcccccggtccccgttacccggg

SEQ ID NO: 22798 - DNA, 663 bp, Homo sapiens
  misc_feature: GYAE6OF02IKIP4.12.40.D07.1.454.CMB.1.raw
  modified_base (149)..(149): a, c, t, g, unknown or other
  misc_feature (149)..(149): n is a, c, g, or t
  modified_base (232)..(232): a, c, t, g, unknown or other
  misc_feature (232)..(232): n is a, c, g, or t
  modified_base (280)..(280): a, c, t, g, unknown or other
  misc_feature (280)..(280): n is a, c, g, or t
  modified_base (374)..(374): a, c, t, g, unknown or other
  misc_feature (374)..(374): n is a, c, g, or t
tcagatacgacgtacacgaccggtgctcgatttagtgatagagcgtaacaacagagggctcaccatggagtttgggctgagctgggttttcctcgttgctctttaagaggtgtccagtgtcaggggcacctggtggagtcgtggggganccgtggtccagcctgggcgtccctgacactcgcctgtgttgcctctggatttccctcaatttctattccatgcactgggtccnccaggctccagggcaaggggctcgaggtgggtcgctacgttatgccanatgatggcgtcaactaaattcacgcaaattccgtaggacggggtccattccaccaatcctacaagacgactaagttacaagaaccctccttaanctagaccaaatgacagcctgaacgacccaagaccgaacacggctacgtacttaacttagtcgtacggtacgtaacgaagacgaacgtacaaacggtaacctaccgtacggacctaaacgtaacgtagttacgggggtacttacggttacgtacgggggtccgtaacgggggtacccgtcgggtacgtacgttacccggtcccgttaccccgacgtaccccgttaccgaacccgtaacgggccctaacggttccggtcccgttaccccggtcggtcccgcccggttaccg

SEQ ID NO: 22799 - DNA, 551 bp, Homo sapiens
  misc_feature: GYAE6OF02GN270.12.40.D07.1.454.CMB.1.raw
  modified_base (235)..(235): a, c, t, g, unknown or other
  misc_feature (235)..(235): n is a, c, g, or t
  modified_base (498)..(498): a, c, t, g, unknown or other
  misc_feature (498)..(498): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaacaaattctacgcaaattccgtgaggggccattcaccatctcagagacaattacaacgaactaccctttatctagacaaatagacagcctgagaccagacgacacgctgtactattatgcgcgagagagacacacgaacctactggaccaatactagtggggtcttgttcgtgggccgacgggtaccctggtcagtccgtcctacccgngtccctccgaccgacggcccagtccggtccttccccgtcggtcccgccctcgg

SEQ ID NO: 22800 - DNA, 609 bp, Homo sapiens
  misc_feature: GYAE6OF02F21CS.12.40.D07.1.454.CMB.1.raw
  modified_base (235)..(235): a, c, t, g, unknown or other
  misc_feature (235)..(235): n is a, c, g, or t
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtgcacttatgcacatgatggctnaacaaattctacgcaaattccgtgaggggccattcaccatctccagagacaattacaagaacaccctttanctgacaaatgacagcctgagacccagacgacacggctgtactattattgcgtcgagagagaacacgacgaacctacaggccaaagtactagtcggggggactttcgttcgtcgggggaccaacgggggtacccctcgggtccgtacgttccggtaccctcccccgaacggtccccttacccgaacccgtaacgggcccctaagttcccgggttccctttcccccccggtacgggtccccgtccccgtccgg

SEQ ID NO: 22801 - DNA, 702 bp, Homo sapiens
  misc_feature: GYAE6OF02J08RL.12.40.D07.1.454.CMB.1.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
  modified_base (385)..(385): a, c, t, g, unknown or other
  misc_feature (385)..(385): n is a, c, g, or t
  modified_base (464)..(464): a, c, t, g, unknown or other
  misc_feature (464)..(464): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccaggcctgggcggtcctgacactcgcctgtgttgcctctggactttccctnaatttctattccatgcactgggtccnccaggctcaggcaaggggctcggagtgggtgcacttatgcanatgagtggcgtacaaactaaagtttctaacggctaaattcccggtggacggggtcctattccaaccgatcctacagagtacaattacaaacgaacctaccctttaancacgaactaaatcgaactacgcctagaacgacccagaccgacgacgtactacgtacttattagtgacgtacgagacganaccacgtaacgaaaccttacgacggacctaaacgttaacgtaggtacggggttcgttaccggtttacggtaccggggtaccgggaacggggttaccccgtaggggttacccgtacgttacccggttacccttaccccggtaccgtaccccgttaccaacccccgggtacgggacccctaccggtttacccggtaccccgttacccccggtaccgggtccccggttaccccgtacccgg

SEQ ID NO: 22802 - DNA, 725 bp, Homo sapiens
  misc_feature: GYAE6OF02IT15C.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtcctgacactcgcctgtgttgcctctggatttccctcaatttctattccatgcactgggtccgccaggctccgagggcaaggggctcggagtgggtgcacttatgcacatgatggcgtacaaactaaattctaacgactaaacgtttcccggtagggacgggggccgtaatttccaacctactcctaccagacgaactaaattaacaaagaacctaccctttatctagactaaatacgacaacgtcctaggacaacccgacgaacgaccgaccgggcgtacgttactaatttacgttacggaccggtacggaaggaacggagaaccgaaacccgtaaccgaaacccgttaaccgtaccggaccgtaaacgttaaccgtacgggttacggggggtaccttttcggggtttaccggtcgggggtacccgacgggggttaacccttgggtacctacgttccgttaccctccccgtacgtaccccgtaccgaaccccgtaacggggtccctacggttcccggttccccttcccccggtcgggtacccgccccgttaccg

SEQ ID NO: 22803 - DNA, 653 bp, Homo sapiens
  misc_feature: GYAE6OF02HVLS9.12.40.D07.1.454.CMB.1.raw
  modified_base (191)..(191): a, c, t, g, unknown or other
  misc_feature (191)..(191): n is a, c, g, or t
  modified_base (223)..(223): a, c, t, g, unknown or other
  misc_feature (223)..(223): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (639)..(639): a, c, t, g, unknown or other
  misc_feature (639)..(639): n is a, c, g, or t
tcagatacgacgtacacgaccggtgctcgattttagtgatagagcgtaacaacagagggctcaccatggagtttgggctgagcgttgggtttttcctcgttgcttcttttaagaggtgtccagtgtcgaggggcacctgggtggagtcgtggggggagccggtggtccagccgtggggccggtccctgacnctcgcctgtgttgcctctggtactttcccttntaattttctattccattgccacgttcgggtcccgccgacggcctacccgaggggccgaaagggggtcctacggaggtggggtcggactactttagttgcacagttgatggcgtacaaactaaatttccgtaacgactaaagttccggtggaacgggggcctattcaccctagttcctacagaagaactaaattaacaaagaaacccttaccctttaatctagaacaaaatagaacacgtacctagaacgaccgaagacgacgacgcttagtactattatgcgngaagngacacaacgacaactatcgacaatagagtggggtcttgttcggcgggaccgacggggtacctggtcagttccgtaccgtcccgacgccctaccgaccgaacggtcccagttcccgtcccttccccggngccccgtccgtccg

SEQ ID NO: 22804 - DNA, 571 bp, Homo sapiens
  misc_feature: GYAE6OF02I4BPO.12.40.D07.1.454.CMB.1.raw
  modified_base (384)..(384): a, c, t, g, unknown or other
  misc_feature (384)..(384): n is a, c, g, or t
  modified_base (458)..(458): a, c, t, g, unknown or other
  misc_feature (458)..(458): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctggggcggtccctgacactcgcctgtgttgcctctggatttcccttcaatttctattccatgcactgggtccgccaggctccaggcaaggggctcgaggtgggtgcacttatgcacatgatggcgtcaaacaaattctaacgactaaatttcccggtaggacgggggcccgaattccaaccctatcctccaagagactaattacaagaacctaccctttanctagacaaatagacagcctgacaccagacgacacggctgtactattatgcgcgagagagacacacgaacctacngaccaatactagtggggtcttgttcgtgggccgaggggacccgtggtctacgtcgtcctcccgcgcctaccgaccgacggcccacgtccggtccttccccgcgcccgccctcg

SEQ ID NO: 22805 - DNA, 579 bp, Homo sapiens
  misc_feature: GYAE6OF02IXSJY.12.40.D07.1.454.CMB.1.raw
  modified_base (150)..(150): a, c, t, g, unknown or other
  misc_feature (150)..(150): n is a, c, g, or t
  modified_base (235)..(235): a, c, t, g, unknown or other
  misc_feature (235)..(235): n is a, c, g, or t
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggganccgtggtccagcctgggcggtccctgacactcgcctgtgttgcctctggatttccctcaatttctattccatgcacgtgggtccnccaggctccaggcaaggggctcggagtgggtgctacttatgcacatgatggcgtacaacaaattcacgctaaattccgtggagggccattccactatctcaganacaatacaagaactcccttanctgacaaatgacagcctagacaccagacgacacggctgtctattattgcgacgagagagacacacgaacctactacgaccaatacgtagtacggggtcttcggttcgtacggggaccgacggggtaccctggtactacgttcgtaccctcccgacgtccctaccgaaccggaccggccctacgttcccggtccttccccgtcggtcccgtcccgtaccg

SEQ ID NO: 22806 - DNA, 535 bp, Homo sapiens
  misc_feature: GYAE6OF02FWD5D.12.40.D07.1.454.CMB.1.raw
  modified_base (490)..(490): a, c, t, g, unknown or other
  misc_feature (490)..(490): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaacaaattctacgcaaattccgtgaggggccattcaccatctccagagacaattacaagaactaccctttatctgacaaatagacagcctgacgaccagacgacacggctgtctattatgcgcgagagagacacacgaacctactgaccaatactagtggggtcttgttcgtggggccacgggcctggtcatcgcctcccgngccctccaccgacggcccagtccggtcctccccgtgccgccctcg

SEQ ID NO: 22807 - DNA, 546 bp, Homo sapiens
  misc_feature: GYAE6OF02IDSOS.12.40.D07.1.454.CMB.1.raw
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
  modified_base (474)..(474): a, c, t, g, unknown or other
  misc_feature (474)..(474): n is a, c, g, or t
  modified_base (531)..(531): a, c, t, g, unknown or other
  misc_feature (531)..(531): n is a, c, g, or t
tcagatacgacgtacacgaccggtgctcgatttagtgatagagcgtaacaacagaggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaattttctattccatgcactgggtccgccaggctccaggcaaggggctcgagtgggtggcacttatgcacatgatggctcaacaaattctagcaaatttccgtgacggggccattcacatctcaganacaattacaagaacaccctttanctgacaaatanacagcctgagaccagacgacacgctgtactattatgcgcgagaganacacacgaactacngcaatactagtggggtcttgtcgtgggccgagggaccctgtacgntcgtcctcccgagtccctaccgaccgaacggccctacgtccggttacccttccccgnggtcccgtcccgtcg

SEQ ID NO: 22808 - DNA, 568 bp, Homo sapiens
  misc_feature: GYAE6OF02H63WD.12.40.D07.1.454.CMB.1.raw
  modified_base (514)..(514): a, c, t, g, unknown or other
  misc_feature (514)..(514): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctgggtggagtctggggggagccgtggtccagcctgggcggtcctgacactcgcctgtgttgcctctggatttcccttcaatttctattccatgcactgggtccgccaggctccaggcaaggggctcgagtgggtggcacttattgcacatgatggcgtcaactaaattctaacgctaaaattccgtggaggggccattcaccatctccagagacaatacaagaacacccttttatctagacaaaatacgaacacgacctgagacccagaccgacacggctcgtctattattgcgcgagagagaccacaacgaacctactggacaatactagtaggggtcttgtcgtggggaccacggggacctggtcacgtcgtcctacccgngccctaccgaccgtaacggcccagtccggtccttcccccgtgtcccgccgtccg

SEQ ID NO: 22809 - DNA, 567 bp, Homo sapiens
  misc_feature: GYAE6OF02G5N8V.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttatgcacatgatggcgtcaacaattctacgcaaattccgtgaggggccattccaccatctccagagacaattacaagaactaccctttatctagacaaatgacagcctgacgaccagacgacacgctgtctattattgcgcgagagagacacaccgaacctacgcgaccaatactagtggggtactttcgttcgtcggggcctaggggaccctggtccagtccgtcctcccgacgtccctaccgaacccgaacggccctacgttcccggtcccttcccccgtcggtcccgcccgtcgg

SEQ ID NO: 22810 - DNA, 584 bp, Homo sapiens
  misc_feature: GYAE6OF02F5Z8M.12.40.D07.1.454.CMB.1.raw
  modified_base (149)..(149): a, c, t, g, unknown or other
  misc_feature (149)..(149): n is a, c, g, or t
  modified_base (234)..(234): a, c, t, g, unknown or other
  misc_feature (234)..(234): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
tcagatacgacgtacacgaccggtgctcgatttagtgatagagcgtaacaacagagggctcaccatggagtttgggctgagctgggtttcctcgttgctcttttaagaggtgtccagtgtcaggggcacctggtggagtctgggggganccgtggtccagcctgggcggtccctgacactcgcctgtgttgcctctggatttcccttcaatttctattccatgcactgggtccnccaggctccaggcaaggggctgagtgggtgcacttatgcacatgatggcgtcaacaattcacgcaaattccgtgaggggccgattccaccatctccagacgacaattacaagaacaccctttanctgacaaatgacagcctganaccagacgacacggctgtactattattgcgcgagagagacacacgaacctacgtgaccaatactagtggggtctttggttcgcggggtccacggggtaccctgggtcagttccgtcctccccgacggtcccttaccgaacccgaacgggtccccgtaacgttcccggttacccttccccccgttcgggtcccgtacccccgtccgg

SEQ ID NO: 22811 - DNA, 544 bp, Homo sapiens
  misc_feature: GYAE6OF02IGQBW.12.40.D07.1.454.CMB.1.raw
  modified_base (235)..(235): a, c, t, g, unknown or other
  misc_feature (235)..(235): n is a, c, g, or t
  modified_base (383)..(383): a, c, t, g, unknown or other
  misc_feature (383)..(383): n is a, c, g, or t
  modified_base (417)..(417): a, c, t, g, unknown or other
  misc_feature (417)..(417): n is a, c, g, or t
  modified_base (499)..(499): a, c, t, g, unknown or other
  misc_feature (499)..(499): n is a, c, g, or t
  modified_base (532)..(532): a, c, t, g, unknown or other
  misc_feature (532)..(532): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtcaacaattctacgcaaattccgtgaggggccgattcgaccatctccagagacaattacaagaacacccttatctgacaaatagacagcctaganaccagacgacacggctgtactattattgcgcganagagacacacgaacctactgaccaatactatggggacttggttctggggcctaggggaccctggtcgagtcgtcctccccgngcctccacgacggcccatccggtccttccccgnggtcccgcctcg

SEQ ID NO: 22812 - DNA, 758 bp, Homo sapiens
  misc_feature: GYAE6OF02F519V.12.40.D07.1.454.CMB.1.raw
  modified_base (209)..(209): a, c, t, g, unknown or other
  misc_feature (209)..(209): n is a, c, g, or t
  modified_base (409)..(409): a, c, t, g, unknown or other
  misc_feature (409)..(409): n is a, c, g, or t
tcagatacgacgtacacgaccggtgctcgatttagtgatagagcgtaacaacagagggctcaccatggagtttgggctgagcgtggtttccgtcgtagctctttaagaggtgtccagtgtcaggggcacctggtggagtcgtgggggagccgtggtccagcctgggcggtccctgacactcgcctgtgttgcctctggactttcccttnaatttctattccatgcagtgggtccgccaggctccaggcaaggggctcgaggtgggtgcacttatgcaactatgagtggctacaaactaaatttcaaccgacaaaacgtttcccggagggacgggggaccctatttcccaacctactcctaccgaaggtaacaacctaaattaaccaaagtaaaccctacccgttttaancgtaagaacgtaaatacgaactacggtacctaggaaccgtaaccgaaggaccgaaccgacggtctacgttacttagtttacgttacgacgtacgaagaacgaacgaaccaaccgaaaccgtaacccgttaccgtaccgtaaccgtaaacgttacggttacgggttacggggttacgttttacgggttccgggtacggggtacccggtaaccggggtacccgttacgggttaccgtaccgttacccgtacccgtaccccggtacgtacccttaccccggaacccggtaccggtaaccccgtacggttccccggttaccccgttcccccgggtccggtcccgtcccgtcgg

SEQ ID NO: 22813 - DNA, 624 bp, Homo sapiens
  misc_feature: GYAE6OF02IDOM7.12.40.D07.1.454.CMB.1.raw
  modified_base (92)..(92): a, c, t, g, unknown or other
  misc_feature (92)..(92): n is a, c, g, or t
  modified_base (146)..(146): a, c, t, g, unknown or other
  misc_feature (146)..(146): n is a, c, g, or t
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
tcagatacgacgtacacgaccggtgctcgatttagtgatagagcgtaacaacagaggctcaccatggagtttgggctgagctgggttttccncgttgctctttaagaggtgtccagtgtcaggggcacctggtgagtctggggganccgtggtccagcctgggcggtccctgacactcgcctgtgttgcctctggatttccctnaatttctattccatgcacgtgggtccnccaggctccaggcaaggggctcgagtcgggtgacacttattgacacagttgatgggctacaaaccgaaattcctacgctaaaatttcccggnggaggggcccattcacctatctaccaganacaattacaagacctacccttttacctgaccaaattacgacagcctagacaccctaagaccgtacacggtctacgtctattactgtacgcgtagacgacgacgaacacgactacgttcggacctaactacgtagtacggggtacttggttccgtacggggtccacggggtacctacgggttcgacgttaccgtcctaccccgacgtcccgtacccgacccgtaaccggccctacgtaccggttcccttccccgtacggtcccgcccgtccgg

SEQ ID NO: 22814 - DNA, 563 bp, Homo sapiens
  misc_feature: GYAE6OF02I0O55.12.40.D07.1.454.CMB.1.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (459)..(459): a, c, t, g, unknown or other
  misc_feature (459)..(459): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttnaatttctattccatgcactgggtccnccaggctccaggcaaggggctcgagtgggtggcacttattgcacatgatggcgtcaaacaaattcctaacgacaaaatttccgtaggacgggggccgtattccaaccattcctaccgaagagaacaattaccaaagaacctaccctttatctgactaaatagacagcctgacaccagacgacacggctgtactatattgcgacgagagagacacacgaactacngaccaatactagtgggtcttgtcgtgggaccgacgggcctggtcagtcgtcctcccgcgcctccaccgacggcccacgtccgtcctccccgtcggccgccctcg

SEQ ID NO: 22815 - DNA, 685 bp, Homo sapiens
  misc_feature: GYAE6OF02FTDER.12.40.D07.1.454.CMB.1.raw
  modified_base (151)..(151): a, c, t, g, unknown or other
  misc_feature (151)..(151): n is a, c, g, or t
  modified_base (210)..(210): a, c, t, g, unknown or other
  misc_feature (210)..(210): n is a, c, g, or t
  modified_base (391)..(391): a, c, t, g, unknown or other
  misc_feature (391)..(391): n is a, c, g, or t
  modified_base (608)..(608): a, c, t, g, unknown or other
  misc_feature (608)..(608): n is a, c, g, or t
tcagatacgacgtacacgaccggtgctcgatttagtgatagagcgtaacaacagagggcttcaccatggagttttgggctgagctgggttttcctcgttgctcttttaagaggtgtccagtgtcaggggcacctggtggagtctggggganccgtggtccagcctgggcggtccctgacactcgcctgtgttgcctctggatttcccttnaatttcattccatgcactgggtaccgccaggctccgaggcaaggggctcggagtgggtgcacttatgcacatgatggcgtacaaacaagttcctacgacaaaagttcccgtgaacgggggccaatttccaacctatcctaccaagacgaactaattaacaaagtaacctaacccgttttanctagacctaaaatacgaacctagacctaggaacgaacccaaggaaccgaacgtaccggactacgtacttaagttagttcggcgtaccggtaagacggaacgaccgaccgaacgtaacccttaacgtcggaccctaagtaccttaggtcgggggtcctttgttaccgtcggggtacctacggggtacccgtaggtccacgttaccgtcctacccccgngtaccccgtcccgaaccgtaccgggaccctacgttcccgggttacccttcccccggtcggtcccgtacccgtcccgg

SEQ ID NO: 22816 - DNA, 582 bp, Homo sapiens
  misc_feature: GYAE6OF02IJ0O2.12.40.D07.1.454.CMB.1.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (377)..(377): a, c, t, g, unknown or other
  misc_feature (377)..(377): n is a, c, g, or t
  modified_base (488)..(488): a, c, t, g, unknown or other
  misc_feature (488)..(488): n is a, c, g, or t
  modified_base (529)..(529): a, c, t, g, unknown or other
  misc_feature (529)..(529): n is a, c, g, or t
  modified_base (574)..(574): a, c, t, g, unknown or other
  misc_feature (574)..(574): n is a, c, g, or t
tcagatacgacgtacacgaccggtgctcgatttagtgatagagcgtaacaacaggagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttccctnaatttctattccatgcactgggtccnccaggctccaggcaaggggctcgagtgggtgcacttatgcacatgatggcgtacaaacaaacttctaacgacaaattccgtaggaggggccatttccaccatcctaccagagaacctaattaccaaagaacctacccctttancctacgactaaaatcgaacagacctgaacgacccaagaccgacacggctgtctattattgacgcgagagagacacacgaactactgacaatactagaggggcttcgttcgngggccaggggaccctggtctactcgtcctcccgcgtacccnccgaccgtaaccggcccacgtccggtacccttccccgtcggcccncccgtccg

SEQ ID NO: 22817 - DNA, 585 bp, Homo sapiens
  misc_feature: GYAE6OF02H8KK8.12.40.D07.1.454.CMB.1.raw
  modified_base (405)..(405): a, c, t, g, unknown or other
  misc_feature (405)..(405): n is a, c, g, or t
tcagatacgacgtacacgaccggtgctcgatttagtgatagagcgtaacaacaggggactcaccatggagtttgggctgagctggggttttcctcgttgctcttttaagaggtgtccagtgtcaggggcacctggtggagtctgggggagccgtggtccagcctgggcggtcccttacactcgcctgtgttgcctctgggatttcccttcaatttctattccatgcactgggtccgccaggctccaggcaagggggctcggagtgggtggcacttattgcacatgatggcgtcaacaaattctacgcaaattccgtgacgggccattcaccatctccagagacaattacaagaacctaccctttatctagacaaatagacagcctagacgaccagacgacacggntgtctattatgacgcgaagagagacacacgaacctacgcggaccaatactagtggggtctttgttacgtggggaccgacgggtacccgtggtccacgtcgtcctcccgacgccctaccgacccgaacggtcccacgttcggttcccttccccgtcggtcccgcccgtcgtccgtacccgg

SEQ ID NO: 22818 - DNA, 556 bp, Homo sapiens
  misc_feature: GYAE6OF02FWWDQ.12.40.D07.1.454.CMB.1.raw
  modified_base (361)..(361): a, c, t, g, unknown or other
  misc_feature (361)..(361): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaacaaattctaacacaaattccgtgaggggccattcaccatctccagagacaattacaagaacaccctttanctgacaaatgacagcctgacgaccagacgacacggctgtctattattgcgcgagagagacaacacgaacctactggaccaatactagtggggtcttgttcgtggggccgaggggacccgtggtcacgtcgtcctcccgacgtccctaccaccgaacggcccacgtccggtccttcccccgtggcccgtcccgtcg

SEQ ID NO: 22819 - DNA, 661 bp, Homo sapiens
  misc_feature: GYAE6OF02IFKNJ.12.40.D07.1.454.CMB.1.raw
  modified_base (151)..(151): a, c, t, g, unknown or other
  misc_feature (151)..(151): n is a, c, g, or t
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (571)..(571): a, c, t, g, unknown or other
  misc_feature (571)..(571): n is a, c, g, or t
  modified_base (653)..(653): a, c, t, g, unknown or other
  misc_feature (653)..(653): n is a, c, g, or t
tcagatacgacgtacacgaccggtgctcgatttagtgatagagcgtaacaacagagggctcaccatggagtttgggctgagcgtggtttccgtcgtaggctctttaagaggtgtccagtgtcaggggcacctggtggagtcgtgggggganccgtggtccagcctgggcggtccctgacactcgcctgtgttgcctcgtggacttttcccttnaatttcctattccagtgcacgtgggtccnccaggctccgaggctaaggggctcgaggtgggtgctacttatgacacatgatcggctacaaactaaattctaacgctaaagttccggtaggacggggcctattccacctatcctaccgagacgtaacctaattaacgaacgtaaaccctacccttttaagctacgaactaaaagtacgacgacgtcctaggaacgaccaggtaccacgacgctacgtcttaagttatggacgngaagngaacgacaaccgacgtaacctagtacgacctaagtacgtacggttggggtcttagggtcgtacggggacctaaggggtccctaggtaccgngtttaccccggaccctaccgtacgtccccaaccgtaaccggaccgtcccgtacggtcccgtaccccgttcccggcggtcccnccgtaccg

SEQ ID NO: 22820 - DNA, 827 bp, Homo sapiens
  misc_feature: GYAE6OF02H7WL7.12.40.D07.1.454.CMB.1.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtgggtccagcctgggcggtcctgacactcgcctgtgttgcctctggatttcccttnaatttctattccatgcactgggtccnccaggctccaggcaaggggctcgagtgggtggcacttattgcacatgatggcgtacaacaaatttctaacgcctaaaattcccggtaggacgggggcccgtatttccacccgtattcctacccaaggaacgtaacctaaatttaaccaaacggtaaaccctaaccccctttttaatcctaggtaacctaaaagttacggaaccacggtcccttaggaacgaacccgaaggtaacccggaaccgaaccgggaccttacggttacctttaagtttaacgtttacggtaccgtaccggtaaacggaggaacggaacccgaaccgtaaacccgtaaacccttaaccgttacgggaccctaaacgttaaccgttaacggttacgggggggtcttttcgggtttaccggttacggggggtacccggtaaccggggggtaccccgttacggggttaccgtacgtttacccggttaccccgttacccccgtacggtaccccttaccccgaaccccggtaaaccggggcccccgttacggttccccgggttaccccgtttacccccccggtacgggtccccccggtccccgttaccccggg

SEQ ID NO: 22821 - DNA, 618 bp, Homo sapiens
  misc_feature: GYAE6OF02H0ZMC.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattcacgctaaattccgtgaggggccattccaccatctccagagacaattacaagaactaccctttatctgacaaatagaacagcctgacgaccagacgacacggctgtctattatgcgacgagagagacacgaccgaacctactcggaccaaatacgtaagtcgggggtactttggttccgtcggggaccgtacggggtacccgtgggtccacgttccgtcccgttcccccgaacgtccccgttacccgaacccgtaaccggggacccctaacgttcccgggtaccccgtttccccccgtacgggtccccgtccccgtccgg

SEQ ID NO: 22822 - DNA, 589 bp, Homo sapiens
  misc_feature: GYAE6OF02JHNK4.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtcaacaaattctacgcaaattccgtgacggggccgattcaccatctccagagacaattacaaagacacccttatctgacaatagacagctgagaccagacgacacgctgtctattattgcgcgagagagacacacgaacctactcgaccaatactagtcggggtcttgttcgtcggggtccgacggggtacccgtcggtactacgttcgtaccgtccccgacggtccctaccgaacccgaaccgggtaccccacggttcccggttcccttaccccccgtcgggtccccgtaccccgttacccg

SEQ ID NO: 22823 - DNA, 617 bp, Homo sapiens
  misc_feature: GYAE6OF02H9YY9.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtacaacaaattctacgacaaattccgtggaggggccattcaccatctccagagacaattacaagaacctaccctttatctgacaaatagacagcctagagaccagacgacacggctgtctattattgcgcgaagagagacacgacgaaccctacgtacggaccaaatactaggttacgggggtctttacggttcgtacgggggaccgtacggggtaccccgtgggtctacgtccgttccctccccgacgtccccttacccgaacccggtaaccgggaccccgtacgttcccgggttcccttccccccggtcgggtcccgtccccgttccgg

SEQ ID NO: 22824 - DNA, 762 bp, Homo sapiens
  misc_feature: GYAE6OF02HGEEZ.12.40.D07.1.454.CMB.1.raw
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (663)..(663): a, c, t, g, unknown or other
  misc_feature (663)..(663): n is a, c, g, or t
tcagatacgacgtacacgaccggtgctcgatttagtgatagagcgtaacaacagagggctcaccatggagttgggctgagctgggtttcctcgttgctcttttaagaggtgtccagtgtcgaggggcaccgtgggtggaggtcgtggggggagccggtggtccgaggccgtgggccggtccctgacactcgcctgtgttcgcctcgtggtactttccccttnaattttcctagttcccattcgctacgtggggtcccnccagggcctaccgagggccgaaaggggtctcggaggtcggggtggcacgttatcggacaacgagtgatcgggacgtacctaaaaacgtaaaattccctaagaccaaaaattttccccggagggaagggggaccctactttaccgaaccaacttccgtaccaaggtaacgaactaaaacgttaacaaacggaaacccttacccttttaagccagtaacaaaaacttaacggaactacggtacccttaggaaaccgaccgaaacggaccgaacgaaccgggcctaggtacctaattaagttcgacgacgtaagaggaacgacgaaacctacgaaacctaccgtagaacccgaaataaccgtagtacggggtctttaacggcgttcggggaccgaacgggttacccgnggtacgaacctcggtaccctaccccgaatcccctaccggaaccctaacggggaccccctagttccccggtccgttaccccgtcggcccgtccctaccgg

SEQ ID NO: 22825 - DNA, 871 bp, Homo sapiens
  misc_feature: GYAE6OF02HCH5Y.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaattttctattccatgcactgggtccgccaggcctccaggcaagggggctcggaggtggggtggctacttattgcacatgatggccgtacaaacaaattctaacgactaaacgttcccggtaggacggggcccgtaattccaacccattcctacccgaaggaacgaacctaaaactttaacaaacggtaaaacccttaaccccttttaatccgttacgaacctaaaaagttacggaaacctacggtaccctaggaaaccgaacccgaaggaacccgaaccgaaccgggtaccttacggttacctttaaacgtttaacgtttacggaccggtaccggaaggaacggaaacggaacccgaaaccgaaacccggtaaaccccgttaaccgttaaccgggaaccctaaaacgttaaccgttaacggttacgggggggttaccttttacggggtttaccgggttaccggggggtacccggtaaccggggggtaccccgttagggttacccgtacgttacccggttccccgttacccccggtaacccggtacccccgttaaccccgtaaccccggtaacccggggtacccccgttaaccgggtttacccccgggttacccccgttttacccccccgggtccgggtcccccggtcccccgttacccggg

SEQ ID NO: 22826 - DNA, 727 bp, Homo sapiens
  misc_feature: GYAE6OF02JPFGB.12.40.D07.1.454.CMB.1.raw
  modified_base (211)..(211): a, c, t, g, unknown or other
  misc_feature (211)..(211): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggtactttcccttnaattttctattccatgcactgggtccgcaggctccaggcaagggggctcggaggtggggtgactacttatgcacatggatggctacaacaaattctacgtactaaattccggtagggaacggggccctagttccaaccaattcccgtaccaaggacaacgtaaactttaacgaaacgaaacctaaccccttttagtaccgtagaccgtaaaataacgaactaacgggtccctaaggaacgaacccgaaggaaaccgaccgaaccgggtacttacggttaacttaatttacgttcggacgtaccggaaggaacgtacgaaccgaacctaacccggtaaacctacgtcgtaacctaaagtacgtaggtcgggggtactttcggttacggtcggggaccggtaacggggaccctcgggtacctacgttccgtcccgtaccccgtcgtccctaccgaacccgtaccggaccctacccggttaccggttccccttccccggtcggtccccgtcccgtccgg

SEQ ID NO: 22827 - DNA, 571 bp, Homo sapiens
  misc_feature: GYAE6OF02IQ7SD.12.40.D07.1.454.CMB.1.raw
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttatgcacatgatggcgtcaacaaattctacgcaaattccgtgaggggccattcaccatctccagagacaattacaagaacctaccctttanctgacaaaatagacagcctagagaccagacgacacggctgtctattatgcgacgagagaacgacaaccaacgaaaccctactacggaccaattacgtagtgggggtccttgttcgtcggggtccacggggaccctggtacagtccgtacctccccgagccctaccaccgaacggcccagtccggtacccttccccgcggtcccgccctccg

SEQ ID NO: 22828 - DNA, 543 bp, Homo sapiens
  misc_feature: GYAE6OF02GOJWW.12.40.D07.1.454.CMB.1.raw
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (428)..(428): a, c, t, g, unknown or other
  misc_feature (428)..(428): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaacaaattctacgcaaattccgtgaggggccattcaccatctccagagacaattacaagaacacctttanctgacaaatgacagcctganaccagacgacacgctgtntattatgcgcgagagagacacacgaacctacngacaatactagtggggtcttgttcgtggggaccgacggggccctggtcacgtcgtcctcccgagccctaccgaccgacggccctacgtccgtccttccccgtcggtccgccctcg

SEQ ID NO: 22829 - DNA, 601 bp, Homo sapiens
  misc_feature: GYAE6OF02GYJ4W.12.40.D07.1.454.CMB.1.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (334)..(334): a, c, t, g, unknown or other
  misc_feature (334)..(334): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttnaatttctattccatgcactgggtccnccaggctccaggcaaggggctcgagtgggtggctacttatgcacatgatggcgtcaaacaaattctacgacaaattccggtagaggggcctattcgaccntctccaagacgaacaaattacaaacgaacctaccctttatctagactaaataggacacgctagaacgaccaagacgacgacggtctgtactattattgcgcgagacgagacacacgaacctacgtcgacctaatactaggtcggggtctttcgtcggtcggggccgtacggggtacctggtacacgtccgtacctccccgacgtccctaccgaaccgtaaccgggccctacgtccggttcccttccccggcggtcccgtccctccgg

SEQ ID NO: 22830 - DNA, 577 bp, Homo sapiens
  misc_feature: GYAE6OF02HAPZV.12.40.D07.1.454.CMB.1.raw
  modified_base (237)..(237): a, c, t, g, unknown or other
  misc_feature (237)..(237): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtcccgtgacgactcgcctgtgttgcctctggactttcccttcaatttctattccatgcactgggtccnccaggctccaggcaaggggctcgagtgggtgcacttatgcacatgatggcgtcaaacaaattctaacgacaaattccggtggacggggccgattcaccatcctcagagacaattacaaagaactacccttanctgacaaatanacngcctgacgaccagacgacacgctgtactattatgcgcgagacgagacaacacgaacctacgcgaccaatactaggtcggggtctttagttcgtcggggacgtacggggtaccctggtcacgttcgtcctcccgacgccctaccaaccgaaccggccctacgtccggtaccgttcccccgtcggtcccgccctcg

SEQ ID NO: 22831 - DNA, 592 bp, Homo sapiens
  misc_feature: GYAE6OF02GVE60.12.40.D07.1.454.CMB.1.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
  modified_base (416)..(416): a, c, t, g, unknown or other
  misc_feature (416)..(416): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagccgtgggcggtccctgacactcgcctgtgttgcctctggatttcccttnaatttctattccatgcactgggtccnccaggctccaggcaaggggctcgagtgggtgcacttatgcanatgatggcgtacaacaaattcaacgactaaattccggtaggacggggtccaatttcaccatcctaccagagaacaaattacgaaagaacctaccttatctagaacaaatagacacgctagacgaccaagacgacacgntacgtactattagtcgcgagagacgagactacaccgactacgtcgacaatacgtagtcggggtcttgttcgcgggacgacgggtacctacggtcacgtccgtacctcccgacgtcctacccgaaccgtacggaccctacgtcccggtacccttcccccggtggcccgtcccgtcgg

SEQ ID NO: 22832 - DNA, 577 bp, Homo sapiens
  misc_feature: GYAE6OF02HDFEO.12.40.D07.1.454.CMB.1.raw
  modified_base (235)..(235): a, c, t, g, unknown or other
  misc_feature (235)..(235): n is a, c, g, or t
  modified_base (455)..(455): a, c, t, g, unknown or other
  misc_feature (455)..(455): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccnccaggctccaggcaaggggctcgagtgggtggcacttatgcacatgatggcgtcaacaaattctacgcaaattccgtgaggggccattcaccatctccagagacaattacaagaacaccctttatctgacaaatagacagcctagacgaccagacgacacgctgtctatattgcgcgagacgagacacacgacctactcgaccaatacgtagtcggggtnttgttcgtgggaccaggggaccctgggtacacgtccgtcctaccccgacgtcccgtacctacccgaacgggccccgaacgttcccgggttaccctttccccccggtcggcccgtcccctcgg

SEQ ID NO: 22833 - DNA, 750 bp, Homo sapiens
  misc_feature: GYAE6OF02JDURA.12.40.D07.1.454.CMB.1.raw
  modified_base (147)..(147): a, c, t, g, unknown or other
  misc_feature (147)..(147): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagatacgacgtacacgaccggtgctcgatttagtgatagagcgtaacaacagaggctcaccatggagtttgggctgagctgggttttcctcgttgctctttaagaggtgtccagtgtcaggggcacctggtggagtctggggganccgtggtccagccgtgggcggtccctgacactcgcctgtgttgcctcgtggatttcccttnaatttctattccatgccactgggtcccncaggcctccaggcaagggggtctcggagtggggtcgctacgttagttgccacattgacttgggccgtacaactaaattcgtaccgtataaacgttccgtaggacggggcctaattccgacctaattcctccaggacgaacctaattaccaaagtaacctaccccttttataccgtagtaaccaaaactacgtaacctaggtacccttagaacgtaaccccgagaacccgtaccgaacggacttacgtacttaacgttattacggcgtacgtacgtaacgagtaccgaacgtaacgaacctaacgcgtaccaaatacgttagtacgggggtctttacggtcgtacggggtcccgtaacgggtcccgttagccgtaaccgtttccggtccccgttaacccccggacgggttacccccttaccccgaacccggtaacccgggtacccccgtaccggtttaccccgggtacccccgttttccccccggaaccggggttccccgaacccccttcccggg

SEQ ID NO: 22834 - DNA, 717 bp, Homo sapiens
  misc_feature: GYAE6OF02GE67U.12.40.D07.1.454.CMB.1.raw
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
tcagatacgacgtacacgaccggtgctcgatttagtgatagagcgtaacaacagagggctcaccatggagtttgggctgagcttgggttttcctcgttgcttcttttaagaggtgtccagtgtcgaggggcaccgtggtggagtcgtgggggagccggtggtccagccgtgggccggtccctgacactcgcctgtgttgcctctggtactttcccttactaatttctattccatcgctacgtcgggtcccnccgaggcctccgaggcgaaggggcctacggaggtggggnggctacgtttagtcgcacatgagtggcgtacaaactaattcaacgactaaacgttccggaggacggggcctattccgaactacttcctaccaggaacgtaactaaacgttacaaacgtaacccttaccctttatcgtacgaactaaagtacgaacacgtacctaggacgaaccgacgaacgacgacggtactagtacttatttagtacggcgtacgagaacgacgaaccaacgaaccgtaaccctagaccgtaacctaaacgttacgtagggtcggggttctttcgggttaccggtcggggtacccgaacggggtcccgtgggtacctacgttcccgtacccgtaccccggacgtacccctacccgaaccggtaccggtccctacggttcccgttaccccgttccccggtcggtcccctccgtcccg

SEQ ID NO: 22835 - DNA, 778 bp, Homo sapiens
  misc_feature: GYAE6OF02FGSG0.12.40.D07.1.454.CMB.1.raw
  modified_base (209)..(209): a, c, t, g, unknown or other
  misc_feature (209)..(209): n is a, c, g, or t
tcagatacgacgtacacgaccggtgctcgatttagtgatagagcgtaacaacagagggctcaccatggagtttgggctgagctgggttttcctcgttgctctttaagaggtgtccagtgtcaggggcacctggtggagtctgggggagccgtggtccagcctgggcggtccctgacactcgcctgtgtcgcctcgtggtactttccctnaatttctattccagtgccacgtcgggtccaccaggtcctccgaggaccgaagggggtcctcggtaggtggggtggcctactttagtgcacgatggtagtgggcctacaaactaattcacgactaaacgttccggaggacgggggtcctattccgaacctatcccgtaccgaaggacgaaacctaaattaaccgaaacggtaacccttacccttttagccttacggaacaaaattacggaacacgtcccgtaggaacaacccgaggaccgaaccgaaccgggtctacgtacgttaacgtttaagttcggaccgtaccggtaagacggaacgaccaaccgtaaacctaaacccgttacgtaccgggtaacctaaacgtaaccgttaggtacggggggttactttacgggtttaccgggtccgggggtaccggtaaccggggtacccttcgggtaccttacgttccggtacccctcccgtaaccgtccccgtaccccgaaccggtaaccgggaccccttacggttcccggtttcccccgttacccccggtcgggtccccgtccccgtaccgg

SEQ ID NO: 22836 - DNA, 580 bp, Homo sapiens
  misc_feature: GYAE6OF02H0THB.12.40.D07.1.454.CMB.1.raw
  modified_base (314)..(314): a, c, t, g, unknown or other
  misc_feature (314)..(314): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggctacttatgcacatgatggcgtacaactaaattcacgctaaattccgnggacggggccattcaccatctccagagacaattacaagaacctaccctttatctagactaaagtagacagcctgacgaccaggacgacacggctagtctattagtgcgcgagagagacacacgacctactagccaatactagtgggcgttgttcgtcgggtaccgacgggtacccgtggtacgagttccgtcctcccgacgtccacccgtacccgaacggtcccgacgttcccggtccctttaccccgtccggtcccgccctccgg

SEQ ID NO: 22837 - DNA, 596 bp, Homo sapiens
  misc_feature: GYAE6OF02ISJVV.12.40.D07.1.454.CMB.1.raw
  modified_base (535)..(535): a, c, t, g, unknown or other
  misc_feature (535)..(535): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtatttcccttcaatttctattccatgcactgggtccgccacggctccaggcgaaggggctcgaggtgggtggcacttatgcacatgatggcgtcaacaaattctacgacaaattccgtggaggggccgattcaccatctcagagacaattaacaagaacctaccttatactgactaaatagacagactgagaccagacgacacggctagtctaattattgcgcggaagagacgacgaacacgaaccctacgtacggaccaactacgtagtacggggtctttcgttcggtcggggaccgtacggggtacccgttggtctagtccgtcctacccccgngtacccctccaacccgacggcccacgttccggttacccttccccgtcggtcccgtccctcg

SEQ ID NO: 22838 - DNA, 820 bp, Homo sapiens
  misc_feature: GYAE6OF02IIIY3.12.40.D07.1.454.CMB.1.raw
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttnaattttctattccatgcactgggtccncaggctccaggcaaggggctcgaggtgggtgctacttattgacacatgatgggcgtacaactaaattctaacgctaaaactttcccggtagggtacgggggaccctatttaccgaccctattcctacccgaaggaacgaaactaaacttaacgaaacgtaaccttaaccccgtttaatcctacgactaaaagtacggaacctaggtaccctagaaacgaaccctaaggaacccgaacgaaccgggtcttacggttacctttaagttaacgttggacccggtaggaacggaacggaacggaaccctaaccgaacccgtaaacccgttaccgttacgggacccaaaattacgttaacgggttacggggggttccttttacgggttccgggtacggggggtaccccgtaaccggggggttacccccttacgggtacccgttacgttaccccgggttcccctacccccgtacgggtaccccccttaaccccggaacccggtaaacccgggtcccccttaacggtttaccccgggtttacccccctttacccccccggggttacggtccccccgtcccccggttacccgg

SEQ ID NO: 22839 - DNA, 581 bp, Homo sapiens
  misc_feature: GYAE6OF02IMYAT.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgcaggctccaggcaaggggctcgagtgggtggcacttattgcacatgatggcgtcaacaaattctaacgcaaattccgtgaggggccattcaccatctccagagacaattacaagaaacctaccctttaatctagacaaaatagacagcctgaagaccagacgacacggctgtctattattgcgcgagagagacaacacgaacctacgtcgaccaatactagtgggggtctttgttcgtcggggccgaggggacccgtggtcagtcgtcctacccgacgtccctaccgaacccgaacgggaccccacgttccggttacccttcccccgtcggtcccgcccgtaccgg

SEQ ID NO: 22840 - DNA, 644 bp, Homo sapiens
  misc_feature: GYAE6OF02I36RE.12.40.D07.1.454.CMB.1.raw
  modified_base (149)..(149): a, c, t, g, unknown or other
  misc_feature (149)..(149): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (408)..(408): a, c, t, g, unknown or other
  misc_feature (408)..(408): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcggtccctgacactcgcctgtgttgcctcnggactttccctnaatttctattccatgcactgggtccgccaggcctccgaggcaaggggctcggaggtggggtgctactttagttgacacattgattggcgttacaaactaaatttcaaccgactaaaagtttcccggtggaacggggcccaatttccaaccattaccctaccgaagtacgaacctaattacgaaagaacctaccctttaanctagactaaaatgaactagcctagacgacctagaccgacacggctgtactattatgacgcgagagagacactacgaactacacgaccaagtactacggtaggggtccttagttccgacgggtaccgaacggggtacccgtaggtactagtcccgttacctccccgtaaggccctacccgtaaccgaccgggtacccacggttcccgtcccgtttaccccgcggtccccgcctccgg

SEQ ID NO: 22841 - DNA, 784 bp, Homo sapiens
  misc_feature: GYAE6OF02GUH74.12.40.D07.1.454.CMB.1.raw
  modified_base (153)..(153): a, c, t, g, unknown or other
  misc_feature (153)..(153): n is a, c, g, or t
  modified_base (239)..(239): a, c, t, g, unknown or other
  misc_feature (239)..(239): n is a, c, g, or t
tcagatacgacgtacacgaccggtgctcgatttagtgatagagcgtaacaacagagggctcaccatggagtttgggctgagcgtgggttttcctcgttaggctcttttaagaggtgtccagtgtcaggggcacctggtggagtctgggggganccgtggtccagcctggggcggtccctgacactcgcctgtgttgcctctggatttcccttcaatttctattccatgcactgggtccnccaggctccaggcaggggctcggagtgggtgcactttatgacacatgatggactcaactaaattctacgactaattcccggaggacggggccaattccacctatcctaccaggacaactaagttaacaagaaaccctttacccgtttatactaggaacctaaaagtacgaacaacggtcctaagaacggaacccacggaaaccgtaaccgtaaccgggtacgttacggtttaactttaaacgtttaacggtttcggacggtacggtaaagggtaacggaacggaaacctaaccgaaacccggttaaaacccgttaccgtaaccgggtaaacccttaaaacgtaaccgttaacgggggttacgggggttacggttttacggttaccgggtacgggggtacccggtaaccgggggtacccgttacggtacgtaccgttccggtacccgtaccccgtacgtaccccgttacccgaacccggtaacccgggtacccgtacggttacccgggtttccccttaccccgggtcggtacccgtcccgtaccgg

SEQ ID NO: 22842 - DNA, 684 bp, Homo sapiens
  misc_feature: GYAE6OF02I86QR.12.40.D07.1.454.CMB.1.raw
  modified_base (177)..(177): a, c, t, g, unknown or other
  misc_feature (177)..(177): n is a, c, g, or t
  modified_base (235)..(235): a, c, t, g, unknown or other
  misc_feature (235)..(235): n is a, c, g, or t
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (396)..(396): a, c, t, g, unknown or other
  misc_feature (396)..(396): n is a, c, g, or t
  modified_base (538)..(538): a, c, t, g, unknown or other
  misc_feature (538)..(538): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtgatccagcctgggcggtcctgacnctcgcctgtgttgcctctggatttcccttctaattttctattccatgcactgggtccncaggctccaggcaaggggctcgagtggggtgctacttattgctacagtgacttggcgtacaaactaaattctacgcaaatttcccggnggaaggggcctaattccaacntcctcagganacaattacaaanaaccgtaccctttatctagaccaaaagtanaccagtccctagaacgacccaaggaccgacacggtacctgttactatttagttcgcggacaggaagacgaaccgtaacgaaccgtaacctacgttacggaccaaacttacgtaacgtcgggggtaccttacggtttaccggngggggtaacccgacggggtaaccctcgggtaccgtacgttaccgtacccgtaaccccgacggttcccttaccccgtaacccggaacggggtccccctaagttccccgggttaaccccgttcccccggtacgggtcccccgtcccgg

SEQ ID NO: 22843 - DNA, 997 bp, Homo sapiens
  misc_feature: GYAE6OF02H07QC.12.40.D07.1.454.CMB.1.raw
  modified_base (236)..(236): a, c, t, g, unknown or other
  misc_feature (236)..(236): n is a, c, g, or t
  modified_base (282)..(282): a, c, t, g, unknown or other
  misc_feature (282)..(282): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtgggggagccgtggtccagcctgggcggtccctgacactcgcctgtgttgcctctggatttcccttcaatttctattccatgcactgggtccnccaggctccaggcaaggggctcggaggtgggtggctacttatgcanatgatggctacaaacaaattccaacgacctaaaagtttcccgagggtacgggggaccctatttaccaacccgtaattccctacccgaaggaacgtaaacctaaacttaaaccgaaacggtaaaaccctacccccgtttttaatacccgttagaaaccctaaaaagttaacggaaacctaaccgggtaccccgtttaaggaaaaccgggtaaaccccgaaacgggttaaaccccggaaacccggtaaccggggtacccgtttacgggtttaacctttttaaacgttttaacgtttaccggggaccgggtaaccggggtaaacggaacgggtaaaccgggaaaccgtaaacccggtaaacccggtaaaaccccgttaaccggttaaccggggaaacccctaaaacggtttaaaccggttaacggggtttaaccggggggggttacccgtttttaccggggtttaccgggttaccgggggggtacccccgggtaacccggggggggttaaccccgttacggggtttaccgtaaacccgggtttccccggttaacccccggttaccccccggaaccggttaccccccggtaaccccggtaaaccccccgggtaaaaccccggggttccccccgttaaaccgggtttccccccggggtttaccccgttttacccccccccggggtaccgggtccccccgggttaccccccgttccccggg

SEQ ID NO: 22844 - DNA, 622 bp, Homo sapiens
  misc_feature: GYAE6OF02GOOHI.12.40.D07.1.454.CMB.1.raw
  modified_base (235)..(235): a, c, t, g, unknown or other
  misc_feature (235)..(235): n is a, c, g, or t
  modified_base (459)..(459): a, c, t, g, unknown or other
  misc_feature (459)..(459): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccncaggctccaggcaaggggctcggagtgggtgcacttatgcacatgatggcgtacaaactaaattcctacgactaaacgttcccggtaggacggggggccctaagtttccaaccattcctacccgaagacgaactaaattacaaacgtaacctaccctttatctagacaaatagaacacgcctagacgaccagacgacacgctgtctattagtgcgacgagaganacacacgaacctacgtcgactaatacgtagtgggggtctttcggttcgttcgggtccgtacggggtaccctcggtcacgttccgtcctaccccgacgtccctacccgaaccgtaaccgggccctacgtccggttcccgttccccgtcggtcccgtcccgtccg

SEQ ID NO: 22845 - DNA, 586 bp, Homo sapiens
  misc_feature: GYAE6OF02HOCES.12.40.D07.1.454.CMB.1.raw
  modified_base (236)..(236): a, c, t, g, unknown or other
  misc_feature (236)..(236): n is a, c, g, or t
  modified_base (369)..(369): a, c, t, g, unknown or other
  misc_feature (369)..(369): n is a, c, g, or t
  modified_base (446)..(446): a, c, t, g, unknown or other
  misc_feature (446)..(446): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaattttctattccatgcactgggtccnccaggctccaggcaaggggctcgagtgggtggcactttatgcacatgatggctcaacaaattctacgacaaattccggtggacggggccattccaccatcctccagagacaattacaagaacctaccctttanctagacaaatagaacagcctagacgaccagacgacacggctgtactattatgcgcgagagagacacacgaacctacncggaccaatacgtagtaggggtcttggtcgtcggggccgaggggtaccctggtcagttccgtcctccccgacgtccctacccgaaccgaaccgggccctacgtcccggttcccgttacccccgtcggcccgtcccgtcgg

SEQ ID NO: 22846 - DNA, 589 bp, Homo sapiens
  misc_feature: GYAE6OF02HMZ9X.12.40.D07.1.454.CMB.1.raw
  modified_base (352)..(352): a, c, t, g, unknown or other
  misc_feature (352)..(352): n is a, c, g, or t
  modified_base (382)..(382): a, c, t, g, unknown or other
  misc_feature (382)..(382): n is a, c, g, or t
  modified_base (432)..(432): a, c, t, g, unknown or other
  misc_feature (432)..(432): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtcccgtgacactcgactgtgttgcctctggatttcccttcaatttctattccatgcactgggtccgccaggctccgaggcgaaggggctcggaggtggggtgctacttattgcacatgatggcgtcaaacaaattctaacgacaaactttccggtaggagggggcccgattccgaccatccnccagagacaattacaagaacctacccttanctgacaaatagacaacctgacgaccagacgacacgctgtctattatgcgngagagagacacaaccgacctacgtcgacaatactagtcggggtcttgtcgcggggccgaggggaccctggtcacgtccgtcctaccccgacgtcccgtcccaccgacggccctacgttccggttcccttccccgtcggcccgtccccgtcgtacccg

SEQ ID NO: 22847 - DNA, 576 bp, Homo sapiens
  misc_feature: GYAE6OF02JJBEA.12.40.D07.1.454.CMB.1.raw
  modified_base (234)..(234): a, c, t, g, unknown or other
  misc_feature (234)..(234): n is a, c, g, or t
  modified_base (377)..(377): a, c, t, g, unknown or other
  misc_feature (377)..(377): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaacaattctacgcaaattccgtgagggccattcacatctcagagacaattacaagaacctaccctttatctgacaaatagacagcctganaccagacgacacggctgtctattattgcgcgagagagacacacgaacctactggaccaatactaagtggggcttgttcgtcggggccaggggtaccctgggtacacgtcgtccgtccccgagtcccctaccgaacccgaacgggccccgtaacgttcccgggttaccctttcccccggtcgggtacccgtccccgtcgg

SEQ ID NO: 22848 - DNA, 565 bp, Homo sapiens
  misc_feature: GYAE6OF02GKHY2.12.40.D07.1.454.CMB.1.raw
  modified_base (289)..(289): a, c, t, g, unknown or other
  misc_feature (289)..(289): n is a, c, g, or t
  modified_base (361)..(361): a, c, t, g, unknown or other
  misc_feature (361)..(361): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtgcacttatgcacatgatggcgtanaacaaattctacgctaaattccgtgacggggccattcacatctccagagacaattacaagaacaccctttanctagactaaatagacagcctagagaccagacgacacggctgtctattatgcgacgagagagacacacgaacctactgaccaatacgtagtggggtcttgttcgtggggaccgaggggtaccctggtactatccgtcctaccccgagtcccgtaccaaccgtacggaccctacgtccggttcccttcccccgtggcccgccctcg

SEQ ID NO: 22849 - DNA, 595 bp, Homo sapiens
  misc_feature: GYAE6OF02GCA6S.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcggagtgggtggcacttattgcacatgatggcgtacaacaaattctacgactaaattccggtgacgggggccattcacctatcctccagagactaattacaagtaactaccctttatctagacaaatacgacagcctagacgaccagacgacgacgctgtactattatgcgacgagagacgacacactaacctacgtgaccaatactagtggggtcttgttcgtcgggtaccgacgggtacccgtggtcctacgttaccgtcctaccccgcgtccctacccgaacccgaaccgggccctacgttcccggtcccttcccccgtcggcccgtccccgtccg

SEQ ID NO: 22850 - DNA, 606 bp, Homo sapiens
  misc_feature: GYAE6OF02HDW6Q.12.40.D07.1.454.CMB.1.raw
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtacaacaaattctacacaaattccgtgaggggccattcaccatcncagngacaattacaagaacaccctttaanctgacaaatagaacagcctagacgaccagaccgacacggctgtctaattacttgcgcgagacgagaccacaacgaacctacgtagcctaaatacgtaagtgggggtctttacgttcggtcgggggacccgtaagggggcccttagggtctaacgttccgtcccgtaccccgacgtcccgtaccgaacccgaacgggcccctagttcccggttacccttccccccgtacgggtcccgcccgtccgg

SEQ ID NO: 22851 - DNA, 629 bp, Homo sapiens
  misc_feature: GYAE6OF02F382R.12.40.D07.1.454.CMB.1.raw
  modified_base (235)..(235): a, c, t, g, unknown or other
  misc_feature (235)..(235): n is a, c, g, or t
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtgctacttatgcacatgatggctcaaacaattcacgacaaattccgnggacggggccattcaccatctccagacgaactaattaacaagtaacctaacccttttancttagacaaagtacgacacgccctagaacgacccgagacgacacggctgtactaattattgcgcgagagacgaccaacaacgaacctacgtcggaccaatacgtagtcgggggtactttggttaccgtggggacccgacggggacccttgggtacctagttccgtcccgtaccccgaacgtcccctacccgaacccggtaaccgggacccctacgttcccggttcccttaccccccggtggtccccgtaccccgtccgg

SEQ ID NO: 22852 - DNA, 606 bp, Homo sapiens
  misc_feature: GYAE6OF02GNQWE.12.40.D07.1.454.CMB.1.raw
  modified_base (209)..(209): a, c, t, g, unknown or other
  misc_feature (209)..(209): n is a, c, g, or t
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttnaatttctattccatgcacgtgggtccgccaggctccgaggcaaggggctcggagtcgggtcggcacttattgcacatgatcggcgtcaacaattctacgcaaattccggtgacggggccattccaacatcctccaganacaattacaagtaactacccttanctgaccaaatagacagctagagaccagacgacacggactgtactattatgcgtacgagagagacacacgaacctactggacctaatactagtacggggtctttggttcgtcggggccgaacggggtacccgtagggtccagtaccgtccctcccgacgtccctacccgaaccgaaccgggtccccgtaacgttcccggttccccgttcccccgtcgggtccccgtccccgtccgg

SEQ ID NO: 22853 - DNA, 587 bp, Homo sapiens
  misc_feature: GYAE6OF02FX9EP.12.40.D07.1.454.CMB.1.raw
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
tcagatacgacgtacacgaccggtgctcgatttagtgatagagcgtaacaacagagggctcaccatggagtttgggctgagctgggtttcctcgttgctcttttaagaggtgtccagtgtcaggggcacctggtggagtctgggggagccgtggtccagcctgggcggtccctgacactcgcctgtgttgccttctggactttcccttnaattttctattccatgcactgggtccncaggctccaggcaagggctcgagtgggngcacttatgcacatgatggcgtcaacaattctaacgactaaattccggtggacggggccattccacatcctccagagacaattacaagaactaccttatctgacaaatacgacacgactgacgaccgagacgacacggctgtactattatgcgacgagaggagacaacaccgaacctactcgactaacgtacgtagtacgggtcgtttcgtcggtcgggaccgacgggtacccgtgtaccgtctccgtacctcccgtaacgccttaccgaccgtaccggacccgtacgtccggttcccgttccccgtccggtccgcccgtccg

SEQ ID NO: 22854 - DNA, 843 bp, Homo sapiens
  misc_feature: GYAE6OF02JUFMT.12.40.D07.1.454.CMB.1.raw
  modified_base (151)..(151): a, c, t, g, unknown or other
  misc_feature (151)..(151): n is a, c, g, or t
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
  modified_base (403)..(403): a, c, t, g, unknown or other
  misc_feature (403)..(403): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggganccgtggtccagcccgtgggcggtccctgacactcgcctgtgttgcctcgtggacttttcccttcaattttctattccatcgcactgggtccnccaggcctccgaggcaggggctcggaggtgggtgctacttatgcanatgatggctacaataattcaacgactaaattccggtggacgggtccagtttccaccgtatcctaccgaaggaacgtactaaaattaaccgaaacgtaaacccttaccttttaanacgttacgtaaacaaaagttacggaacctaggtacccgtaaggaaaccgaacccgaacggtaacccgaaaccgacggtaccgttacggtacctttaacgtttaacggttacggtacggaacggttaacgggaacggaaacgtaacccgaaaccgtaaacccggtaaacccgtaaaccggtcggtaaaccctaaacggttaacgttacgggtacggggttaccttttacggggttaccgggttaccgggggttaacccgggaaccggggttacccggttacgggtacccgtaacgttccccggttacccgttacccccggtacggtacccccgtacccggttaaccccggaaacccggggttaccccttaaccccgggttaccccggttacccccggtttacccccggtacccgggtaccccggttccccgttaccccggg

SEQ ID NO: 22855 - DNA, 720 bp, Homo sapiens
  misc_feature: GYAE6OF02J1WGC.12.40.D07.1.454.CMB.1.raw
  modified_base (243)..(243): a, c, t, g, unknown or other
  misc_feature (243)..(243): n is a, c, g, or t
  modified_base (429)..(429): a, c, t, g, unknown or other
  misc_feature (429)..(429): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctcgtggtacttttcccttcaattttctattccattgccacgtgggtccncccaggcctccagggcgaaggggctcggaggtggggtgctacttatgcactagtgagtggcgtacaaacgtaaattcctaacggactaaacgttcccggtaggaacggggtccctaatttcccgaaccacttcctaccaggaacgtaacctaaagttaaccaaaggaaacccttacccgttttaancgttaacgacaaagttacgacaacgtcctagacgaacccaagaccggacgaccggtctagttacttacgttacgttcggaccgtcgaaggagaacgaaccaaccgaacgtaccctagtcgaacctaacgtacgtaggtacggggcttttcggtacggtccgggaccgtaccggggtaccctagggtcgtaccgtccgtcccgttacccgccgtccgtacccaacccgggtaaccgacccgttaccgttacccggttccccgttaccccggtcggtaccccgtcccgtccgg

SEQ ID NO: 22856 - DNA, 778 bp, Homo sapiens
  misc_feature: GYAE6OF02IAKVN.12.40.D07.1.454.CMB.1.raw
  modified_base (234)..(234): a, c, t, g, unknown or other
  misc_feature (234)..(234): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaaactaaattctaacgctaaaactttcccggtaggacgggggcccgtatttccaaccgtatccgtacccaaggacgaacaaatttaaccaaagaaacctaaccccgttttaatccgttagactaaaagtaggaacctaggacccttaggaaccgacccaaggaaacccggaaccgtaccgggaccttcggtaacctttactttaacgtttcgacggtacgaaggtagaacggaacaacgaacccgtaaaccctaccgtacggaaccctaaagttaactaacggttacggggggtacttttacgggttccgtcggggggtacccgaaaccggggggtaccccggttacgggtaccgtaacgttcccggttacccctacccccggtaacgtacccccgttacccgtaaccccggtaaaccgggtaccccgtaacggttccccgggttacccccgtttccccccgggttcgggcccccggttaccccgtcccgg

SEQ ID NO: 22857 - DNA, 595 bp, Homo sapiens
  misc_feature: GYAE6OF02HXTZK.12.40.D07.1.454.CMB.1.raw
  modified_base (235)..(235): a, c, t, g, unknown or other
  misc_feature (235)..(235): n is a, c, g, or t
  modified_base (266)..(266): a, c, t, g, unknown or other
  misc_feature (266)..(266): n is a, c, g, or t
  modified_base (383)..(383): a, c, t, g, unknown or other
  misc_feature (383)..(383): n is a, c, g, or t
  modified_base (444)..(444): a, c, t, g, unknown or other
  misc_feature (444)..(444): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcggagtgggnggcacttattgcaacatgatggcgtacaaacaaattctaacgactaaattccggtggacggggccgtattccaaccatcctaccaagagacaaattacaaagaaacctaccctttanctagacaaaatagacagcctagacgaccagacgacacggctgtctatatgcgacgagaganacacacgaactacacgacaagtactagtcggggtcttagttcgtcgggccgacggggtacctggtacacgttccgtacctacccgacgccctaccgaaccggaccggaccctacggtccggttcccgttaccccgtcggtcccgcccgtcg

SEQ ID NO: 22858 - DNA, 629 bp, Homo sapiens
  misc_feature: GYAE6OF02IUNFH.12.40.D07.1.454.CMB.1.raw
  modified_base (208)..(208): a, c, t, g, unknown or other
  misc_feature (208)..(208): n is a, c, g, or t
  modified_base (328)..(328): a, c, t, g, unknown or other
  misc_feature (328)..(328): n is a, c, g, or t
  modified_base (354)..(354): a, c, t, g, unknown or other
  misc_feature (354)..(354): n is a, c, g, or t
  modified_base (486)..(486): a, c, t, g, unknown or other
  misc_feature (486)..(486): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttntaatttctattccatgcactgggtccgccaggcctccgagggcgaagggggcctcggaggtggggtcggcacttattgcacatgatggcgtacaaacaaattctacgacaaacttccggnggacggggccattcaccatctccaanagacaattacaagaacctaccttaatctagactaaatacgactacgaccgtgaagaccgagaacgaacgacgggacttacgtacttaatttagttcggcgacgacgtagaacgaccaacgtacgaaaccctntacggaccaaatacgtagtggggtacttgttcggacgggccgtaaggggcccttggacctagtccgtcctaccccgcgtaccctccgaacccgtaacgggccctacgtaccggtttccctcccccgtcggcccgtccctaccg

SEQ ID NO: 22859 - DNA, 789 bp, Homo sapiens
  misc_feature: GYAE6OF02I30A8.12.40.D07.1.454.CMB.1.raw
  modified_base (148)..(148): a, c, t, g, unknown or other
  misc_feature (148)..(148): n is a, c, g, or t
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (279)..(279): a, c, t, g, unknown or other
  misc_feature (279)..(279): n is a, c, g, or t
tcagatacgacgtacacgaccggtgctcgatttagtgatagagcgtaacaacagaggactcaccatggagtttgggctgagctgggtttcctcgttgctcttttaagaggtgtccagtgtcaggggcacctggtggagtctggggganccgtggtccagcctgggcgtccctgacactcgcctgtgttgcctctggatttccctnaatttctattccatgcacgtgggtccncaggctccgaggcaaggggctcggagtcgggtgactacgttatgcanatgagtggactacaaactaaattcctaacgactaaacttcccggtaggaacggggtccctattaccgacctatcgtaccagaacgtaactaaacttacgaaacgtaaacctacccttttaatccgtagaaactaaatacggaacctaggtacccttaggaacgaaccctaagaacccgagtaaccggtactacggttacttaagtttacgttacggccggacgtaaggaacgtagaaccgtaacgaaccggtaacctaccgtacgtaaccctaaagtacgttaacggtcgggggttaccttttacgggttacccggtacggggtacccggtaacggggttaccccgtaggggttaccctacggttacccggttacccctaccccggttaccgtaaccccgttacccgaaacccgggtaaaccgggttaccccccgttaaccggttacccccgggttttccccgttaacccccccgggtccggggtaccccggttacccccgttacccggg

SEQ ID NO: 22860 - DNA, 769 bp, Homo sapiens
  misc_feature: GYAE6OF02IH8O5.12.40.D07.1.454.CMB.1.raw
tcagatacgacgtacacgaccggtgctcgatttagtgatagagcgtaacaacagagggctcaccatggagtttgggctgagcgtgggttttccgtcgttgctcttttaagaggtgtccagtgtcaggggcacctggtggaggtcgtgggggagccgtggtccagcccgtgggccggtccctgacactcgcctgtgttgcctcgtggtactttcccttctaatttccttattccatgctcgtgggtccgccgaggctccgaggccgaaggggctcggagtcggggtagcgtacttagttgacgactatgtagtcggtccgtacaaacgtaattccgtaacgacgtaaacgttccgtcgggaacggggtccctattacccaccgacttccgtccgaagtacgaaaccttaattaacgaaacgtaaccctacccgtttacacgtacgaacgtaaactacggaaccgtacgaccgtacggaaccgtacccgagaaccgtaaccggacggttacctgttacccttagttacgtcgacgttacggaagacgtacgaaccgactaaccgtaacccgtacgacggtacctaacgttacgtacgggttacgggtacgttttccggttcgggtaacgggcccgggttaaacgggtccccggttaggtccgtacgttcccggttacccgtaccccggtaacgtccccgaccgtaacccggacccggtacccgtcgttaccccggtcccgtttccccggaccggttcccccaccggtcccg

SEQ ID NO: 22861 - DNA, 571 bp, Homo sapiens
  misc_feature: GYAE6OF02GCUWH.12.40.D07.1.454.CMB.1.raw
  modified_base (233)..(233): a, c, t, g, unknown or other
  misc_feature (233)..(233): n is a, c, g, or t
  modified_base (330)..(330): a, c, t, g, unknown or other
  misc_feature (330)..(330): n is a, c, g, or t
  modified_base (377)..(377): a, c, t, g, unknown or other
  misc_feature (377)..(377): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttccttcaatttctattccatgcactgggtccncaggctccgaggcaaggggctcgagtgggtgcacttatgcacatgatggcgtacaacaattctaacgctaaattccgtgacggggcattcaccatcncagagacaatacaagaactacccttatctagacaaatagacagctanacgaccagacgacacggtctgtactattagtgcgcgagagagacacacgaacctacgacgaccaagtactaggtagggtcgttgttcggtcggggtccggacgggtccgtcgtacgtcgtccgtcctccccgacgtccctaccgaacccgacggcccacgttccgttacccttccccgtcggccgtccccgtcg

SEQ ID NO: 22862 - DNA, 551 bp, Homo sapiens
  misc_feature: GYAE6OF02GYJ57.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacgagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactgccaatactagtgggggtcttgttcgtggggccaggggaccctggtcagtcgtctccccgagccctaccaccgaacgggcccacgtccggtccttcccccgtggtcccgtccctccgg

SEQ ID NO: 22863 - DNA, 579 bp, Homo sapiens
  misc_feature: GYAE6OF02HJYAL.12.40.D07.1.454.CMB.1.raw
  modified_base (236)..(236): a, c, t, g, unknown or other
  misc_feature (236)..(236): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcacgtgggtccnccaggctccaggcaaggggctcggagtgggtgcacttatgcacatgatggctacaaactaaattctaacgacaaattcccggtggacgggggcctagttccaaccatcctaccaagagacaattacaagaaacctaccctttatctgactaaatagacagcctagacgaccagacgacgacggctgtactatattgcgcgagagagacacacgaacctacgtacgaccaatactagtcggggtcttgttcgtggtcgaccgacgggacctcggtctacgtccgtccgtcccacgccctaccgaccgacggcccacgtccgtcccttccccgtcggccctcccg

SEQ ID NO: 22864 - DNA, 987 bp, Homo sapiens
  misc_feature: GYAE6OF02I0PBP.12.40.D07.1.454.CMB.1.raw
  modified_base (279)..(279): a, c, t, g, unknown or other
  misc_feature (279)..(279): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcacgtgggtccgccaggctccaggcaaggggctcgagtgggtgcacttattgcanatgatggcgtacaactaaaattcctaacgactaaaacgttcccggttagggaacggggggcccgtaagtttaccaaccccatttcctacccgaaggtaacgaacctaaaatttaaaccgaaaacggtaaacccttaacccccttttaatacccgttagaaacctaaaaattaacgggaaacctaacggtacccgttacggaaaccggtaaacccccgaagggaaacccggtaaaccgtaaccccgggggtacctttacggtttaacccgttttaaagtttttaacgttttaccgggaccggtaaccggggaaacgggaaacgggtaaacggaaacccgaaaccgtaaaccccgggtaaaacccccgttaaccgttaaacccggggaacccctaaaacggtttaaaccggttaacgggtttacggggggggttaccgtttttaccggggtttttacccggggtaccggggggggttaaccccgggtaaccggggggggttaccccgtttaacgggggtttacccgttaaccggtttccccgggtttaccccgttaccccccccggtaaccgggtaccccccgtttaacccccggaaaccccgggtaacccgggggtaccccccgttaacccggtttcccccggggtttaccccccgttttcccccccccggttaccggggtacccccgggttcccccccggttccccgg

SEQ ID NO: 22865 - DNA, 557 bp, Homo sapiens
  misc_feature: GYAE6OF02ILMD8.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtcccgccaggctccaggcaaggggctcgagtgggtggcacttattgcacatgatggcgtcaacaaattctacgcaaattccgtgaggggccgattcaccatctccagagacaattacaagaacacccttatctgacaaatagacagcctgagaccagacgacacggctgtctattattgcgcgagagagacacacgaacctactagccaatactagtgggggtacttgttcgtcggggccacggggaccctggtcgtatcgtcctcccgacgtccctaccaaccgacggacccacgttccggtcctcccccgtggccgtcccgtcgg

SEQ ID NO: 22866 - DNA, 591 bp, Homo sapiens
  misc_feature: GYAE6OF02JY6AY.12.40.D07.1.454.CMB.1.raw
  modified_base (293)..(293): a, c, t, g, unknown or other
  misc_feature (293)..(293): n is a, c, g, or t
  modified_base (443)..(443): a, c, t, g, unknown or other
  misc_feature (443)..(443): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtacaanaaattcacgcaaattccgtgaggggccgattcaccatcctccagacgacaattacaagaacctaccctttatctgacaaatacgacagacctgaagaccagacgacacgctgtactatattgcgacgagagagacacaccgaacctacgngaccaatactagtcggggacttgttcgtaggggtccgacggggtaccctagggtcacgtaccgtcctaccccgcgtcccgtacccaacccgacggtacccgacgtttacccggtccgtttcccccgtaggttccccgtacccgtccgg

SEQ ID NO: 22867 - DNA, 615 bp, Homo sapiens
  misc_feature: GYAE6OF02HSJ04.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttccctctaatttctattccatgcactgggtccgccaggctccaggcaaggggctcgagtgggtgcacttatgcacatgatggctacaacaaattcacgcaaacttccgtaggaggggccattcaccatcctccagacgacaattacaaagaacctaccgtttatctagacaaaattagaactcgacctagaacgaccagaccgacacggctgtctatatgcgcgagagagacacgacgaacctacgcgacaatacgtagtcgggggtacttcggttcgtcggggtaccgacgggggtaccctagggtacacgttcccgtccgtaccccgacgtccccgtacctacccggaaccgggtccctaacggttcccgggttcccctttacccccggtcgggtaccccgtcccgtaccgg

SEQ ID NO: 22868 - DNA, 602 bp, Homo sapiens
  misc_feature: GYAE6OF02GIM5V.12.40.D07.1.454.CMB.1.raw
  modified_base (343)..(343): a, c, t, g, unknown or other
  misc_feature (343)..(343): n is a, c, g, or t
  modified_base (459)..(459): a, c, t, g, unknown or other
  misc_feature (459)..(459): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtatttcccttctaatttctattccatgcactgggtccgccaggcctccgaggcgaagggggctcgaggtgggtggcacttattgcacatgatgggcgtacaacaaattctaacgacaaattccgtgaggggccagttcaccatcncagagacaattaacaagaactaccctttatctagacaaatacgacacgcctagacgaaccagaacgacacggctagtactattagttgcgtcgagagacgacacgacgaacctacncggaccaaatactagtggggtctttggttccgtacggggccgacggggtacccgtacggtcgactccgtcctacccgcggccctacccgacccgaacggtcccacggttccggtcccgttacccccgtcggtccgccctccgg

SEQ ID NO: 22869 - DNA, 730 bp, Homo sapiens
  misc_feature: GYAE6OF02IB3NS.12.40.D07.1.454.CMB.1.raw
  modified_base (411)..(411): a, c, t, g, unknown or other
  misc_feature (411)..(411): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctctggatttcccttctaatttctattccatgcacgtgggtccgcaggctccgaggcgaagggctcggagtggggtgctacttagtgcacatgactggacgtacaaactaaattcctaacgactaaaacgttccggtgggaacggggccctattaccaccacttcctaccgaagtaacgaactaaattaccgaaaagtaaccctaacccgttttaanccgtagaactaaacgtagaaacctcgtaccctagaaacgtacccgaaggaccgtaaccgaccggtctacgttaccgtaatttacgttcggaccgtacggaagaagaacgaaccgtaacctaaaccgaaccctttaacgaccggtaaaccaaacgttaccgttaacgggttcgggggtacttttacggtccggtacggggacccgaccgggggtaaccctgggtacctacgtccgtaccctccccgaacgtcccctaaccgaccggtaccggtccctaacggtcccggttcccttacccccggtggtcccgtcccgtccg

SEQ ID NO: 22870 - DNA, 933 bp, Homo sapiens
  misc_feature: GYAE6OF02G0ZWR.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtgatccagcctgggcggtccctgacactcgcctgtgttgcctctggatttcccttctaatttctattccatgcacgtgggtccgccgaggctccaggcaaggggctcggagtgggtgcacttattgcacatgagtggacgtacaaactaaattcgtaacgactaaaagtttcccggtagggaacgggggtccctaatttaccgaaccctaagttcccgtacccgaaggaacgtaacctaaaagttaaccaaaacggtaaaccctaaaccccttttaattcctaacggtacctaaaaaacgttacgtaaaccgaacggtcccgttagggaaaccggaaacccctaaaggggaaaccccggaaaccggtaacccgggtactttacgggtttaacctttaaagttttacggtttacgggaccgggtaacgggaacggtaaaacgggaaccggtaaaccgaaacccgtaaaccccgggtaaaaaccctttacccgggtaacggtaaaccccgtaaaacgtttaaacccggttaacggggtttaccgggggggtacctttttacggggttttaccggttagggggttccgggtaccccgggttaaaccgggggggttacccccgttgggggttacccgtacggtttaccccggttaccccgttaccccccgtaaccgggtcccccgtttacccccggaaacccgggtaaaccccggggtaccccctaaaccgggtttacccccgggtttcccccgttttacccccccgggtccggggtaccccccg

SEQ ID NO: 22871 - DNA, 683 bp, Homo sapiens
  misc_feature: GYAE6OF02G3GRG.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggcctccaggcaagggggctcggagtgggtggcacttatgcacatgatggcgtacaacaaattctacgactaaattccggtggacggggccgtattaccaccattcctccgagaacgaactaaattaacaaacgtaaaccctacccttttaatctacgactaaaatacgacagacctagaacgaaccagacgaacgacggtactcgtacttattattacgcgacgaagtaacggacgaaccaccgaaccgtaaccctacgtacgacctaaataacgttaggttacgggggtacgtttggtttaccggtcggggaccggtaacgggggtacccgtagggtccgaccgttccgtcccgtaccccgtcgtccctacccgaacccggaaccgggccccgtaacggttcccggttccccgttaccccggtccgggtcccgtcccgtccgg

SEQ ID NO: 22872 - DNA, 606 bp, Homo sapiens
  misc_feature: GYAE6OF02H99O3.12.40.D07.1.454.CMB.1.raw
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
tcagatacgacgtacacgaccggtgctcgatttagtgatagagcgtaacaacagaggctcaccatggagtttgggctgagctgggttttcctcgttgctcttttaagaggtgtccagtgtcaggggcacctggtggagtctgggggagccgtggtccagcctgggcggtcccgtgacgactcggcctgtgttgcctctggatttcccttcaatttctattccatgcactgggtccgccaggctccgagcgaaggggctcgaggtgggtggctacttattgcacatgatggcgtacaaactaaatttcctaacgactaaattccggtaggacggggccattccaccatctccagtagacaattacaaagaaccaccctttanctagacaaatacgacngacctagaacgaccagacgacacgctgtactattagtgcgacgaagagagaacacaaccgaactacgtagaccaatacgttaggtcggggtcttggtccggtcggggaccgcggggacccgtggtactagtccgtaccctcccgcgaccctccgaacccgtacggccctacgtccggttaccccgttccccgtcggtcccgcccgtccg

SEQ ID NO: 22873 - DNA, 774 bp, Homo sapiens
  misc_feature: GYAE6OF02GUAY9.12.40.D07.1.454.CMB.1.raw
  modified_base (421)..(421): a, c, t, g, unknown or other
  misc_feature (421)..(421): n is a, c, g, or t
tcagatacgacgtacacgaccggtgctcgatttagtgatagagcgtaacaacagagggctcaccatggagtttgggctgagctgggtttcctcgttgctcttttaagaggtgtccagtgtcaggggcacctggtggagtctgggggagccgtggtccagcctgggcggtccctgacactcgcctgtgttgcctctggatttcccttcaattttctattccatgcacttgggtccgccaggctccaggcaaggggctcggagtgggtggcacttatgcacatgatggacgtacaaactaaattctaacgacaaaacgtttcccggtaggacgggggcccgtaatttacccgaacctagttcctacccgaaggaacgtaacctaaaatttaaccaaaacggtaaacctaaccccgtttttaanccgttagaacctaaaaacgttaacggacctaacggtacccttaggaaacgaaccccgtaaggtaacccggaaccgtaaccgggtccttacggtaccttaatttaacgtttcggacggtacgaaggaacgaacggaaccaaccgaaccgtaaacccgttacgtcggtacctaaattaacgtaggttacgggggttaccttgggttaccggtcggggtaccgtaacggggggtaccctagggttacctaacgttcccgtaccgtccccggaacgtccccgttaaccacccggaaaccgggtacccctaacggttcccggttacccttcccccggtcgggaccccgtccctaccgg

SEQ ID NO: 22874 - DNA, 885 bp, Homo sapiens
  misc_feature: GYAE6OF02GHEI3.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtatttcccttcaatttctattccatgcactgggtccgccaggcctccgaggcgaaggggctcggaggtgggtggctacttattgcacatgagtcggctacaaactaaattcctaacgactaaagttccggtaggacgggggccctaatttccaacctattccctaccgaaggaacgtaactaaactttaaccaaaacgtaaacccttaaccccgttttaatccgttagaaacctaaaaagttaacggaacctaacggcccgttaaggaaaccgaaaccccgaaggaacccggaaccgtaaccgggtaccgtttacggttaccgtttaaagttttaacgttacgggaccggtacggaacggaaacggaacggtaaccgaaacccaaccggtaaaaccccgttaaccgtaccgggtaaccctaaaacgttaaccgttaacggggttaccggggggttaccttttacggggtttacccgggtacggggggtaaccccgggtaaccggggggtacccccggttagggtaccgtaaccggttcccggttaccccgtacccccggtaaccggttacccccgtaaccccggaaaccccgggtaaccccgggtaccccgttaacccggtttcccccgggtttaccccccgtttccccccgggtccgggttaccccccggtccccgtaccccggg

SEQ ID NO: 22875 - DNA, 708 bp, Homo sapiens
  misc_feature: GYAE6OF02H8K3X.12.40.D07.1.454.CMB.1.raw
  modified_base (242)..(242): a, c, t, g, unknown or other
  misc_feature (242)..(242): n is a, c, g, or t
  modified_base (318)..(318): a, c, t, g, unknown or other
  misc_feature (318)..(318): n is a, c, g, or t
tcagatacgacgtacacgaccggtgctcgatttagtgatagagcgtaacaacaggggactcaccatggagtttgggctgagctgggttttcctcgttgctctttaagaggtgtccagtgtcaggggcacctggtggagtcgtggggggagccggtgggtccaggccgtggggcggtccctgacactcgcctgtgttgccttcgtggactttcccttcatttctattccatgcactgggtccncaggctccaggcaaggggctcggagtggggtggcacttattgctacatggatcggcgtacaactaattctaccganaaactttccgagggacggggtcctaattccaccgtaatcccgtacgaagacgtaacaagttacaaacgtaaactacccctttagttaccacgaataaaactgaaccagtccctagacaccgagaacgtacgacggactgtacttaactagttcgcgtacgagaagacgacaacgaaccgaactacgtaccggtaacaactacgtaaggtcggggtactttacggttcgacggggtaccgtacggggtcccgtaggtaccgtacgttaccgtacccttaccccggacgtaaccccgttacccgaacccggtaacccgggtaccccgtaaccggttcccggttaccccttccccccggttaccggccccggttccccgtaccggtaccccgg

SEQ ID NO: 22876 - DNA, 662 bp, Homo sapiens
  misc_feature: GYAE6OF02G3KWH.12.40.D07.1.454.CMB.1.raw
  modified_base (177)..(177): a, c, t, g, unknown or other
  misc_feature (177)..(177): n is a, c, g, or t
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
  modified_base (656)..(656): a, c, t, g, unknown or other
  misc_feature (656)..(656): n is a, c, g, or t
tcagatacgacgtacacgaccggtgctcgatttagtgatagagcgtaacaacaggggactcaccatggagttgggctgagctgggtttcctcgttgctcttttaagaggtgtccagtgtcaggggcacctggtggagtcgtggggagccgtggtccagccgtgggcggtccctgacnctcgcctgtgttcgcctctggatttccctnaatttcctattccatcgctacgtgggtccnccagctccaggcgtaaggggcctcgaggtgggttcggctacgttatcggcacgagtgtagtaggcgttacaaacgtaaacttcgtaacgtactaaacttccggtagacggggtcctacttcgacctaagtcctaccagagaacctaattacaaagtaaccaccctttataccctgaccaaaagtnacaggacctgaaactcaaacggtanaacccgtagcgtacgtactagtttatcgcgtaacgacgtagagtacacacgaacctactacggaccaatacgtaacggtgggaacgtttgtaccggtcggacgacggggtacctggtacgcgtacgtaccgtccccaggtcccgtaccaccggtaaaccgggcccttacgtacccggttacccgttccccgacggtcccgtcccgtacnccccgg

SEQ ID NO: 22877 - DNA, 564 bp, Homo sapiens
  misc_feature: GYAE6OF02I5URU.12.40.D07.1.454.CMB.1.raw
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
  modified_base (508)..(508): a, c, t, g, unknown or other
  misc_feature (508)..(508): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctctggatttcccttcaatttctattccatgcactgggtccgcaggctccaggcaagggggctcggaggtggggtggctacttattgcacatgatggctacaacaaattctacgcaaattccgtgagggccattcaccatctccagagaacaattacaagaactacccttatctagacaaatacgacagcctagaagaccagacgacacgctgtctaatntgcgcgagaganacacacgaacctagcgacaatactagtggggtcttgtacgtggggaccgacggggaccttggtctacgtccgtctaccccgngaccctaccgacgtaacggccctacgtccgtcccttccccgcggtcccgccctcgg

SEQ ID NO: 22878 - DNA, 685 bp, Homo sapiens
  misc_feature: GYAE6OF02FUDDB.12.40.D07.1.454.CMB.1.raw
tcagatacgacgtacacgaccggtgctcgatttagtgatagagcgtaacaacagagggctcaccatggagtttgggctgagctgggttttcctcgttgctctttaagaggtgtccagtgtcaggggcacctggtggagtcgtggggggagccgtggtccagcctgggcggtccctgacactcgcctgtgttgcctctggtactttcccttcaatttctattccatgctacgtcgggtccgccaggcctccgaggcgaaggggctcggaggtggggtcgcacttatgcacatccccccgagtggcgtacaactaaacttactacgactaaacgttccgtaggacggggccgtacttacaccactcctaccagagaactaactaacaacgtaacctaaccttactactacgactaaactaacgacacgacctacgaacgaccgaacgaacgaacgaccggtacgtacgtacttaattagttacgtcgacggagaacgacgaacaacaaccgtaacctacgtacgtacctaactaacgtagttacgggttacgtttacggttcggtcgggtaccggaccgggtaccggtcggtacgtacgtccgtccgtcccgtaccgtaccctacccgtaacccgaccggacccgtaccgtccggttcccgttccccgtccggtcccgtcccgtccg

SEQ ID NO: 22879 - DNA, 559 bp, Homo sapiens
  misc_feature: GYAE6OF02FX96I.12.40.D07.1.454.CMB.1.raw
  modified_base (236)..(236): a, c, t, g, unknown or other
  misc_feature (236)..(236): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggactttcccttcaatttctattccatgcactgggtccnccaggctccaggcaaggggctcgagtgggtggcacttatgcacatgatggctnaacaattcacgnaacttcgngagggccatcaccatctcaganacaattacaagaacctacctttanctgacaaatagacagcctgaacacagacgacgacggctgtctattattgcgcgagagacgacaacacgaacctacgcgaccaatacgtagtggggtcttcgttcgtcggggccgacggggcctggtactatccgtcctcccgtcgccctaccgacccgaacggccctacgtcccggttcccttccccggcggccgtcccgtccg

SEQ ID NO: 22880 - DNA, 584 bp, Homo sapiens
  misc_feature: GYAE6OF02G4OY7.12.40.D07.1.454.CMB.1.raw
  modified_base (234)..(234): a, c, t, g, unknown or other
  misc_feature (234)..(234): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtcaacaaattctacgcaaattccgtgaggggccattcaccatctccagagacaattacaagaacctaccctttatctgacaaatgacagcctgacgaccagacgacacggctgtctattatgcgcgagagagacacacgaacctactacggaccaatactagtacggggtcttacgttcgtcggggaccgtacggggaccctagggtcacgtaccgtcctaccccgacgtccctacccgaaccgaacgggccctacgttcccggttcccttacccccgtcggtcccgtcccgtccgg

SEQ ID NO: 22881 - DNA, 624 bp, Homo sapiens
  misc_feature: GYAE6OF02IFOQX.12.40.D07.1.454.CMB.1.raw
  modified_base (149)..(149): a, c, t, g, unknown or other
  misc_feature (149)..(149): n is a, c, g, or t
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (261)..(261): a, c, t, g, unknown or other
  misc_feature (261)..(261): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggganccgtggtccagcctgggcggtccctgacactcgcctgtgttgcctctggactttcccttnaatttctattccatgcactgggccncaggctcaggcaagggctcgagtgggngacacttatgcacatgatgggctcaactaaattcaacgcaaattccgagagggccaatcaccatcnccagagacaattacaagtaacnccctttaagcagacaaatcgacagtcctganacccagaacgcaacggtcctgtactattattgcgcgaagacgaagaccactaaccgaaccttactacggacctaatacctaagtcgggggtactttcggttacgtcggggacccgtagggggaaccctgggtaccgacgtccgtaccgttccccgaaggtcccttacccggaacccggaacgggtaccccgtaaccgttcccgggtaccttttccccccgacggtcccggttcccctacccggg

SEQ ID NO: 22882 - DNA, 572 bp, Homo sapiens
  misc_feature: GYAE6OF02GJGT3.12.40.D07.1.454.CMB.1.raw
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
  modified_base (432)..(432): a, c, t, g, unknown or other
  misc_feature (432)..(432): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttatgcacatgatggctcaacaaattctacgcaaattccgtggaggggccattcaccatctccaganacaattacaagacaccctttanctgacaaatagacagcctganaccagacgacacggctgtctatattgcgacgagagagacacacgaacctacncgaccaatactagtggggtcttggttcgtcgggccgacggggtacccgtggtccacgtccgtccgtccccgagtccctacccgaaccgaacgggcccctacgtcccggttcccttccccccgtcggtcccgtcccgtccg

SEQ ID NO: 22883 - DNA, 629 bp, Homo sapiens
  misc_feature: GYAE6OF02GJ8DF.12.40.D07.1.454.CMB.1.raw
  modified_base (234)..(234): a, c, t, g, unknown or other
  misc_feature (234)..(234): n is a, c, g, or t
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgcacatgatggcgtcaacaaattctacgcaaattccgtgaggggccattcaccatctccagacgacaattacaagtaacaccctttanctagacaaatagacagcctagacgaccagacgacacggctgtctattatgcgcgagacgagactacgacgaaccctacgtcggacctaacgttacgtagttacgggggtactttcggtttccggtacgggggtacccggtacgggggtaccctgggtacctacgttccgtaccctaccccggacgtcccgtacccgaacccggaacgggtcccctacggttcccgggttccctttccccccggtcgggtaccccgtccccggttaccgg

SEQ ID NO: 22884 - DNA, 768 bp, Homo sapiens
  misc_feature: GYAE6OF02JHH8D.12.40.D07.1.454.CMB.1.raw
  modified_base (150)..(150): a, c, t, g, unknown or other
  misc_feature (150)..(150): n is a, c, g, or t
  modified_base (200)..(200): a, c, t, g, unknown or other
  misc_feature (200)..(200): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccggtggtccaggcctggggccggtccctgacactcgcctgtgttgcctntggtatttcccttcaattttctattccgatcggcacgttggggtcccgccaggcctccagggcaaggggctcggaggtgggtggcacttagttgcacgtatgatcgggcgtacaaacaaattctaacgtacaaattccggtagaggggaccgtattccgaaccatcctaccgaagacgaactaaattacaaacggtaaacctaccccgttttaatctacggaactaaaagtacggtaccagggaccctaggaaccgaaccccgaagtaaccggaacgaaccgggtcctacggttcctttaagtttaccgtgaccggtaacggtaagaacgggtaacaaccaacgtaaccgtaaacccgtacggtaacggaccctaaataacgtacgggttgggggtccgttttaggttaaccgggtccgggggtaccggtaaaccgggggtaccccttggggtaccacgttcccggtacccgtcccgtacccgacccttacccggaacccggaacccggggtaccctgggtaccccggttcccccgttacccggtcccggggttccacccgttcccgg

SEQ ID NO: 22885 - DNA, 577 bp, Homo sapiens
  misc_feature: GYAE6OF02FP0AN.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaattctacgcaaattccgtgaggggccattcacatctccagacgacaattacaagaaccacccttatctgacaaatagacagcctgacgaccagacgacgacggctgtctattattgcgcgagagagacacgacaacctacgtcggaccaatacttagtacggggtctttggttcgtcggggtccaggggtaccctggtcacgttcgtcctacccgtacgccctacccgaacccgaacggcccctagtcccggttcccttcccccgtcgggtcccgtccctccgg

SEQ ID NO: 22886 - DNA, 566 bp, Homo sapiens
  misc_feature: GYAE6OF02GMFFC.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaattctacgcaaattccgtgaggggccattcaccatctaccagagacaattacaagaacaccctttatctgacaaatagacagcctgacgaccagacgacacggctgtctattatgcgcgagagagacacacgaacctacgtcggaccaatactagtagggggtcttgttcgtcggggaccgtacggggcccgtgggtcacgtccgtcctccccgagccctcccgaaccgacgggcccacgtccggtcccttcccccgtggcccgcccgtccgg

SEQ ID NO: 22887 - DNA, 577 bp, Homo sapiens
  misc_feature: GYAE6OF02FVM00.12.40.D07.1.454.CMB.1.raw
  modified_base (209)..(209): a, c, t, g, unknown or other
  misc_feature (209)..(209): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttnaatttctattccatgcactgggtccgccaggactccaggcaaggggctcgagtgggtggcacttattgcacatgatggcgtcaacaattctacgcaaattccgtggacggggccattcaccatctccagagacaattacaaagacaccctttactagacaaatagacagcctgacgaccagacacgacgctgtctattagttgcgcgagagagacacgacgaacctacgtacgccaatactagtcggggtctttcgttcgtcggggaccgacggggtacccgtgggtcacgttcgtcctccccgagtcccctcccaccgaaccgggtcccacgttccggttcccttcccccgtggcccgtcccgtccg

SEQ ID NO: 22888 - DNA, 684 bp, Homo sapiens
  misc_feature: GYAE6OF02IP4VN.12.40.D07.1.454.CMB.1.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
tcagatacgacgtacacgaccggtgctcgatttagtgatagagcgtaacaacagagggctcaccatggagttgggctgagctgggttttcctcgttgctcttttaagaggtgtccagtgtcaggggcacctggtggagtcgtgggggagccgtggtccagcctgggcggtccctgacactcgcctgtgttgcctctggattccttcaatttctattccatgcactggtccgcaggctccaggcaaggggctcgagtgggngctacttatgcanatgatggctcaacaaagtctaacgctaaaattccgtagaggggacccatttaccaccaattccaccaagaacgtacaaacttacaaagaacctaacccctttagctagacctaaaatagactacggcccttagaacgacccaggaccaacgtacggactgtacgtattagttgacgcgaagagtagacgacaacgtaaaccgtaacacgggtaacccaagttaaacctaggttacggggaccgtttacgttccggtacggggaccgtacggggacccgtacgggtcgtaacgtccggttactaccccccgtaggacccttacccaccccggaaaaccggggtcccccaaccgttcccgggttaaccccgtttccccccggtaaccgggtccccggttcccccggtacccgg

SEQ ID NO: 22889 - DNA, 584 bp, Homo sapiens
  misc_feature: GYAE6OF02G3JVE.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccgccaggctccaggcaaggggctcgagtgggtgcacttattgcacatgatggcgtcaaacaaattctacgcaaattccgtggaggggcccattccaccatctccgaagagacaaattacaagaacctacccctttatctcgactaaatgacagccctgacaccagacgacgacgctgtctatattgcgcgagagagacacacgaacctacgtcgaccaatactagtcggggtcttacgttcgtcgggaccgtaggggaccctggtccagttccgtcctaccccgacgccctaccgacccgaacgggtccctacgttcccggtaccgttcccccgcggtcccgtcccgtacg

SEQ ID NO: 22890 - DNA, 551 bp, Homo sapiens
  misc_feature: GYAE6OF02GRLZ5.12.40.D07.1.454.CMB.1.raw
  modified_base (234)..(234): a, c, t, g, unknown or other
  misc_feature (234)..(234): n is a, c, g, or t
  modified_base (361)..(361): a, c, t, g, unknown or other
  misc_feature (361)..(361): n is a, c, g, or t
  modified_base (536)..(536): a, c, t, g, unknown or other
  misc_feature (536)..(536): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtcaacaaattctacgcaaattccgtgaggggccgattcaccatctccagagacaattacaagaacaccctttanctgacaaatacgacagcctgacgaccagacgacacgctgtctattattgcgcgagagagacacacgaactacgtgaccaatactagtggggtcttgtcgtgggccgagggacctaggtcacgtcgtacctcccgacgccctccaccgaacggcccacgtccggtccgttcccccnggtcccgcccgtccg

SEQ ID NO: 22891 - DNA, 628 bp, Homo sapiens
  misc_feature: GYAE6OF02HOFY2.12.40.D07.1.454.CMB.1.raw
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
tcagatacgacgtacacgaccggtgctcgatttagtgatagagcgtaacaaacagagggctcaccatggagtttgggctgagctgggttttcctcgttgctctttaagaggtgtccagtgtcaggggcacctggtggagtcgtgggggagccgtggtccagcctgggcggtccctgacactcgcctgtgttgcctctggtactttcccttctaatttctattccatgcacgtgggtccgccaggctccaggcgaaacggggctcgagtcgggtgctacttatgcacatgatgtcgtacaaactaaattctaacgactaaaagttccgtaggaggggcctaattccgaaccatcctacgaagagaacaaattacaaaagtaaactaccctttaanccanactaaaatagacaagcctgaacgaccaagacgacacgactgtactattaacgttgacgacgagagaacgactaacaaccgaaaccttacgacggaccaataacgtaggtacggggtactttcgtacgtacgggaccgacggggaccctggtaccagttccgaccgtccccgaacgtccctaccgaaccgtacggaccacgttccggtacctcccctacggccgtccctcg

SEQ ID NO: 22892 - DNA, 637 bp, Homo sapiens
  misc_feature: GYAE6OF02JAL5E.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtacaaacaaattctacgcaaattccgtggaggggccgtattccaccatcctccagagactaattacaagaactaccctttatctgactaaatacgacacgcctagacacagacgacacggctgtcttattattgcgacgagagagacaacaccgaacctacgacgaccaactacgtaggtacggggttcttcggttacggtcgggggaccgtaaccgggggtaccccgttgggtaccgtaccgttccggtaccctaccccgtaacggtcccctacccggaaccggaaccggtccccgaacggttcccggtttcccccgttcccccggtacgggtccccgtccccgtccgg

SEQ ID NO: 22893 - DNA, 548 bp, Homo sapiens
  misc_feature: GYAE6OF02F24EL.12.40.D07.1.454.CMB.1.raw
  modified_base (234)..(234): a, c, t, g, unknown or other
  misc_feature (234)..(234): n is a, c, g, or t
  modified_base (360)..(360): a, c, t, g, unknown or other
  misc_feature (360)..(360): n is a, c, g, or t
  modified_base (434)..(434): a, c, t, g, unknown or other
  misc_feature (434)..(434): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcgaaggggctcgagtgggtggcacttattgcacatgatggcgtcaaacaattctacgcaaattccgtgaggggccattcaccatctcagagacaattacaagaacaccctttanctgacaaatagacagcctagacaccagaccgacacgctgtctattattgcgcgagagagacacacgaacctacncgccaatactagtggggtctttgttcgtcggggccgacgggacccgtggtacacgtccgtcctcccgacgccctccgacggcgaccaccgtccggagacgcaccgacggcccgg

SEQ ID NO: 22894 - DNA, 623 bp, Homo sapiens
  misc_feature: GYAE6OF02IO23W.12.40.D07.1.454.CMB.1.raw
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagccgtgggcggtcccgtgacactcggcctgtgttgcctcgtggtacttcccttataatttctattccatcgctacgtgggtcccnccaggctccgaggcgaaggggtctcggaggtgggngctacttntgcacagtgagtggctcaaagtaatctacgacaattccggngacgggcctatccacnctcnccgaagtanacaagttacaaacgtacctccttagctagactaaagctaacncgtacctnaaacgccaggacgaacgacgtactcgtactagtacttggacgtcggacgaagaacgacaccgaactaaccgtactcggaacctaaatacgtacggtcgggttacgtcgttcggtcggggaccggacgggtacgtcgtactcggtactacccgtcctacgccctacgacccgacgcccgacgtaccgtccctacccggtcggtcccgccctaccg

SEQ ID NO: 22895 - DNA, 686 bp, Homo sapiens
  misc_feature: GYAE6OF02JTZ1A.12.40.D07.1.454.CMB.1.raw
  modified_base (150)..(150): a, c, t, g, unknown or other
  misc_feature (150)..(150): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (292)..(292): a, c, t, g, unknown or other
  misc_feature (292)..(292): n is a, c, g, or t
  modified_base (394)..(394): a, c, t, g, unknown or other
  misc_feature (394)..(394): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggganccgtggtccagcctgggcggtccctgacactcgcctgtgttgcctctggatttcccttnaatttctattccatgcactgggtccnccaggctccaggcaaggggctcgaggtgggtgctacttatgcacagtgatggcgtanaaactaattctaacgcaaagttccggtaggacggggacctattaccgaacctattccgtaccaaggacgtaacaaattacgaaacgtaacctaccctttaanctacggaactaaagtacgaactacgtcctacgacacccgtaagacccacgacggtcctacgttacttaagttacgtcgacgacggtaagaacgtacgacgaaccgaacgtaaccgtacgtacggaacctaagttaaccgtaggttcggggtactttcgggtacggtggggacccgtacggggtaccccgttgggtacctaccgttccgtaccgtaccccgtaacgtcccgtaccgacccgtaaccgggtccctacgttacccggtccttccccggcgtcccgtcccctacgg

SEQ ID NO: 22896 - DNA, 602 bp, Homo sapiens
  misc_feature: GYAE6OF02HYCLW.12.40.D07.1.454.CMB.1.raw
  modified_base (366)..(366): a, c, t, g, unknown or other
  misc_feature (366)..(366): n is a, c, g, or t
  modified_base (405)..(405): a, c, t, g, unknown or other
  misc_feature (405)..(405): n is a, c, g, or t
tcagatacgacgtacacgaccggtgctcgatttagtgatagagcgtaacaacagagggctcaccatggagtttgggctgagctgggttttcctcgttgctctttttaagaggtgtccagtgtcagggacacctggtggagtcgtggggggagccgtggtccagcctgggcggtccctgacactcgcctgtgttgcctctggatttcccttcaatttctattccatgcactgggtccgccaggctccaggcaaggggctcgagtgggtggcacttattgcacatgatgggctcaacaaattcacgctaaattccgtgaggggccattcaccatcctaccagagacaattacaagaactaccctttanctagacaaatagacagcctagacgaccagacgacaggcngtctattatgcgacgagagagacaacacgaacctacgtacgaccaatacgtaagtggggtactttcggttaccgtggggccgaacggggcccgtggtcgacttccgtacctccccgtacgtccctacccacccgtaaaccggccccgtaacgttcccgggttccctttacccccggtcggtcccggtacccgtccgg

SEQ ID NO: 22897 - DNA, 589 bp, Homo sapiens
  misc_feature: GYAE6OF02FH337.12.40.D07.1.454.CMB.1.raw
  modified_base (236)..(236): a, c, t, g, unknown or other
  misc_feature (236)..(236): n is a, c, g, or t
  modified_base (333)..(333): a, c, t, g, unknown or other
  misc_feature (333)..(333): n is a, c, g, or t
  modified_base (359)..(359): a, c, t, g, unknown or other
  misc_feature (359)..(359): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctggtggagtctggggggagccgtggtccagcctgggcggtccctgacactcgcctgtgttgcctctggatttcccttcaatttctattccatgcactgggtccnccaggcctccgaggcaaggggctcgaggtgggtggcacttatgcacatgatggcgtcaaacaattcacgcaaattccgtgagggccattcaccatcncagagacaatacaagaccacctttanctagcaaatacgacagcctagacgaccagacacgacgctgtctattatgcgcgagagacgacacgaccgaacctacgtagaccaatactaggtaggggtctttggttacgtggggaccgacgggtacccgtcggtactacgtccgtccctaccccgacgtccctacccgacccgtaaccgggccctacggtcccggttacccttcccccggcggtcccgtcccgtcccgg

SEQ ID NO: 22898 - DNA, 647 bp, Homo sapiens
  misc_feature: GYAE6OF02FRIXO.12.40.D07.1.454.CMB.1.raw
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (384)..(384): a, c, t, g, unknown or other
  misc_feature (384)..(384): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggactttcccttctaatttctattccattgccacgtcgggtccgccaggcctccgaggcgaaggggctcggagtggggtggctacttatgcanatgatggctacaactaattcacgactaaattccggnggaggggaccattccaccatctaccagacgacaattacaaagtaacctacccttttanctagacaaatagacagtccagacgacacgacgacacggctagtactattagttcgcgacgagagacgacaacgacgaacctacgcgaccaagtactaggtcggggtactttcggttcggtcggggaccgtacggggtacccgttgtaccgtacgttcccgtacccgtaccccgacggtccccgtacccgaacccggtaccgggtacccctaccggttcccgggttccccgtttcccccggtcgggtccccgtcccgttcccgg

SEQ ID NO: 22899 - DNA, 891 bp, Homo sapiens
  misc_feature: GYAE6OF02JDMUM.12.40.D07.1.454.CMB.1.raw
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
tcagatacgacgtacacgaccggtgctcgatttagtgatagagcgtaacaacagagggctcaccatggagtttgggctggagctgggttttcctcgttgcctcttttaagaggtgtccagtgtcaggggcacctggtggagtcgtggggggagccgtggtccagcctgggcggtcctggacactcgcctgtgttcgcctctggtatttcccttnaatttctattccatgcactgggtccncaggctccgaggcaaggggctcggaggtcgggtggactacttagttcgctacattggaactgggaccttacaaactaaaattttccaaccgactaaaacgtttcccggagggacggggggtaccctatttccaaccttactcctcccgaagacgtaacctaaatttaccaaaacggtaaccctaaccccttttagtcccgttaaggaacctaaaagttacggaaccctaaggtacccctaggaaacccggacccgaacgggtaaccggaaccgaccggggtaccttacggtaccgtttaacgtttattacgggtaccgaacgggtaaaccgaagggtaaaccaacccgtaaccgaaaccccggtaaaaccccttaacgggtaccggggtaaaccctaaaacgttaaccggttaagggggttaccgggggggtttacccttttcgggtttacccgggttacggggggggaccccggttaaccgggggggttaacccccgttcgggttacccgtaacgttccccggggttacccctaaccccggcccggtaacccccttacccgggaacccggtaaacccggggtacccctaaccgggtttccccgtaccccggtttccccccgtaccgggggtcccctaccccggtcccggg

SEQ ID NO: 22900 - DNA, 673 bp, Homo sapiens
  misc_feature: GYAE6OF02IBFHH.12.40.D07.1.454.CMB.1.raw
  modified_base (233)..(233): a, c, t, g, unknown or other
  misc_feature (233)..(233): n is a, c, g, or t
  modified_base (386)..(386): a, c, t, g, unknown or other
  misc_feature (386)..(386): n is a, c, g, or t
tcagatacgacgtacacgaccggtgctcgatttagtgatagagcgtaacaacagagggctcaccatggagtttgggctgagcgtggtttcctcgttgctctttaagaggtgtcagtgtcaggggcacctggtggagtctggggggagccgtggtccagcctgggcggtccctgacactcgcctgtgttgcctctggatttcccttcaattttctattccatgcactgggtccnccaggctccgaggcgaacggggctcggaggtggggtggcacttattgcacatgatggcgtacaaacaattcctaagctaaacttccggtggacggggccattccacctatcctaccagacgactaaattacaaagtaaccctaacccgtttanactagaacctaaaagtacgaactgaccctagacgaccgaaggtaaccacgacggtacgtcgtattattagttacgcgacgaagtacgaacgaacctaacgaaccgtaacctacgtacggacctaaacgttacgtacggtacgggggtctttggttcggtaccgggtacgtaccggggaccgttggtacgtacgtcccgtaccctaccccgtacgaccctaccgaacccggtaaccggccccgtacgttcccggtacccttcccccggtcggaccccgtccgtcccgg

SEQ ID NO: 22901 - DNA, 762 bp, Homo sapiens
  misc_feature: GYAE6OF02G6SJQ.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcacgtgggtccnccaggctccaggcaaggggctcgaggtgggtggctacttatgcacatgatggcgtacaaactaaattctacgactaaagttcccggtaggacgggggtccgtatttccgaacctagtcctacccgaaggaacggaacctaaaatttaaccaaaacgtaaacccttaccccgttttaatccttacggacctaaaaataggaacctaacggcccttaggaacgtaacccgaacggaaccgaaccgaccggtacctacgttaccttaatttacgttacggcggacggtaaggaacgaaggaaccaaccaacccgtaaacctaccgtacggaccctaaacgttacgttaggtacggggggttcctttcgggttccggtacgggggtacccgtaacggggggtacccgttcgggtacctacgttccggttacccgtaccccgacgtacccctacccgaaccccgtaaccgggtccccctaacggttcccggttaccccttccccccggtcgggtccccgtcccccgtaccgg

SEQ ID NO: 22902 - DNA, 762 bp, Homo sapiens
  misc_feature: GYAE6OF02IEPFH.12.40.D07.1.454.CMB.1.raw
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
  modified_base (686)..(686): a, c, t, g, unknown or other
  misc_feature (686)..(686): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctggggcggtccctgacactcgcctgtgttgcctctggatttcccttcaatttctattccatgcactgggtccnccaggctccaggcaaggggctcgagtgggnggcacttatgcacatgagtggcgtacaaactaaattcctaacgacctaaacgttcccggtaggacgggggcctattaccaccatcctaccgaaggaagaacctaaactttaacaaacggaaaccttaacccccttttaataccgtacgaactaaaaacgttacgaaactacggacccgtacggacgaacccgtaggaaacccggaaccgtaaccgggtccgtttacggtttaaccttaaagttttaacgtttcgggaaccggaccgggtaaaggtacggtaaaggaacccaaaccgtaaccgggtaaaccccttacgtacgggaaccctaaaggttacgtaagggttacgggggtcttttacgggttcggtccggggaccgtacggggacccttggtactacgttccgtaccctccccgngtacccctccgaaacccgtacggacccctcggttacccggttccccgttacccccggtgggcccctcccgtaccgg

SEQ ID NO: 22903 - DNA, 573 bp, Homo sapiens
  misc_feature: GYAE6OF02F22NA.12.40.D07.1.454.CMB.1.raw
  modified_base (235)..(235): a, c, t, g, unknown or other
  misc_feature (235)..(235): n is a, c, g, or t
  modified_base (315)..(315): a, c, t, g, unknown or other
  misc_feature (315)..(315): n is a, c, g, or t
  modified_base (512)..(512): a, c, t, g, unknown or other
  misc_feature (512)..(512): n is a, c, g, or t
  modified_base (556)..(556): a, c, t, g, unknown or other
  misc_feature (556)..(556): n is a, c, g, or t
  modified_base (567)..(567): a, c, t, g, unknown or other
  misc_feature (567)..(567): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggcctccaggcaaggggctcggagtgggtgcacttatgcacatgatggctcaaactaattcacgactaaattccggngaggggcctattccaccatctccagacgactaattacaacgaactacccttatctaaacaaatagacagcctagacaccagacgaacacggtctagtctaattatgcgacgagagacgacaacacgaacctacgacgactaatacgtagtggggtcttcgttcgacgggccgtacgggcctaggcctactccgtccncccgacgcctaccgaaccgacggccctagtccgtccttccccgnggcccgtccgngtcccg

SEQ ID NO: 22904 - DNA, 680 bp, Homo sapiens
  misc_feature: GYAE6OF02F809N.12.40.D07.1.454.CMB.1.raw
  modified_base (234)..(234): a, c, t, g, unknown or other
  misc_feature (234)..(234): n is a, c, g, or t
  modified_base (373)..(373): a, c, t, g, unknown or other
  misc_feature (373)..(373): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaagggctcgaggtgggtgcacttattgcacatgatggccgtacaaacaattcacgactaaattcccgaggacggggccaattccaaccgtatcctccaagacgactaattacaagacctaccttanctagacaaatagacagtcctagacgaccacgtaacgacgcggactcgtacttaattcgttgcgacgtaaggaagtacgaaccgtaacaaccgtaacccttacgacgggaaccctaaagttacgttaagggtccgggggttactttacgggttccggtagggggtacccgacggggttacccgtgggttacctaacggttccggttacccgtcccgtaacggccccttacccgaaccggtaacccgggtccctaaccggttcccggtttccccttacccccggtacgggtccccgtaccccgttccgg

SEQ ID NO: 22905 - DNA, 650 bp, Homo sapiens
  misc_feature: GYAE6OF02F74HU.12.40.D07.1.454.CMB.1.raw
  modified_base (237)..(237): a, c, t, g, unknown or other
  misc_feature (237)..(237): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccggtggtccagcctgggcggtccctgacactcgcctgtgttgcctctggatttcccttcaatttctattccatgcactgggtccnccaggctccaggcgaaggggctcgaggtgggtgcacttatgcacatgatggcgtacaaactaattcacgacaaacttccggtggacggggccattcaccactctaccagagaacaattaacaaagtaacctaccctttatctagacaaatacgacagcctagaacgaccagaccgacgacggctcgtacttattattcggcgacggagaacgacgaaccacgaacctaaccgtacgtacggacctaaagttacgttaggtcgggggtactttcggttcggtacggggaccgtacggggacccgtgggtacctacgttccgtcctacccgacgtcccctacccgaacccggtaaccgggacccctacggttcccggttacccgttcccccggtcgggtcccgtccccgtaccgg

SEQ ID NO: 22906 - DNA, 655 bp, Homo sapiens
  misc_feature: GYAE6OF02JMJ09.12.40.D07.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (585)..(585): a, c, t, g, unknown or other
  misc_feature (585)..(585): n is a, c, g, or t
tcagatacgacgtacacgaccggtgctcgatttagtgatagagcgtaacaacgagagggctcaccatggagtttgggctgagctgggtttcctcgttgctctttaaggaggtgtccagtgtcaggggcacctgggtgagtctgggggagccgtggtccagcctgggcggtcctgacactcgcctgtgttcgctctggattcccttnaatttctattccatncnctgggtccgactacggctccaggccaaggggctcgagtggngcacttatgcncangagtgcgtnaaactaagttccancgtaaatccggtgacggggtccntttaccacctattcnccgntaagacctaattacaaacgacccgttacccttaagccttacgaataacgtaacgcaactacgtagacgaccaagacgttacacgacgtctacttaataacgtttgacgtacgacgtaagacgaacctacgtaacgtaaccctacgtccgaaccgtaattacgtaacgttacggggtactttaggtcggtaaccgggtcggtacggggtacctcgggtactacgtccgttaccgcccggtacnccttaacccgcccgtaacgggcccttaccggtccgtttccgtacccccggttcggtccctacccgttcgg

SEQ ID NO: 22907 - DNA, 599 bp, Homo sapiens
  misc_feature: GYAE6OF02I22X2.12.40.D07.1.454.CMB.1.raw
  modified_base (208)..(208): a, c, t, g, unknown or other
  misc_feature (208)..(208): n is a, c, g, or t
  modified_base (278)..(278): a, c, t, g, unknown or other
  misc_feature (278)..(278): n is a, c, g, or t
  modified_base (380)..(380): a, c, t, g, unknown or other
  misc_feature (380)..(380): n is a, c, g, or t
  modified_base (474)..(474): a, c, t, g, unknown or other
  misc_feature (474)..(474): n is a, c, g, or t
  modified_base (590)..(590): a, c, t, g, unknown or other
  misc_feature (590)..(590): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttnaattttctatttccatgcactgggtccgcaggctccaggcaaggggctggagtgggtgcacttatgcacntgatggcgttacaaacaaattcacgactaaattccgtggacggggccatttccaacctatcctccaaggacaccaaagttaaccaaagaaccacccttttanctagacaaaatgaaccagcctagacgacagacgacacggctgtacttattagtgcgagagagacacgaacacgaacctagcgaccaatactagngggtacttgttcgtcgggacacggggtacctggtactactccgtcctcccgtacgcccttaccgaaccgtaaccgggcccctacggttcccgttccgttacccccggtcggtcccncccggtacg

SEQ ID NO: 22908 - DNA, 736 bp, Homo sapiens
  misc_feature: GYAE6OF02I6X3W.12.40.D07.1.454.CMB.1.raw
  modified_base (208)..(208): a, c, t, g, unknown or other
  misc_feature (208)..(208): n is a, c, g, or t
tcagatacgacgtacacgaccggtgctcgatttagtgatagagcgtaacacagggggctcaccatggagtttgggctgagctgggttttcctcgttgctcttttaagaggtgtccagtgtcaggggcacctggtggagtcgtgggggagccgtggtccagcctgggcggtccctgacactcgcctgtgttgcctctggatttcccttnaatttctattccatgcactcgggtccgccaggctccgaggcgaaggggctacggagtggggtgcacttatgacacatgatggactacaactaaattctacgactaaagttccggtggacggggccgtaattccaccgatccgtaccagaacgaactaaactttaacgaaaacgaaccttaaccccgtttataccgttacgaactaaaattacggaacgtaacgtccgtaggaacgaacccaggaacccgaacgtacggtctacggttcttaacgtttagttcgacgtacgaaggtaagacgaacaaccgaacgtaacctacgtaccggtaacctaaacgtaacgtacgggtacggggttacctttcggttacgggtcggggtacccggtaacggggtacccgttagggtacctacgtcccgttcccgacccgtaccgtcccgtaccccgaaccggtaaccggtcccgtaaccggttcccgggttcccgtttacccccgggtcggaccccggttacccgtccgtacccg

SEQ ID NO: 22909 - DNA, 613 bp, Homo sapiens
  misc_feature: GYAE6OF02H26YW.12.40.D07.1.454.CMB.1.raw
  modified_base (381)..(381): a, c, t, g, unknown or other
  misc_feature (381)..(381): n is a, c, g, or t
  modified_base (605)..(605): a, c, t, g, unknown or other
  misc_feature (605)..(605): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggactttcccttcaatttctattccatgcactgggtccgccaggctccaggcaaggggctcggagtgggtggcacttattgcacatgatggcgtcaacaaatttcctaacgctaaattccggtggacggggccgtatttccgacctatcctaccagagaccaattacaagaacctacccttttanctagacaaatacgacagcctgacgaccaacgacgacacggctgtactattattgcgacgagagacgacacaccgaacctacgtacgaccaagtactaggtggggtctttaggtcggtacggggccgaacggggtaccctggtacctagttccgtctaccccgcgtccctacccgaccgaaccgggtccctacggtcccggttcccgttcccccgtcgggtcccnccccgtcg

SEQ ID NO: 22910 - DNA, 698 bp, Homo sapiens
  misc_feature: GYAE6OF02GWW1U.12.40.D07.1.454.CMB.1.raw
tcagatacgacgtacacgaccggtgctcgatttagtgatagagcgtaacacagagggctcaccatggagtttgggctgagctgggttttcctcgttgctctttaagaggtgtccagtgtcaggggcacctggtggagtctgggggagccgtggtccagcctggggccggtccctgacactcgcctgtgttgcctctggactttcccttcaatttctattccatgcacgtggtccgccaggctccaggcaaggggctgagtggtgcacttatgcacagtgatggctacaaactaaattctacgactaaagttcccgtagggacggggtcctaagttccaaccaattccaccagaagactaaattacaaagaaacctaccctttaatctagactaaaagtacgacacggtcctagacgaacccgagaaccgacgacggtactgtacttactttacgttcgaccgacgtaaggaagaacgaaccacgtaacccgaaccttaccgtacgacctaaactaaccgtaggtacggggtctttacgggttcgtacggggccgtaacggggtacccgtaggtccgtacgttcccgttaccctaccccggtaaccgtacccctacccgtaacccggtaacccgggtcccgtaaccggttcccgggttacccccgttcccccggttaccgggtccccgtcccgtcccgg

SEQ ID NO: 22911 - DNA, 980 bp, Homo sapiens
  misc_feature: GYAE6OF02I7ATT.12.40.D07.1.454.CMB.1.raw
  modified_base (151)..(151): a, c, t, g, unknown or other
  misc_feature (151)..(151): n is a, c, g, or t
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggacnccggtggtccagccgtgggccggtccctgacactcgccgtgtgttncctctggtactttcccttnaatttctatttccatgcacgtgggtccncaggctccgaggaccgaaggggtcctacggnggtgggtacgctacgtttattcggacaactagtaggtacgtcgggtacccgtaactaaaaaccgttaaacttttcccgttaaacccgaacgttaaaacccggtttttccgggtacggggggaaacccgggggggtttacccccgtttagttttaacccgaacccccgtttaaacttcccccgttaaacccgaaagggttaaaccggtaaacctttaaaaacgtttaaaacccgaaaaccggttaaaaccccttttaacccccgtttttaagtacccttacgggtaaaaccctaaaaagtaccgaacctaccgggttaaccctagggaaacccgtaaaccccgaggaaacccgcgtaacggtccttacggttaacgttaacgtttacgttcggaccgtaccgggtaaggaccgtaacgaaccgttaaccgaaacccgttaacccttaaccggtaaccggtaacccgtaaacgttaacggttacgggtacgggggtttacctttacgggttccgggttaacccggggggtaccggtaccggggttacccgttacgggttacccgttacggttccccgttaccccgtaccccggtacccggtaccccgttaccccgaacccgggttaaccccgtaccccggttaaccgtccccgggtttaacccccggtttcccccggtacccgggttacccggttacccccgtacgg

SEQ ID NO: 22912 - DNA, 703 bp, Homo sapiens
  misc_feature: GYAE6OF02GUZN4.12.40.D07.1.454.CMB.1.raw
  modified_base (150)..(150): a, c, t, g, unknown or other
  misc_feature (150)..(150): n is a, c, g, or t
  modified_base (214)..(214): a, c, t, g, unknown or other
  misc_feature (214)..(214): n is a, c, g, or t
tcagatacgacgtacacgaccggtgctcgatttagtgatagagcgtaacaacgagaggactcaccatggagtttgggctgagctgggttttcctcgttgctcttttaagaggtgtccagtgtcaggggcacctggtggagtctggggganccggtggtccagcccgtgggccggtccctgacactcgcctgtgttgcctctggtatttcccttnaatttctattccatgcacgtgggtccgccaggcctccgagggcaaggggctcggagtgggtgcacttatggcacatgatggcgtacaaactaatttctaacgactaaacgttcccggtaggacggggaccgtagttccaccacgttctacccgagacgaactaacgttaacaacgaaaccttaccccgtttatacgtacgaactaaactacggaactacgcctagacgaaccaacggacgtacacggtctacgttattaacgttacgttggaccggtacgacggaagacgaacctacgaaccgtaaccgtacgacggaacctaagtaccgttagggtacgggtacgtttgttccggtcggggacccggtacggggtacccttagggtcctacgttccgttccgtccccggtaacgtcccgttaacccgaccgtaaccggccctaacgttccggttaccccttcccggtaccggtacccgcccgtacccg

SEQ ID NO: 22913 - DNA, 811 bp, Homo sapiens
  misc_feature: GYAE6OF02H08W1.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctggggcggtccctgacactcgcctgtgttgcctctggactttcccttcaatttctattccatgcacgtgggtccgccgaggtcctccgagggcgaaaggggggctcgggaggtggggtggctacttattgccacattgatgggcgtacaaactaaacttcaacgtactaaaacttccggtagggacgggggcctaagtttccaaccctaattccttaccccgaagtacggaaacctaaaacgtttaaacgaaacgtaaaacccttaaccccgttttataccgttacgaacctaaaaagttaacgaaccaacggtccctaaggaaccgaacccgaacgggaacccggaaaccggtaccgggtccgtttagttaccgttaattttacgttacgggacggtacggtaaggaacggtagaaccctaaccgaacccgtaaccctaaccgtacgggtacccaaacgttacgttaagggtcgggggtacttttcgggttcggtacgggggacccggtaacgggggtaccccgttgggtacctacgttccggttccctaccccgtcggtaccctacccggaacccggtacccgggaccccttacggttccccgggttacccccttccccccggtcgggtaccccggtcccctacgg

SEQ ID NO: 22914 - DNA, 834 bp, Homo sapiens
  misc_feature: GYAE6OF02I3GY1.12.40.D07.1.454.CMB.1.raw
tcagatacgacgtacacgaccggtgctcgatttagtgatagagcgtaacaacagagggctcaccatggagttgggctgagctggtttcctcgttgctctttaagaggtgtccagtgtcgagggcaccgtggtggagtcgtgggggagccggtggtccgacgccgtgggtccggtccctgacactcgctgtgttcgcctcgtggtactttcccttctaatttctactccatgctactcgggtccgccacggcctccgagggccgaagggggtcctcggtaggtggggttacggcctacgtttagttcgacacgaatgtacgtggccgtacgtaaactaaaagttccaacggtaccctaaaattccccgggtaggacgggggaccctaagtttaccacctaaacttcgtacccgacgaacggtaaaccctaaacgtaaccgtaaaacgaaccctaaccccgtttttaacgactaaccggtactaaaaaagtacgtaccacggtacccttaacgggaacggtaaccccaagggtaaccccgaaaccgtaccgggtaccttcggttaaccgttaactttaacgttacgtcggaacgaacgtacggaaccgactaaccgtaaccgacctaccgtagtacccaaagttaccgtaggttaccggggtactttgggttacccgtaggggtacccggtaacgggtacccgtacgggtccgtacttccccggtaccgtaccccgcggtaccccgtacccgtaaacccggtaaccgggtccccgttaacggttccccgggtaccctttaccccccgggtcgggtacccccgtccccgttacccgg

SEQ ID NO: 22915 - DNA, 633 bp, Homo sapiens
  misc_feature: GYAE6OF02FE0KP.12.40.D07.1.454.CMB.1.raw
  modified_base (149)..(149): a, c, t, g, unknown or other
  misc_feature (149)..(149): n is a, c, g, or t
  modified_base (234)..(234): a, c, t, g, unknown or other
  misc_feature (234)..(234): n is a, c, g, or t
tcagatacgacgtacacgaccggtgctcgatttagtgatagagcgtaacaacgagagggctcaccatggagtttgggctgagctgggttttcctcgttgctctttaagaggtgtccagtgtcaggggcacctggtggagtctggggganccgtggtccagcctgggcggtccctgacactcgcctgtgttgcctctggactttcccttcaatttcattccatgcactgggtccncaggcctccgaggcaaggggctcggagtgggtgcacttatgcacatgatggctacaaactaattcacgactaaacgttccgaggacggggtccattcacatcctacagacgactaattacaagtacctacctttacgtacgacaaatcgacagcctagacgaccagacacgacgctagtctattacgtgcgagagagacgacacaccgtaactacgacgacctaatacgtagtcggggtactttacggttccggtacggggacccgacgggtacccgtgggtaccctaacgttcccgtaccctaccccgaacgtccccgtaacccgaacccggtaccggaccccgtacgttccccggttaccccgttcccccggtccgggtccccgtcccggttaccgg

SEQ ID NO: 22916 - DNA, 708 bp, Homo sapiens
  misc_feature: GYAE6OF02JHULW.12.40.D07.1.454.CMB.1.raw
  modified_base (149)..(149): a, c, t, g, unknown or other
  misc_feature (149)..(149): n is a, c, g, or t
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (322)..(322): a, c, t, g, unknown or other
  misc_feature (322)..(322): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcgtccctgacactcgcctgtgttgcctctggatttcccttnaatttcattccatgcactgggtccncaggctccaggcaagggctcgagtgggtgcacttatgcacatgatggcgtcaacaattcacgcaaattccgtgacgggtccattccaccntcctaccagagacctaattaccaagtaacctaccctttatctagaccaaagtacgaccacgtacctggaacgacccgagaccgacgaacgggtccttaggtaccttaagtttacgttggccggtacgtaaggaacgtaagaacctaacgtaacccgtaaaccttaccgtacggtaacccaaacgttacgtaaggttacggggtaccgtttacgggtttaccgtacgggggtcccgtaacgggggtaccccgttacgggtaccgtacgttaccggttccttaccccggacggtacccgtacccgtaaccggaaccgggtccccgtaacggtttccccgggttacccgtttcccccggtaccgggtaccccggtaccccgttaccggg

SEQ ID NO: 22917 - DNA, 599 bp, Homo sapiens
  misc_feature: GYAE6OF02FIMPF.12.40.D07.1.454.CMB.1.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (387)..(387): a, c, t, g, unknown or other
  misc_feature (387)..(387): n is a, c, g, or t
  modified_base (442)..(442): a, c, t, g, unknown or other
  misc_feature (442)..(442): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctggtggagtctggggggagccgtggtccagcctgggcggtccctgacactcgcctgtgttgcctctggatttcccttnaatttctattccatgcactgggtccnccaggctccaggcaaggggctcgagtgggtggctacttatgcacatgatgggcgtacaaactaaattctaacgacaaacttccggtggacgggggccctattccaaccatcctaccaggaagaacaattaacaaagaacctacccttttanctgacaaaatagaacagcctagacgaccaagaccacacggctgtctattatgcgngagagagacacgacgacctacgagacctaaatactagtcgggggtctttggttcggtcggggcgacggggtacccgtggttaccagttccgtcctcccgacgtcccgtaccacccgaacggcccagttccggtcccttccccgtcggccgtccctcg

SEQ ID NO: 22918 - DNA, 577 bp, Homo sapiens
  misc_feature: GYAE6OF02IDKHB.12.40.D07.1.454.CMB.1.raw
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (527)..(527): a, c, t, g, unknown or other
  misc_feature (527)..(527): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctggggcggtccctgacactcgcctgtgttgcctctggtactttcccttcaattttctattccatgcactgggtccgcaggctccgaggcaaggggctcgaggtgggtggcactttattgcacatgagtggcgtnaaactaattctacgacaaattccgtgacggggccgattcacctatctcagacganaacttacaagaacctacccttatctacgacaaatagacagcctagacgacacgacgacacggctgtacttattattcgcgcgagagacgacacaccaacctcgtacgaccaatacgtaggtcggggtctttcgttgtcggggccgacggggacctggtcatccgtccgcccgtacncctaccaccgaacggtcccacgtccggtcccttcccgtcggccgtcctcg

SEQ ID NO: 22919 - DNA, 715 bp, Homo sapiens
  misc_feature: GYAE6OF02GVSLM.12.40.D07.1.454.CMB.1.raw
  modified_base (209)..(209): a, c, t, g, unknown or other
  misc_feature (209)..(209): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggactttcccttnaattttctattccatgcacgtgggtccgccaggctccaggcgaagggctcgagtgggtcgcacttattgcacatgatggcgtacaacaaagttcctacggactaaagttcccggtagacggggggccctaatttccaacccgattcctacccaaggaaccgactaaaattaaccgaaacgtaaacctacccgttttatactgtaaccaaaagtagaactagtaccctagaacgaacccaggaaccgacgaccggcttagtaccttaagttattcggaccggacgtaaggaagacgaactaacaaccgtaaacctacgtcgggaaccctaaattaacgaggtacgggggttacttacggtttcggtacggggaccgttaacgggggacccttagggtcctaacgttccgtacccgtaccccgtacgaccccgttacccaacccggaaccgggcccctacgttcccgggttacccctttcccccggacgggtcccgtccccgtaccgg

SEQ ID NO: 22920 - DNA, 808 bp, Homo sapiens
  misc_feature: GYAE6OF02GRM40.12.40.D07.1.454.CMB.1.raw
  modified_base (198)..(198): a, c, t, g, unknown or other
  misc_feature (198)..(198): n is a, c, g, or t
  modified_base (240)..(240): a, c, t, g, unknown or other
  misc_feature (240)..(240): n is a, c, g, or t
  modified_base (329)..(329): a, c, t, g, unknown or other
  misc_feature (329)..(329): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcgaggggcacctggtggagtcgtgggggagccgtggtccagccgtgggcggtccctgacactcgcctgtgttgcctntggtacttttccctctaatttctattccatgcactgggtccnccaggctccgaggcgaaggggctcggaggtgggtgctacttatgcacagtgagtggacgtacaacgaaattctacgacaaacttccggnggacggggacctattacccaactactacctaccgaaggtaacgtaactaaacgtttaacgaaaacgtaaacccttaacccgttttaataccgtacgtaaacgtaaaacgtaacgaacgtactaccggtacgaaccgtaacccgtaacggtaaccgtaaccgtacccgggtactttaaccggtttacgtttaacgtttacggttaccggtaccgtacgggaaacgtaaagggaaccgtaaaccgtaaacccgaaacccggtaaacccttacggtacgtaacccgtaaaacttaccgttagggttacgggggttaccgtttcgggtttacccgtacgggggtacccggtaacccgggggttaccctacgggtaccgttacgtcccggtttacccaaccggtaccgtacccgtacccgtaaccggaacggtacccgtacgtcccggttacccttccccgtcgggtccctcccgttacgcccg

SEQ ID NO: 22921 - DNA, 192 bp, Homo sapiens
  misc_feature: GYAE6OF02GEHSX.12.40.D07.1.454.CMB.1.raw
  modified_base (186)..(192): a, c, t, g, unknown or other
  misc_feature (186)..(192): n is a, c, g, or t
tcagatacgacgtacacgaccggtgctcgatttagtgatagagcgtaacaacagaggactcaccatggagtttgggctgagctgggttttcctcgttgctccaggagcacctccgagagcacagcggccctgggctgcctggtcaaggactacgtcgtatctgagcgggctggcaaggcgcatagnnnnnnn

SEQ ID NO: 22922 - DNA, 723 bp, Homo sapiens
  misc_feature: GYAE6OF02G2DOU.12.40.D07.1.454.CMB.1.raw
  modified_base (151)..(151): a, c, t, g, unknown or other
  misc_feature (151)..(151): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggganccgtggtccagcctgggcggtccctgacactcgcctgtgttgcctctggactttcccttcaatttctattccatgcactgggtccgccaggcctccagggccaaggggcctcggaggtgggtgcacttatgcacatgatggcgtacaaacaaattctaacgactaaagtttcccggtaggacgggggcctaagtttccacctatcctaccaagacgaacaattacaagaacctaccctttatctagaacaaatacgaactagcccgtagaaccggtaccaaggtaaccgaaccgacggtccgttacgttaccttaatttacgttacgacgggtcgaaaggaacggtacgaacctaaacgaacctaaacccgtactcggaacctaagttaaccgtaaggttcgggggtcctttggttacggtacggggtaccggaacgggggtaccctagggtaccacgttccgtacccgtacccccggtacggtccccgtacccgtaacccggaacccgggtaccccttacggttacccggtcccccttttcccccgggaccgggtccccgtaccccgtccg

SEQ ID NO: 22923 - DNA, 647 bp, Homo sapiens
  misc_feature: GYAE6OF02G3DQR.12.40.D07.1.454.CMB.1.raw
  modified_base (242)..(242): a, c, t, g, unknown or other
  misc_feature (242)..(242): n is a, c, g, or t
  modified_base (357)..(357): a, c, t, g, unknown or other
  misc_feature (357)..(357): n is a, c, g, or t
  modified_base (390)..(390): a, c, t, g, unknown or other
  misc_feature (390)..(390): n is a, c, g, or t
  modified_base (499)..(499): a, c, t, g, unknown or other
  misc_feature (499)..(499): n is a, c, g, or t
  modified_base (551)..(551): a, c, t, g, unknown or other
  misc_feature (551)..(551): n is a, c, g, or t
  modified_base (558)..(558): a, c, t, g, unknown or other
  misc_feature (558)..(558): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtcgtgggggagccgtggtccaggccgtggggcggtccctgacactcgcctgtgttgcctctggtatttcccttcaattttctattccatgcacgtgggtccnccaggctccgaggcgaagggctcgagtgggtgcacttattgcacatgatggcgtacaactaaattcctacgactaaagttcccggtggaggggcctattcaccatcctaccaganaactaacttaacaaacgaacctaaccctttacnctacgtacaaaatacgacacgtcctaggaacgaccaacggaaccgtaacgaccggactagttacttattacgttcgacgtcgaagtacgagaccaacaacgaaccctanacgacctaatacgtaggtgggtcttgttccggtgggccggacgggtacccgnggtaccngttccgtcccgacccgacgtccccaccgtacccgaaccggcccgtaacgttcccggttccccttccccggtccggtcccgtccctccgg

SEQ ID NO: 22924 - DNA, 568 bp, Homo sapiens
  misc_feature: GYAE6OF02FQH7C.12.40.D07.1.454.CMB.1.raw
  modified_base (234)..(234): a, c, t, g, unknown or other
  misc_feature (234)..(234): n is a, c, g, or t
  modified_base (360)..(360): a, c, t, g, unknown or other
  misc_feature (360)..(360): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtcaacaaattctacgcaaattccgtgaggggccgattcaccatctccagagacaattacaagaacacccttanctgcaaatagacagcctagagaccagacgacacggctgtactattattgcgcgagagagacacacgaacctactggaccaagtactagtggggtcttggttcgtcggggcctacggggaccctgggtcatcgtcctccccgacgtccctccgaacccgtaacgggccccacgtccggttccttcccccggtcggtcccgtcccctcgg

SEQ ID NO: 22925 - DNA, 649 bp, Homo sapiens
  misc_feature: GYAE6OF02G1BFZ.12.40.D07.1.454.CMB.1.raw
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccgaggctccaggcaaggggctcgagtgggnggcacttatgcacatgatggcgtacaacaaacttctaacgctaaaatttcccggtaggacgggggcccgtatttccaccgaacttcctacccgagaacgactaaacttaacaacgaaacctacccttttactcgtacgacgtaaatacggaacacgtacctagaacgaccgtagaaccgtacgacggctcgtacgtattacgttgcgagagtagagtacacgacgtaactacgcggacaatactagcggggtcttcggttcgtcgggacgtacggggtaccgtagggtcacgtccgtccgtcccgacgtcccctccgaacccggaccggtacccgtaccgttcccggttacccgttccccgtacgggtcccgtaccccgtccgg

SEQ ID NO: 22926 - DNA, 583 bp, Homo sapiens
  misc_feature: GYAE6OF02GIATS.12.40.D07.1.454.CMB.1.raw
  modified_base (374)..(374): a, c, t, g, unknown or other
  misc_feature (374)..(374): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttatgcacatgatggcgtcaacaaattctaacgcaaaattccgtagacggggccattccaccatcctccaagacgacaaattacaaacgtaaccaaccccttttanacttcgactaaaatagacagcctagacgaaccagacgacacggctgtctattatgcgcgagagagacaacacgaacctactacgaccaataactagaggggtcttgttcggtgggaccgacggggtaccctggtctacgtcgtcctacccgacgccctccaaccgacggcccgacgtccggttaccttcccccgtggcccgcccgtccg

SEQ ID NO: 22927 - DNA, 665 bp, Homo sapiens
  misc_feature: GYAE6OF02GCP0O.12.40.D07.1.454.CMB.1.raw
  modified_base (242)..(242): a, c, t, g, unknown or other
  misc_feature (242)..(242): n is a, c, g, or t
  modified_base (332)..(332): a, c, t, g, unknown or other
  misc_feature (332)..(332): n is a, c, g, or t
  modified_base (423)..(423): a, c, t, g, unknown or other
  misc_feature (423)..(423): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctctggtactttcccttctaattttctattccatgcacgtgggtcccnccaggctccgagggcgaaggggctcggaggtgggtcgctactttatgcacatgatggcgtacaaactaaattctacgactaaattccggnggacggggcctattccactatcctacagacgactaattaacaaacgtaacctaccctttagtctagactaaagtacgaacgacgacccganaaccgagaaccgacacggctacgttactaattacgtacgacgtacgaagacgacgaacctaaccgaaccgaaaccgtacgtacgtaaccaagttacgtaggtacggggtctttaggttaccggtacgggccgtaacggggtccctggtacctcgtccgtcccgtacccacggtccctaccgacccgaaccgggtccctacggttcccggttccccttcccgtccggccctcccgtcgtcccg

SEQ ID NO: 22928 - DNA, 719 bp, Homo sapiens
  misc_feature: GYAE6OF02GP4ME.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaattttctattccatgcactgggtccnccaggctccgaggcaaggggctcggaggtgggtcggcacttagttgcacagtgatgggcgtacaactaaactttctaacgactaaaattcccggtaggacgggggtccctattcgaacccattcctacccgaagacgtaactaaacgttaaccaaacgtaaacctacccgttttaatccgttaggaacctaaaagtacgaaccgtacgcccgtagaacgtaacccaaggaaccgaccgaacgggtctaggttacctaatttacgttaggaccgacgacggaacgaacgaacaaccgtaaccgaaccttacgtacggacctaagtacctaaggtcggggtacttcgttcggtcgggtacccgaggggtaccctgggtacctacgttaccggtccgttacccccgagtaccccgtacccgaaccgtaaccgggcccgtacggttcccggttacccttcccccgggtacggtcccgtcccgtaccgg

SEQ ID NO: 22929 - DNA, 802 bp, Homo sapiens
  misc_feature: GYAE6OF02H6R69.12.40.D07.1.454.CMB.1.raw
  modified_base (275)..(275): a, c, t, g, unknown or other
  misc_feature (275)..(275): n is a, c, g, or t
tcagatacgacgtacacgaccggtgctcgatttagtgatagagcgtaacaacagagggctcaccatggagtttgggctgagcgtggtttccgtcgtagctctttaagaggtgtccagtgtcaggggcacctggtggagtcgtgggggagccgtggtccagccgtgggcggtccctgacactcgcctgtgttgcctctggtactttcccttctaatttctattccatgcacgtgggtccgccgaggtcctcccgagggaccgaagggggctacggnggtggggtggtactacgtttagttcgacaccgtagtgtaagtcgggacgttacaaactaatttacgacactaaacgttccggtaggacggggtaccctagttccaaccgtacttcaccgagacgtaaacaattaacgaaagtaacccttaaccctttatccgtacaacgtaaattaacgactacggtacacggacgaaccaggacccgagaccggtactgtttaccgttaattacgttcgcgtacggagtagaacgtaaccaccggaaactaaacccggttactcccgggaaactaacggttaaccgttagggtacgggggttttaccggtttccgggttacgggtacccgggggtaccccggtaacgggggtttacccccgtagggttaccggtaaccgtttccgggtacccctttaccccgggaaccgttaccccgtacccgtaaacccggtaacccgggtacccctacggttttccccggtccccggtttaccccccggtcgggttcccccgacccgttcccgg

SEQ ID NO: 22930 - DNA, 578 bp, Homo sapiens
  misc_feature: GYAE6OF02GVV9M.12.40.D07.1.454.CMB.1.raw
  modified_base (294)..(294): a, c, t, g, unknown or other
  misc_feature (294)..(294): n is a, c, g, or t
  modified_base (448)..(448): a, c, t, g, unknown or other
  misc_feature (448)..(448): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcgaaggggctcgagtgggtggcacttattgcacatgatggcgtacaanaaattctacgactaaattccgtaggagggccgattcaccatctccagagactaattacaaagtaaaccaccctttaatctagactaaatagacagcctagacaccagacgacacggctgtctattattgcgcgagagagacacacgaacctacngaccaataccagtgggtcttgtcgtgggtccgaggggccctggtcagtccgtcgtaccccgaggtccctaccgaacccgaacggaccctacgtcccggttcccgttcccccgtcggtcccggccctccgg

SEQ ID NO: 22931 - DNA, 648 bp, Homo sapiens
  misc_feature: GYAE6OF02IIQI1.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggactttcccttcaatttctattccatgcactgggtccgcaggctccaggcaaggggctcggagtgggtggcacttattgcacatgatggcgtcaaacaattctaacgactaaacttccggtaggacgggccgattcaccatcctaccagacgacaattaacaacgaactaccctttatctagacaaaatagacacgcctagacaccaggaccacgacgctgtacttattacgttcgacgtacgaagaaggaagaaccaacgtaacgtaaaccctacgttacggaccaacgttactaacggtcgggggttactttggttcggtcggggaccgtacggggaccctgggtcctagttccggtaccctaccccgcgtaccccgtacccaaccggaaccggtacccgacggttcccggttccccttcccccggacggtccccgtcccgtaccggg

SEQ ID NO: 22932 - DNA, 821 bp, Homo sapiens
  misc_feature: GYAE6OF02F76CY.12.40.D07.1.454.CMB.1.raw
  modified_base (242)..(242): a, c, t, g, unknown or other
  misc_feature (242)..(242): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggtactttcccttataatttctattccatcgctacgtcgggtccnccgaggtcctccgaggccggaaggggtcctacggagggtcggggtcgacttacttagttcgacactagtgagtcggaccgtacaaacttaactttaccgtacgtaacttaaacgttccggaggggacggggccctaattccaacctacttcctacgaagacgaaactaaacttaacaaacgtaaccttaccctttatcgtacaactaaacgtacgactacgtacctagaaccgaccgaacggaccgaacgtaccggtacttacttactttaagtttcgtacggacggtaacggaagaacggaacgtaacccaacccggtaaacctaacccgttaacggacccgtaaacccgtaaacgttaaccggttaaggggttcgggggttacctttttcgggttaccggggttaccggggaccggtaacccggggtacccgttggttaacccgttacggttcccgtacccccgtacccgtaaccggtccccttaacccggaacccgggtaacccgggtacccctaccgggtttccccggtttaacccccgttcccccggtccgggtacccctcccggttaccccgg

SEQ ID NO: 22933 - DNA, 667 bp, Homo sapiens
  misc_feature: GYAE6OF02HJYPN.12.40.D07.1.454.CMB.1.raw
  modified_base (239)..(239): a, c, t, g, unknown or other
  misc_feature (239)..(239): n is a, c, g, or t
  modified_base (406)..(406): a, c, t, g, unknown or other
  misc_feature (406)..(406): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagccgtgggcggtccctgacactcgcctgtgttgcctctggtatttcccttcaattttctattccatcgcactgggtccnccaggcctccaggcaagggggctcggaggtgggtggctaacgttattgccacattgatgggcgtacaaactaattctaacgactaaagttccggtagacgggggcctaattccaccattccgccaagacgtacaaattacgaaacgtaacctaccctttaatccganaactaaatagaacctagcctagggaacaccctacgaacgaccacgggctcggtacttacttaagttcggcgtacgaaggaacgagaaccgaacctaaccgtaaacctactcggactaaacgtacctaaggtaggggtcttgttacggtcggggtaccgacggggtacctacggtcacgttcgtcccgttacccgcggtaccctccgaacccgaccggtcccgtacgtacccggtccgttccccggtcggcccgtccctcgg

SEQ ID NO: 22934 - DNA, 628 bp, Homo sapiens
  misc_feature: GYAE6OF02GHVE5.12.40.D07.1.454.CMB.1.raw
  modified_base (150)..(150): a, c, t, g, unknown or other
  misc_feature (150)..(150): n is a, c, g, or t
  modified_base (236)..(236): a, c, t, g, unknown or other
  misc_feature (236)..(236): n is a, c, g, or t
  modified_base (316)..(316): a, c, t, g, unknown or other
  misc_feature (316)..(316): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (452)..(452): a, c, t, g, unknown or other
  misc_feature (452)..(452): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccgtggtccagcctgggcggtccctgacactcgcctgtgttgcctctggatttcccttcaattttctattccatgcactgggtccncaggctccaggcaaggggctgagtgggtgcattatgcacatgatgggctacaaactaaattctacgactaaatttccggngacgggggcctattaccaacctatctacccaggacgacctaaattaaccgaaanaaccctaccctttanctgacaaatcgacagccctggaacaccgagacgacgacggtctgtactattatcgcgacgagacganacacaccgaactacgcgtacaagtactaggacggggtctttggtcggtcggggccgacggggtaccctgggttaccacgttccgtccgtaccccgcgtacccgtacccaacccggtaccggacccgtacgttcccggttacccgttacccccggtcgggtacccctcccgtaccgg

SEQ ID NO: 22935 - DNA, 567 bp, Homo sapiens
  misc_feature: GYAE6OF02G95AI.12.40.D07.1.454.CMB.1.raw
  modified_base (237)..(237): a, c, t, g, unknown or other
  misc_feature (237)..(237): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctggacactcgcctgtgttgcctctggatttcccttcaatttctattccatgcacgtcgggtccnccaggctccaggcaaggggctcgagtgggtgcacttattgcacatgatggcgtcaaacaaattctacgcaaaattccgtggtaggggccattcgaccatctaccagagacaagttacaagaacacccttatctagacaaatacgacagcctagacgaccagacgacacggctgtactatattgcgtcgagagagacacgacgaacctacgacggaccaatacgtagtcggggtcttggttcgtcgggccgaagggcctggtacagtcgtctcccgcgccctaccgaccgacggccacgtccggtaccctcccgtacggtccgcccgtacg

SEQ ID NO: 22936 - DNA, 655 bp, Homo sapiens
  misc_feature: GYAE6OF02JK6QB.12.40.D07.1.454.CMB.1.raw
  modified_base (276)..(276): a, c, t, g, unknown or other
  misc_feature (276)..(276): n is a, c, g, or t
  modified_base (315)..(315): a, c, t, g, unknown or other
  misc_feature (315)..(315): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtgggagtcgtggggggagccggtggtccagcctgggcggtccctgacactcgcctgtgttgcctctggatttcccttcaatttctattccatgcactgggtccgccaggcctccaggcaaggggctcgaggtggtgcacttntgcacatgatggcgtcaacaattctacgacaaattccgngacggggccattccaccatcctccagagacaattacaaagaaccctacctttanctagactaaanacacagtcctgacgaccagaccgacacgctagtctattattcgacgtcgagagacggacacgaacgaaccctacgtcgaccaagtacgtaagtcggggtacttcgttacggtcggggacccgtacgggggacccttcgggtaccgtaacgttccggttacccgtcccccgtaacgggtccccctaacccggtaaccccggaaccgggtacccccctaacgttcccgggttccccccgtttccccccggtacgggtccccgtcccccgttacccgg

SEQ ID NO: 22937 - DNA, 793 bp, Homo sapiens
  misc_feature: GYAE6OF02HE8L1.12.40.D07.1.454.CMB.1.raw
  modified_base (398)..(398): a, c, t, g, unknown or other
  misc_feature (398)..(398): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctctggtactttcccttcaatttctattccatgcactgggtccgccaggctccaggcaagggctcgagtgggtgcacttatgcacatgatggcgtacaaataaattctaacgactaaacgtttccggtaggacgggggcctatttaccgacctatcctacccgaagaacgactaaacttaacgaaacgtaacctacccttttancctagaactaaaagtacgacagtacccgtagaacgaaccgacggacgtaacccgacggtaccttacggttaacgtttaactttaacggtttcggacggtacgaagggtaacggaaacggaacccgaaaccgtaaacccggtaaacccttaccggtaacggtaaccgaaacgtttaaccgttaacgggtacggggggttaccttttcgggttaccgggtaccgggggtacccggggtaaccgggggtaaccccgttggggtacctaccgttacccgggttaccctaccccggtaccgtaccccgttacccggaaacccggaacccgggtacccccgtaggttacccccggttccccgtttaccccccggtcgggttccccgtaccccggttcccgg

SEQ ID NO: 22938 - DNA, 778 bp, Homo sapiens
  misc_feature: GYAE6OF02H41BN.12.40.D07.1.454.CMB.1.raw
  modified_base (178)..(178): a, c, t, g, unknown or other
  misc_feature (178)..(178): n is a, c, g, or t
  modified_base (301)..(301): a, c, t, g, unknown or other
  misc_feature (301)..(301): n is a, c, g, or t
  modified_base (424)..(424): a, c, t, g, unknown or other
  misc_feature (424)..(424): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggcacctggtggagtcgtgggggagccgtggtccagccgtgggcggtcctgacnctcgcctgtgttgcctctggtactttccttctaattttctatttccagtcgcacgtgggtccgccaggctcgaggacgaaggggctcggaggtggggtcgactacttatcgacacgtagtagngtcggcgtacaacgtaattcgtaacgacttaacgttcccggtaggacgggcctacgttcaccgtacgtcctaccgaaggtacgtaactaacttaacgaaacggtaaaccttacccgttttaanccgttaggaaccttaaacgacgacgtacggtaccgtaagaacggtaacccgaggacccgtaacgtaccggtacttacggtacttacgttagttacgacgacggtagagtaacgacgtaaccgaacgtaaccctacgtacggacctaagttacgttacggtcgggtacgtttacggttcggacggggtcccgttaacggggacccgttagggttaccgtaccgttaccgttccccgtaaccccggtaacgttcccccttaaccggaacccggttaaacccggttacccgttaacccggttccccggtttacccccgttacccccggtacgggttaccccgtacccggttacccgg

SEQ ID NO: 22939 - DNA, 616 bp, Homo sapiens
  misc_feature: GYAE6OF02GE0CT.12.40.D07.1.454.CMB.1.raw
  modified_base (150)..(150): a, c, t, g, unknown or other
  misc_feature (150)..(150): n is a, c, g, or t
  modified_base (234)..(234): a, c, t, g, unknown or other
  misc_feature (234)..(234): n is a, c, g, or t
  modified_base (374)..(374): a, c, t, g, unknown or other
  misc_feature (374)..(374): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccgtggtccagcctgggcggtccctgacactcgcctgtgttgcctctggatttcccttcaatttcattccatgcactgggtccncaggctccaggcaaggggctcggtagtgggtgcacttatgcacatgatggcgtcaaactaaattctacgctaaattccggtggacggggccaatttccaccatcctccagtagacaattacaaacgaacctaccctttanctagactaaaatagacaagcctagacgaccagacgacacggctgtctattatcgacgcgagagacgacaacgaccgaacctacgacgaccaatactaggtggggtcttcgttcgtcgggtccgagggtaccctgggtaccgtacgttccgtcccgtaccccgcgtacccctacccgaacccgtaaccgggcccctacgttacccgggttcccttacccccggtcggccccgtccccgtccgg

SEQ ID NO: 22940 - DNA, 697 bp, Homo sapiens
  misc_feature: GYAE6OF02HKPQX.12.40.D07.1.454.CMB.1.raw
  modified_base (213)..(213): a, c, t, g, unknown or other
  misc_feature (213)..(213): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
  modified_base (449)..(449): a, c, t, g, unknown or other
  misc_feature (449)..(449): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcgtccctgacactcgcctgtgttgcctctggtacttttcccttanaattttctattccatgccacgtcgggtccgaccagggcctccgaggaccgtaaggggctacggaggtggggtcggcctactttagttcggccaactatgatggctacaaactaattcacggactaattccggaggacgggcctattcaccatctccaaganacaatacgaaanaacctacctttanctagacctaaanacgacgagacctgaacggactacggaccgacgaccggnttacgtacttaattagttgacgtacgaagagacgaccaaccacgtaacctaccgtacgaaccaagtacgtagggttcggggtacttcggttccggtaccggggtaccgtaacgggggtaccctaggggtctagttccccgtaccgtacccccggtcgtaccccgtacccgaacccggtaaccggggccccctacggttcccccggttaccccttcccccgggttccggaccccggtcccgttacccgg

SEQ ID NO: 22941 - DNA, 689 bp, Homo sapiens
  misc_feature: GYAE6OF02FP7JR.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtgggtggcacttattgcacatgatggcgtacaaactaaattctaacgcaaattccggtggaggggccattccaccatcctaccagagacaattaacaagaacctaaccctttatctagacaaaatacgaacacgtacctagacgacccaaggaaccgacgaacggctagttacttaatttacgttaggccgacggaggagacgacaaccaaccgtaaaccctacgtacgaccctaaataacgttaggtaggggggtacctttcggtttaccggtcgggggtacccgtaacggggggtaccccttcgggttaccgtacgttcccgttacccgtcccccgtaacggtcccttaccccgaacccgtaaccggggtcccccacggttcccgggttccccttaccccccggtcgggccccgtccccgtacccgg

SEQ ID NO: 22942 - DNA, 783 bp, Homo sapiens
  misc_feature: GYAE6OF02FFMZF.12.40.D07.1.454.CMB.1.raw
  modified_base (93)..(93): a, c, t, g, unknown or other
  misc_feature (93)..(93): n is a, c, g, or t
  modified_base (149)..(149): a, c, t, g, unknown or other
  misc_feature (149)..(149): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
tcagatacgacgtacacgaccggtgctcgatttagtgatagagcgtaacaacaggggactcaccatggagtttgggctgagctgggttttccncgttgctcttttaagaggtgtccagtgtcaggggcacctggtggagtctggggganccgtggtccagcctggggcgtccctgacactcgcctgtgtncnctgnttccttcattctatcatgcactggtccgccaggctccaggacgagggcgtcgaggtgggtgcactttattgcacagttgattggcgtacaaacgaaaatttctaccgacgtaaatttccgtggagggggtaccgtattccaccgaattcctacccgaaggaacgaactaaagtttaaccaaacggaacctaacccctttttataccgtggaacctaaactaaggacccgaggtaccctaggaacgaacccaggaaccgacgaaccggggtcttacgtacctttaagtttaacgtttcggaccggtagtaacggaacggtaagaacccgacgaaacccggtaaaccctttaacgaccgggtactaaaccgttaacgttaggttacggggggtcgtttacggtttaccggttacgggggacccggtaacggggggtaacccttcgggttaccgtaaccgttacccggtttaccccgccccgaacggttaccccgacccgtaaccccggaacgggtacccccgttacgtaccgggttttcccccggtttaccccccgtgggaccccggtacccccgttacggtaccccgg

SEQ ID NO: 22943 - DNA, 749 bp, Homo sapiens
  misc_feature: GYAE6OF02JLP8X.12.40.D07.1.454.CMB.1.raw
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (380)..(380): a, c, t, g, unknown or other
  misc_feature (380)..(380): n is a, c, g, or t
tcagatacgacgtacacgaccggtgctcgatttagtgatagagcgtaacaacagaggactcaccatggagtttgggctgagctgggttttcctcgttgctctttaagaggtgtccagtgtcaggggcacctggtggagtctgggggagccgtggtccagcctgggcggtcctgacactcgcctgtgttgcctctggatttcccttcaatttctattccatgcactgggtccgccaggctccaggcaaggggctcggagtggtgccacttattgcacntganggtcgtcaacaatctaaccgctaaatccggtgaacgggtccgacttacacccgatctacccagtaagaccaaattacaaacgtaacctacccttttaanactacgactaaaacttacggaaccaggtaccctagaaacggaccccaaggtaaccccgaacggtaccggtacccgttacggtttaaccgttactttaacgttacgtaccgggtacggtaacggaacgtaacgaaccgaaccgtaaccgtaaacccttaccgtaacggtacctaaaccgttaacgtaacgttacggggtacgtttcgttacggttacggggtccggtaacgggggtacccgtcgggttaccgtacgttacccgttaccgtcccccggtaacggtaccccctccggtaaccccgtaaccgggaccccgtacggttcccggttaccccgttcccccgtacgggtccctaccccggttcccgg

SEQ ID NO: 22944 - DNA, 845 bp, Homo sapiens
  misc_feature: GYAE6OF02GWOGJ.12.40.D07.1.454.CMB.1.raw
  modified_base (465)..(465): a, c, t, g, unknown or other
  misc_feature (465)..(465): n is a, c, g, or t
  modified_base (835)..(835): a, c, t, g, unknown or other
  misc_feature (835)..(835): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagccgtgggccgtccctgacactcgcctgtgttgcctcgtggtactttcccttactaattttctattccatgctacgtcgggtcccgccgaggtcctccgagggaccgaacgggggcctcgggaggttggggtcggaccttacgtttagttcgaccaacgtagttgagttcgggactacaaacgtaacttctaaccgactaaacgtttccggaggacggggtcctagttacccgaacctacgttccgaccgaaggaacgtaaactaaaactttaaccgaaacgttaaacccttaccccgttttaanccgttacgaaactaaaagttacgacctaacggtccgtaacggaaccgaaacccggtaacgaaccggtaaccgtaaccgggtacctttacggttaacctttaagttttacgtccggtacgaacggtaacggaacgaaccgaacctaaaccgaaccgttaaacccgttacgaccggaaccctaagttaacccggttaggggttccggggttacttttcgggttaccgggaccggggtaccgggtaccgggtaccgttacgggtaccttaccggttcccgtacccgtaccccgtaccggtaccccgtacccggaacccggtaccggtcccgttacccggttccccggttcccgttccccggaccggttccccncggttacccg

SEQ ID NO: 22945 - DNA, 589 bp, Homo sapiens
  misc_feature: GYAE6OF02G4CW2.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagccgtgggcggtccctgacactcgcctgtgttgcctctggatttcccttcaatttctattccatgcactgggtccgccaggctccaggcaagggggctcggagtgggtggcacttattgcacatgatggcgtcaacaaattctacgactaaattccggtgaagggggccgattcaccatctccagagacaacttacaagaacctaccctttaatctgacaaatacgaacagcctagacgaccagacgacacggctgtctattattcgcgcgagagacgacacacgaacctctcgacaatactagtggggtcttgttcgtcggggccgacggggaccctggtacctagtccgtcctccccgagtccctacccgaaccgaaccgggcccacgttccggttccccttcccccggtcggcccgtccctcgg

SEQ ID NO: 22946 - DNA, 656 bp, Homo sapiens
  misc_feature: GYAE6OF02GEOI8.12.40.D07.1.454.CMB.1.raw
  modified_base (638)..(638): a, c, t, g, unknown or other
  misc_feature (638)..(638): n is a, c, g, or t
tcagatacgacgtacacgaccggtgctcgatttagtgatagagcgtaacaacgagagggctcaccatggagtttgggctgagctgggttttcctcgttgctcttttaagaggtgtccagtgtcaggggcaccgtggtggagtctgggggagccgtggtccagcctgggccggtccctgacactcgcctggtgttgcctctggatttcccttcaatttctattccatgcactgggttcctcaggctccgaggcaaggggctcgaggttgggtgcacttatgacacatgatggacgtcaaacaattctacgactaaagttccgtgacgggggcctattccgacctagtcctaccagagaacaattacaacggaacctacccgtttaatctagtaccaaatacgacacgcctagacgaaccacgaacgacgacggactgtctattattgcgtcgaagagagtacaacaaccgaaccttacgtcgggacctaaagtaccgtaaggtcgggggtactttcgggttacggtcggggaccgtaacggggtacccttaggggtcctacgttccgtcccgtaccccgacggtccccttacccgaacccgaacgggcccttacggtcccggttacccgttcccccggnggtaccccgcccgtcccg

SEQ ID NO: 22947 - DNA, 788 bp, Homo sapiens
  misc_feature: GYAE6OF02IGIKX.12.40.D07.1.454.CMB.1.raw
  modified_base (399)..(399): a, c, t, g, unknown or other
  misc_feature (399)..(399): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagccgtgggcggtccctgacactcgcctgtgttgcctctggtatttcccttcaattttctattccatgctacgtgggtccgccaggctccgaggcgaacgggggctcggaggtggggtgctactttagttgccacatgatggcgtacaaactaattcctacgactaaacgttccggtggacggggctattccaccatcctaccgagaacgactaaattacaaagtaacctacccttttanctagaactaaaagtagaacacgtacctaggaacgaccaacggaccgacgaccggtctacgttacttagtttaagttcggaccgacggaagacggaactaaccgaaaccgtaaccgtaaacccgtacggtaaccggtacctaaaacgttacggttaacgggtcgggggttaccttttaccgggtttaccgggtaccggggggtaaccccggttaaccggggggtaaccccgttcgggttaaccgtaccggtttaccccggttcccgtaacccccggtacggtaacccccctaccccggaaacccggtaaccccggggtcccctaacgggtttcccccgggtttacccccgttccccccgggtaccgggtccccggtccccgttacccggg

SEQ ID NO: 22948 - DNA, 842 bp, Homo sapiens
  misc_feature: GYAE6OF02I4TC5.12.40.D07.1.454.CMB.1.raw
  modified_base (150)..(150): a, c, t, g, unknown or other
  misc_feature (150)..(150): n is a, c, g, or t
  modified_base (178)..(178): a, c, t, g, unknown or other
  misc_feature (178)..(178): n is a, c, g, or t
  modified_base (243)..(243): a, c, t, g, unknown or other
  misc_feature (243)..(243): n is a, c, g, or t
  modified_base (478)..(478): a, c, t, g, unknown or other
  misc_feature (478)..(478): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccgtggtccagcctgggcggtcctgacnctcgcctgtgttgcctctggtactttcccttcaattttctacttccatcgcacgttggggtcccnccaggcctaccgaggacgaagggggcctcggagggttggggtcggacctacgtttagttcggacccaactagttacggaagttcggggaccgttaacctaaaactaaaatttcccgtaacgacgttaaaacgtttcccgggtaaggggtaccgggggaccctacgtttaccaaccgtacttcctacccgaagacgaaccctaaagttaccaaacggtaacccttaccccttttancttacgaactaaaagtcggacaacgtcccgtaagaacggtaccaacggtacgaccgaacggtccttacgttacgtaagttttacgtacggacgtacggaaggtacggacgtaaccgaaccgaaacccgtaaccgttaaccgtccggtaaccctaacgttaccgtaacgggttcggggttacgtttacggttccgggttacggggacccggttaaccggggtaccgttcgggtaacctccggttacccggtaccccgttacccgtaacccggtccctaccccgggaacccgtaaccccgggtccgtacccggtttccccggttccccgttaccccccggtgggttcccccgtcccgttaccccgg

SEQ ID NO: 22949 - DNA, 753 bp, Homo sapiens
  misc_feature: GYAE6OF02HJUN9.12.40.D07.1.454.CMB.1.raw
  modified_base (154)..(154): a, c, t, g, unknown or other
  misc_feature (154)..(154): n is a, c, g, or t
  modified_base (250)..(250): a, c, t, g, unknown or other
  misc_feature (250)..(250): n is a, c, g, or t
  modified_base (455)..(455): a, c, t, g, unknown or other
  misc_feature (455)..(455): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcaccgtggtggagtcgtggggggacnccgtggtccagccgtgggcggtccctgacactcgcctgtgttgcctcgtggtactttcccttactaatttctattccatcggctacgtcgggtccnccgaggtcctccgagggcgaacggggtctcggaggttggggtacggctacgtttatgacctaacgagtgagttcggactaaccaaaacgtaaatttccgtaacggactaaacgtttccggtagggaaccgggtcctaattccaaccaagttcctaccgaaggtaacaactaaacgttaacgaaacgtaaccctacccgttttaanacgtacgaacctaaaagtacgtacacgtacgtagaacgtaaccgaagacccgacgacgtctacgttacttaacttagttacggacgacgaaggtacgacgaacgtaaccgtaacgtaccgtaacgtcggaactaacgttacgtaacgggtgggttacttcggttcggtacgggtaccgtacggggtacccgttcggacgtacgtcccgttaccgtacccgtacgacccgtaaccgaaccgaacggtcccgtaacggttcccgttaccccgttacccgtacggtccccggtcctaccgg

SEQ ID NO: 22950 - DNA, 842 bp, Homo sapiens
  misc_feature: GYAE6OF02H73KY.12.40.D07.1.454.CMB.1.raw
  modified_base (150)..(150): a, c, t, g, unknown or other
  misc_feature (150)..(150): n is a, c, g, or t
  modified_base (212)..(212): a, c, t, g, unknown or other
  misc_feature (212)..(212): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggancccgtggtccagccgtgggcggtccctgacactcgcctgtgttgcctctgtactttcccttnaatttctattccatgcactgggtccgccaggcctccgaggcgaagggggctacggaggtggggtagctacgtttagttcgacaacattaggattcgggtacgtaccaaacgtaaaatttccaaacgtacctaaaatttcccggtaggacgggggaccctagtttccaccctacttacctccgaagtaacgtaactaaacttaacaaacgtaaccttaaccctttaatcccgtagaacctaaaacgtaacgaacctaccgtacccgtaagggaacgaaaccccggaaggtaacccccggaaacgaccgggtaccctttaaggtttaccttttaaacgtttaacgtttcgggaccgggaccggttaaaggaacgggaaacgtaaccgaaacccgtaaacccggtaaaccctaacgttaccgggaaaccctaaagttaacccggtttagggtaccggggttccgtttacgggttcgggtaccgggggacccgtaccggggtaaccgttacgggtactacgttaccgttcccgaccccgtagtaccccgttacccgaaacccggttaaccggaccccgttacggtttcccggttaccccctttacccccgggtcggtccccgtacccgtcccgg

SEQ ID NO: 22951 - DNA, 572 bp, Homo sapiens
  misc_feature: GYAE6OF02FRYD3.12.40.D07.1.454.CMB.1.raw
  modified_base (444)..(444): a, c, t, g, unknown or other
  misc_feature (444)..(444): n is a, c, g, or t
tcagatacgacgtacacgaccggtgctcgatttagtgatagagcgtaacacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaattttctattccatgcactgggtccgccaggctccaggcaaggggctcggagtgggtggcacttatgcacatgatggcgtcaaacaaattctacgacaaattccgtgaggggccgaattcgaccatctccgagagaacaattaacaagaactacccttatctagacaaatagacagcctgacgaccagacgacacggctgtctattattgcgcgagagagacacaccaacctacngaccaatactagtaggggctttgttcgtgggccgaacgggtacctcgtctacgtcgtccgtacccgtcgccctaccgaaccgaccggacccacggtccgttcccttccccgtcggcccgtcccgtccg

SEQ ID NO: 22952 - DNA, 703 bp, Homo sapiens
  misc_feature: GYAE6OF02F2AJF.12.40.D07.1.454.CMB.1.raw
  modified_base (149)..(149): a, c, t, g, unknown or other
  misc_feature (149)..(149): n is a, c, g, or t
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
tcagatacgacgtacacgaccggtgctcgatttagtgatagagcgtaacaacagagggctcaccatggagtttgggctgagctgggttttcctcgttgctctttaagaggtgtccagtgtcaggggcacctggtggagtctgggggganccatggtccagccgtgggccggtccctgaccactcgcctgtgttgcctntggatttcccttnaatttctattccattgcacgtgggtccgccaggcctccgaggcaaggggctcgaggtgggtggccacttatgcacattgagtggacttacaactaaattctaacgactaaacttccggtaggcgggccgtattccacctactctccaagacgaactaattaaccgaaagtaaaccctacccttttaagtccttaagactaaaaacgtacgaactacgacccttaggacgtaacccgacgaaccgtaccgaaccggtcgttacgttaccttagttaagttcgaccggtaacggtaaggaacgacgaacccgtaccgaacgaaacctacgtacggaccttaaatacgtacggttggggtacgtttgtccggtcgggaccgtaccgggacgtaccggtcctcgtcccggtcctccccgtaccgtacccctaccccgaaccgtaccgggacccctcgttacccgggttccccttccccggtaccggccccgtcccg

SEQ ID NO: 22953 - DNA, 839 bp, Homo sapiens
  misc_feature: GYAE6OF02I1IPZ.12.40.D07.1.454.CMB.1.raw
  modified_base (150)..(150): a, c, t, g, unknown or other
  misc_feature (150)..(150): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctctttttaagaggtgtccagtgtcaggggcacctggtggagtctggggganccgtggtccagcctgggcggtccctgacactcgcctgtgttncctntggatttccctnaatttctattccatcgcactgggtccnccaggcctccaggcaagggctcgagtgggcgcacttatgcacatgatggcgtcaaacaattctacgactaaaactttccggtaggagggggcccgtagtttacctaacccgacttccgtaccgtagaacgtaacctaaagtttaaaccaaaacggaaacccttaaccccttttaagtacctacgtaccaaaaagtaacggtaccaaacgtcccttaggaacgaaccccgaaggtaaccgaccgtaaccgggtaccgtttacgttaccgttaaacgtttacttaacggtaccgtccggtaaacggtaaacggaacggtaaacccggaaaccgaacccggttaaaaccccgttaaccgttaaccgggtaacccgtaaacgttaaaccgttaacggttcggggggttacctttaacggtttccgggttacgggggtacccggttaaccgggggtaacccgttacgggttaccgaaccggttcccggttcccgttaccccgtaaacccggccccgttacccggttaaacccgaacccgggttaccccgaccggttacccggttaccccgtttcccccccggtcggggtacccccttccccgtacccgg

SEQ ID NO: 22954 - DNA, 786 bp, Homo sapiens
  misc_feature: GYAE6OF02JZFWO.12.40.D07.1.454.CMB.1.raw
  modified_base (241)..(241): a, c, t, g, unknown or other
  misc_feature (241)..(241): n is a, c, g, or t
  modified_base (409)..(409): a, c, t, g, unknown or other
  misc_feature (409)..(409): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtggggggagccgtggtccagccgtgggcggtccctgacactcgcctgtgttgcctctggtactttcccttctaatttctattccatgcacgtgggtccncgaggctcagggcaggggctggaggtgggtgctacttatcgacactatgagtggacgtacaaactaattcctacgtactaaacgttccgaggacggggcctaattccaaccacttcctcgaacgacgaaacctaagttaaccaaacggtaaacccttaacccttttanacgttagaaccgtaaaatacggaaccgaagcccgtaaggaacccgaaccgaacggtaaccgaaccgtaccgggactacgttacgtttaacttagttacggacgtacgggaacgacggaaacgaacctaaccggaaacccgtaaccgtaaccgtaccggaacctaaattaacggtaacgggtcggggttacgtttcgggttacgggtcggggtacccgggtaaacggggtacccggttagggtacccacggttcccggttccctaccccggtaccgtaccccgttacccggaaacccgggtaacccggtccccgttaacgggttccccgtttaccccggtttacccccggccggggttccccgtaccccgtacccggg

SEQ ID NO: 22955 - DNA, 770 bp, Homo sapiens
  misc_feature: GYAE6OF02I0390.12.40.D07.1.454.CMB.1.raw
  modified_base (152)..(152): a, c, t, g, unknown or other
  misc_feature (152)..(152): n is a, c, g, or t
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (466)..(466): a, c, t, g, unknown or other
  misc_feature (466)..(466): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtgggggganccggtggtccagcctgggcggtccctgacactcgcctgtgttcgcctctggtactttcccttacaattttctacttcccatgcacgtcgggtccnccgaggcctccgagggcgaaggggctacggaggtcgggtgcacgtttatcgacacgatggatcgggcgtacctaaaanaaacgtttccaacgtactaaaacttcccgggtaggaaccgggggtccctaagtttaccaaaccctgttaccccgtaccaaggaccgtaaacctaaaagtttaaaccgaaaaccggtaaaaccctaccccggttttttaaanacgtagaaacctaaaagtacgacgaacgtccctaaggaacgaaccgacgtaaaccgaaccgtacggttaccgtattaacttaagtttacgtggaccggtaacgaagtaaccggaacgtaaccaaccgtaaccgtaaacctacgtaacgacgtaaacgttacgttacgggttcgggttacgttacggttccggtacggggaccgtaccgggtaccgtagtaccgtacgtccgttacccgtccgaaccgacccgtacgaaccgaccggtcctacggtcccgttccgtcccgacgtcccgtccgtcg

SEQ ID NO: 22956 - DNA, 743 bp, Homo sapiens
  misc_feature: GYAE6OF02IPYAD.12.40.D07.1.454.CMB.1.raw
  modified_base (234)..(234): a, c, t, g, unknown or other
  misc_feature (234)..(234): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
  modified_base (385)..(385): a, c, t, g, unknown or other
  misc_feature (385)..(385): n is a, c, g, or t
tcagatacgacgtacacgaccggtgctcgatttagtgatagagcgtaacaacaggggactcaccatggagtttgggctgagctgggtttcctcgttgctcttttaagaggtgtccagtgtcagggcacctggtggagtctggggagccgtggtccagcctgggcggtccctgacgactcgcctgtgttgcctctggatttccctcaatttctatttccatgcacgtcgggtccnccaggctccaggcaaggggcctcgaggtgggtgactacttatcgacanatggntggccgtanaaactaattccgacnctaaactccgtaggacgggtccgattcgacctatcctaccagtacgaactaaattacaagaacctaccgtttanctaagctaaaatcgactagacctgaacgaccgacgacgacacggtcgtacgtacttacgtaacgttcggaccagggtacgaaacggaccgtaaaccaaaccggacccgttaaacccgtacgtagggtaaccccgtaaattaacccggtaagggttccgggggttacctttaggggttaccccgggttaacgggggtccccggtaaacggggttacccgttacgggtaaccgttaccgtttcccgtacccgtaccccccgtaggtccccttaaccccgaaaccccggaaggtacccccggtaaccgtttcccgggtccccttccccggtccgggtcccgtaccccgtcggtaaccccgg

SEQ ID NO: 22957 - DNA, 610 bp, Homo sapiens
  misc_feature: GYAE6OF02G5QGJ.12.40.D07.1.454.CMB.1.raw
  modified_base (380)..(380): a, c, t, g, unknown or other
  misc_feature (380)..(380): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggactttcccttcaattttctattccatgcactgggtccgccaggcctccgagggccaagggggctcggaggtgggtggcacttattgcacatgatggcgtcaaacaaattcctaacggcaaattccgtggacggggccgattcaccatcctccagagacaattacaagagctaccctttanctcgacaaatagtaacacgcctgacgaccagacgacaccggtactcgtacttattattgcgcgagagacgacaccacgaacctacgtcgacaacttactacggtggggtcgttgttccggtcgggaccggtacgggacccgtacgtcgtacgtcgtccctcccgaccgccctcccgaaccgaaccggcccacgttcccggtcccttaccccggtccggtcccgtaccccg

SEQ ID NO: 22958 - DNA, 696 bp, Homo sapiens
  misc_feature: GYAE6OF02FSEOC.12.40.D07.1.454.CMB.1.raw
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccggtggtccagcctgggcggtccctgacactcgcctgtgttgcctctggactttcccttnaatttctattccatgcactgggtccnccaggcctccgaggcgaaggggctcggaggtgggtggctacttattgcacatgagtggctacaaactaaattcctaacggactaaaacgttcccggtaggacgggggcctacttcacctatcctccaagacgactaattaacaaacgtaaccttaccctttatcctagaactaaagtagacacgccctagaaccgaaccgaaggaacgaccgacggtcctcggttacttaacgtttaacgttcggcgacggaagaacgaacgaaccaaccgaaccgaaaccgtaccgtacggaacctaattaaccgtaggtcggggttactttaggttccggtacgggaccgaaccggggtaccgtggtacctacgttccgtccctcccgacgtccccgtacccgaaccggaaccggtcccgacgttcccggttacccgttcccccggtacggccccgtacctcccgg

SEQ ID NO: 22959 - DNA, 590 bp, Homo sapiens
  misc_feature: GYAE6OF02HDANT.12.40.D07.1.454.CMB.1.raw
  modified_base (413)..(413): a, c, t, g, unknown or other
  misc_feature (413)..(413): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtgcacttattgcacatgatggcgtcaataaattctacgcaaattccgtgacggggccattcaccatctccagagacaattacaagaaccaccgtttatctgacaaatacgacacgctagacaccagacgacacgctgtactattatgcgngagagacgacaccgacgaacctacgtacggacaactacgtagtcggggtactttggtcgtcggggaccgtacggggaccctggtactgtccgtcctaccccgcgtccctcccgaaccgtaccgggcccctacggttcccgggttacccttcccccgtacgggtcccgcccgtcccgg

SEQ ID NO: 22960 - DNA, 636 bp, Homo sapiens
  misc_feature: GYAE6OF02G9U6X.12.40.D07.1.454.CMB.1.raw
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtacaacaattctacgcaaattccgtgacggggccgattcacctatctaccgagacgacaaattacaagaacctaccttatctgaactaaananaacagcctagacaccagaacgacgacggctcgtcttaattattgcgacgagagagaccacacgaacctacgacggacctaataacgtaggtcggggtacttggttaccggtcggggaccgacggggtacccgtgggtacgtacgtcccgttacccgtacccgtaccgtcccgtacccgaacccgaaccggggtacccctaccggttcccgggttaccccgtttccccccggtccgggtaccccggtccccgtaccgg

SEQ ID NO: 22961 - DNA, 608 bp, Homo sapiens
  misc_feature: GYAE6OF02GK98B.12.40.D07.1.454.CMB.1.raw
  modified_base (339)..(339): a, c, t, g, unknown or other
  misc_feature (339)..(339): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattcacgctaaattccgtggaggggccattccaccatctccaganactaattacaaagaacctaccctttatctagacaaatagaacacgcctagacgaccaagaccgacacgctgtactattatgcgcgagagagaccacgaccgaacctacgcgaccaagtactaggtcggggtcttggttcgtcgggccggacgggtacccgtgggtctacgtccgttcccgtacccgacgccccttacccgaacccggtaaccgggtcccctaacggttcccggttccccttcccccggtcgggccccgtccccgtccgg

SEQ ID NO: 22962 - DNA, 749 bp, Homo sapiens
  misc_feature: GYAE6OF02I09K7.12.40.D07.1.454.CMB.1.raw
  modified_base (151)..(151): a, c, t, g, unknown or other
  misc_feature (151)..(151): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (309)..(309): a, c, t, g, unknown or other
  misc_feature (309)..(309): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtggtggagtcgtggggganccgtggtccagcctgggcgtccctgacactcgcctgtgttgcctctggtactttcccttanatttctattccatgactacgtgggtccncaggcctaccgaggcgaaggggtcctcgaggtgggtggcctaacttattcgcactatgatcggccgtanaaacgtaacttcaacgactaaacgtttccggtaggacggggaccctattccgaaccgtattccacccgaagaacgtaactaaaccttaacgaaactaaacccgttacccttttagccgtacgaaataaagttacggaccagtaccgtaggaactaacccgaacgggtacacccggtacgtaccgtttgtaaccttaagttttacgtacggtaccgacggtaagaagaccggtaaccaaacgaccctaacggtaccgtagaacccttaagtaacgtagggttcgggttctttaggtaccggacggggtacccgtaaccggggtcctggttacccgacgtccgttcccgtaccccgacgtcccgttacccgaaaccggtcccgggtaccgttaacccgttccgggttcccccttccccgggacgggtccccgaccgttccgg

SEQ ID NO: 22963 - DNA, 764 bp, Homo sapiens
  misc_feature: GYAE6OF02IJ1KE.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcagggggcacctggtggagtctggggggagccgtggtccagcctgggcggtccctgacactcgcctgtgttgcctctggactttcccttcaatttctattccatgcactgggtccgccaggctccaggcgaaggggctcgaggtgggtggctacttattgcaacatgagtggactacgaaacaaattcctaacgaccaaactttcccggtagggaacgggggacccgtacgtttaccaacccgtaatccgtacccaaggaacgaaccgtaaatttaaccaaacggtaaaccctaaccccgttttaatacccttcggaactaaaaagttacgaactacggtcctaagacgaaccctaaggaacccgaaccgaccggtcgtacgttacgttaactttagttcgtacggcgaaggacggaagaaccaaccgaaaccgtaaactaccgtacggaccaaactacgtaaggttcgggggtactttacgggttccggtacggggtacccggtaacggggacccgttacgggtaccgtaacccggttccttcccgtaccgccggtaccccgtacccgaacccggtaaccggtccctaccggttcccggttccccgttacccccggtacggttccccgaccccgttaccccg

SEQ ID NO: 22964 - DNA, 615 bp, Homo sapiens
  misc_feature: GYAE6OF02HT45L.12.40.D07.1.454.CMB.1.raw
  modified_base (346)..(346): a, c, t, g, unknown or other
  misc_feature (346)..(346): n is a, c, g, or t
  modified_base (385)..(385): a, c, t, g, unknown or other
  misc_feature (385)..(385): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtcgtggggggagccgtggtccagcctgggcggtccctgacactcgctgtgttgcctctggattttcccttcaatttcattccatgcacgtcgggtccgccaggcctccaggcgaaggggctcgagtggggtgctacttatgcacatgatggcgtacaaactaattctaacgactaaacgttccggtggacggggccattccaaccntctaccagacgaactaataacaagaaacctaccctttancctagactaaaatacgacagcctgggaacaccaagacgacgacgctgtacttattagttggcagagagaacacaaccgacgaaccgtacgtagaccctaatacgtaggtcggggttcttaggttcggtcggggacccgtaacggggccctggtacctagtccgtccaccccgtgccctaccgtaaccggaacggtcccacgttccggtcccgtccccgtggcccgcctcg

SEQ ID NO: 22965 - DNA, 881 bp, Homo sapiens
  misc_feature: GYAE6OF02G8RV0.12.40.D07.1.454.CMB.1.raw
  modified_base (149)..(149): a, c, t, g, unknown or other
  misc_feature (149)..(149): n is a, c, g, or t
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (284)..(284): a, c, t, g, unknown or other
  misc_feature (284)..(284): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcgtccctgacactcgcctgtgttgcctctggatttcccttnaattttctattccatgcacgtcgggtccncaggctccaggcaagggctcgaggtgggtgctacttattcgcacatgngtggcgtacaaacgtaacttactacgactaaacgttccggtagacgggggcctaagtttcccgaacctcgttaccttaccgaacgaagtaacctaaatttaaccaaacgtaaacccttaccccgtttaaatcgtacaacgtaaattacgtacgacgtaccgtagaacgaaccgaagaacccgaacgaccggtaccgttacgtttacctttaagtttacggttacgacggtacgtaagggaacgtaacgaccgtaaacccggtaaccgtaaacccgtaccgggtttaccgaaaacctttaacccgggttaaaccgttacgggggtttaacgggggttacccttttttacgggggttaaccggggttacccgggggaccccggggttaaaccccggggggtaaaccccgtttccggggttaacccgaaccggtttccccggtttacccccggtaacccccgttaacggtaccccccggtttaacccgaaaaccccccggggtaaccggggtaaccccccgtttaaccgggtttacccccgggtttcccccgttaacccccccgggttttcccggccccgggttaccccccgtttccggg

SEQ ID NO: 22966 - DNA, 883 bp, Homo sapiens
  misc_feature: GYAE6OF02HWDK7.12.40.D07.1.454.CMB.1.raw
tcagatacgacgtacacgaccggtgctcgatttagtgatagagcgtaacaacagaggactcaccatggagtttgggctgagctgggtttcctcgttgctcttttaagaggtgtccagtgtcaggggcacctggtggagtcgtggggggagccggtggtccagccgtgggcggtccctgacactcgcctgtgttcgcccttcgtgggtacttttccccttcaaactttttctactttacccattcgacctacggttcggggtcccgtcccgagggtcctcccgaaggggaccggaaaggggggtcctacgggtacgggtggggggttacggtccttaacgtttacgttacggaccgtaactagttacggaagtcggggtaccttaacaaaccgttaaaacttccgtaacgacttaaaaccgttcccggttagggaacggggtccctaagttacccaccggtactcccgtaacaggtacgaaacttaacctaacgaaaacgtaacccgtaaccccttttatacccgtgaaactaaacgtaggacctaacgtccctaggaaccaccaacggaccggtacacgggtctacggttactaaagtcttacggcgtaacggaacgacgtaaacgaccaaacccgtaaccgaaccgttaaccggtacggaacctaaacggtaacttacgggtacggggttacgtttacggttacggtaccgggggtaaccgtaccgggggtaacccttacgggtacctacggtaccccgttacccgtaccccccggtaacgtacccccgtacccgaacccggtaacccgggtaacccccttacggttaccccggtttccccgttaccccccggtaccggttccccggtacccgttacccggg

SEQ ID NO: 22967 - DNA, 949 bp, Homo sapiens
  misc_feature: GYAE6OF02ITAVP.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtgggggagccgtggtccagcctgggcggtccctgacactcgcctgtgttcgcctcgtggtactttccccttacaaattttctactttccaattcgcctacgttcggggtcccgccaagggtcctcccgaaggggccgtaaacggggggccttcggaagggttgggggtcgggacctaaaccgttttagtttcggaccaacgtaagttggaacgttgggaccgttacctaaaaacaaaagtttcccgtaaacggactaaaacgtttcccggtagggacgggggtaccctaactttaccgaaccttagttacccgtacccgaaaggacggtaaacctaaacgtttaaaccgaaaacggtaaaacccttacccctttttaagaccgttaacggtaaacctaaaaattaaccggaactaaccgggtaccccttaagggaaccggtaaaccccgaaaggtaacccggtaacgaaacccgggtcttacggtttaacccgttaaagttttaacgtttacggaccggtaaccggtaacggaagggaacgaacccgtaaaccgtaaacccggtaacccttaaccggtacgggtaacctaaaacggtttaacgtaacgggttacgggggttacctttaacgggtttccggtacggggggacccgtaaccgggggtacccgttacggtaccgtacgttacccggttaccctaccccggtaacggtacccgttacccgaaaccggtaacccggaccccgttaaccgggttcccgttacccgtttccccccgggtacggtaccccgtacccgttacccgg

SEQ ID NO: 22968 - DNA, 731 bp, Homo sapiens
  misc_feature: GYAE6OF02GGRFF.12.40.D07.1.454.CMB.1.raw
  modified_base (240)..(240): a, c, t, g, unknown or other
  misc_feature (240)..(240): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctgggtggagtcgtgggggagccgtggtccagcctgggcggtccctgacactcgcctgtgttgcctctggatttcccttcaattttctattccatgcacgtcgggtccnccaggctccgaggcaaggggctcggaggtgggtgctacttatgcacatgatggcgtacaactaattctacgactaaacttccggaggacggggtccagttaccaccgtactcctacgaagtacgaactaaacttaacaaacgtaactattcctttaatcgtagaactaaagtacgaactacgtcctagaacgaccgaagaccgaacgtacggtctacggttacttaattagtcggacgtacggaagtacggaacgaaccgtaaccgaacccgtaaaccgttaccgtacggtaacctaaaggttaaccggttagggtttacggggtaccgttttacgggtttcgggacgggggtacccggtaccggggttaacccggtgttaccggtacgttcccggtacccgttccccgaaccgttcccgtacccgtaacccggaaccggtcccgtacggttccccggttcccgttacccccggtcgggacccctccccgg

SEQ ID NO: 22969 - DNA, 852 bp, Homo sapiens
  misc_feature: GYAE6OF02JAYHX.12.40.D07.1.454.CMB.1.raw
  modified_base (240)..(240): a, c, t, g, unknown or other
  misc_feature (240)..(240): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccggtggtccagcctgggcggtccctgacactcgcctgtgttgcctctggtactttccttcaatttctattccatgctactcgggtccnccaggcctccgaggcgaaggggctcgaggtgggtgcacttagtgcacatgagtggcgtacaaactaaattctacgataaacttccggtagggacgggggtccctaatttcccgaacccattaccgtcccgaaagggtacgtaacctaaacgttaaaccgaaactaaacccgttaaccccttttaatcctacggtaacctaaaaattacggtaactagtacccgtaggtaacgaaccccaagggtaaccgtaccgaacggggtcctttaccggttaactttaaacttttacggttacggacgggtaccggaaaggtaacgacggtaaacccaacgtaaacccggtaaccgttaacgtacgaaaccctaacgtttaaccggtaacgggttcgggggtaccttttacggggttacccgggtcggggggtaccccggtaaggggggttacccccttcggggtaaccttaaccggttcccgttaacccggtccccccgttaagggtcccccttaaccccgggtaaaccccggaaaccggggtcccccttaaccgggttcccgggtttaccccccgtttcccccggaccggggttaccccggtcccccggttaccggg

SEQ ID NO: 22970 - DNA, 850 bp, Homo sapiens
  misc_feature: GYAE6OF02HOWYW.12.40.D07.1.454.CMB.1.raw
  modified_base (236)..(236): a, c, t, g, unknown or other
  misc_feature (236)..(236): n is a, c, g, or t
tcagatacgacgtacacgaccggtgctcgatttagtgatagagcgtaacaacagagggctcaccatggagttgggctgagctgggttttcctcgttgctcttttaagaggtgtccagtgtcaggggcaccgtggtggaggtcgtggggggacgccggtggtcccaggtccgtggggccggtccctagaccactccggccttggtcgttcggccttacgtggtacttttccccttanaattttctactttccagtcgcctacgttcggggtcccgccagggtcctaccgagggtaccgaaggggccttacggaggtgggggtggacctaagtttattcggaccaagtagttgaaggtcgggccgttaaccgaaaataaacgtttccaaccggtaccaaaaagtttcccggtagggaacgggggtccctaatttaccgaacctacgttcctaccgaaaggtacgtaacctaaaattaaccgaaacgaaaacccctacccgtttttaaactccgtaaggaaaccctaaaaagttacgaaactcggaacccttagaaacgggaacccgaaagtacccggtaacggaccggaccttaggtacctttagtaacgttcgcggtacgaggtaacgaaggaccaaaccgaaacccgtaacttaccgtacgaaccgtaaacgtaacgtaacggtacgggggttcttacggttacgggtacgggggacccgaccggggggttaccacgggttaccacgtcccggttccctaccccggtaggtccctacccggtaaccggaacccggtcccttaccggcccggtttccccgtaccccgggttcgaccccggttccacccggg

SEQ ID NO: 22971 - DNA, 901 bp, Homo sapiens
  misc_feature: GYAE6OF02GZBC1.12.40.D07.1.454.CMB.1.raw
  modified_base (248)..(248): a, c, t, g, unknown or other
  misc_feature (248)..(248): n is a, c, g, or t
tcagatacgacgtacacgaccggtgctcgatttagtgatagagcgtaacaacagagggctcaccatggagtttgggctgagcttgggttttcctcgttgctcttttaagaggtgtccagtgtcgaggggcaccgtggtggagtcgtgggggagccgtggtccagccgtgggccggtccctgacactcgcctgtgttgccttctggtactttcccttctaattttctattccatgctacgtcgggtccnccgacggcctccgaggcgaaggggctcggaggttgggtcggctacgtttattcgcacagtgagttggcgtacaaactaaattctaaccgactaaacgttccggtaggacgggggacccgtattaccgaaccctagttcccgtaccgaagaacgtaaactaaaactttaaccgaaacgtaaacccttacccttttaatccgttaacgaactaaaagttacgaaccgtacgtacccgttaggaaaccgtaaccgaacggaaccggtaccgaaccggtcttacgtttaactttaacgtttaacgttcggaccggaccggtaaaggaacgaacgtaaacccgaaccgtaaaccgtaacccgttacgtaccgggtaaccctaaacgtttaacgtacggggttacggggttacttttacgggtaccgggttaccgggggtaacccgaaaccggggggtttacccccgttagggttacccgtaaccggtttaccccggttaccccccgttaacccccggtaacccggtcccccggttaaaccccccgtaaacccggggttaacccgggtaccccccgtttaaccgggtttcccccgggttttaccccccggtttacccccccggttaccgggggtccccccgttcccccgttaccccggg

SEQ ID NO: 22972 - DNA, 775 bp, Homo sapiens
  misc_feature: GYAE6OF02G5XE6.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggactttcccttcaatttctattccatgcacgtgggtcccgccaggcctccgagggcgaaggggcctcggaggtgggtggcactttatgcacatgatcggcgtacaaacgtaaattccgtaacgactaaaacgtttcccggtagggaacggggggacccttatttccgaacccctaagttccctacccgaagaacgaaacctaactttaaaccaaaacggaaacccttaccccttttaatcgtacgaactaaaagtacgaactaacggcccttaaggaaccgtaacccgtaacggaacccggtaacgaccggggtaccttacggtttaccgttaaacgtttaacgtttcgggaccgggtacggaacggaagaaccggaccaaacgaacccgtaaacccgtacgtacgaacccaagttaactaagggtcggggtcgttacggttacgggtacgggtacccggacgggggtaccctcgggtaccgtacgtccggttacctaccccgacgtccccgtaccgaacccggaccggtacccgtacgttccggtacccgttcccccgtcggtacccggccccttcg

SEQ ID NO: 22973 - DNA, 777 bp, Homo sapiens
  misc_feature: GYAE6OF02HO1AT.12.40.D07.1.454.CMB.1.raw
  modified_base (152)..(152): a, c, t, g, unknown or other
  misc_feature (152)..(152): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (710)..(710): a, c, t, g, unknown or other
  misc_feature (710)..(710): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcacctggtggagtcgtgggggganccgtggtccagcctgggccggtccctgacactcgcctgtgttgcctctggtactttcccttactaattttctactttcccagttcgctacgttcggggtccccgccgacggcctaccgaggaccgaagggggtctcgggaggtggggtgacctactttagttgaccaactagtgaagtggtccgtaacaaaaccttaaatttccgtaaccgaacctaaagtttccccggtaggggaaccgggggaccctatttacccaacctacttccctaccgaagacggtaaacctaagttaaccgaaacgtaaccctacccttttanacgtccgaanaaagttaacgacgtacgcctaaggaacgaaccgaacggtaaccgaaccgacggtacttacgtacttatttacgtcgacggacggtaagaacgacgtaaacccgaaccgtaaccgtaaaccttacggtaccgtaactaaaccgttggttacgggtacgggtctttacgggtcgggtccgggtaaccgggtccggggtacctgggtacctcgttcccgtaccctacccgnttcccccgtacgaaccgaccggtacctcgtccggttaccccttccccggacgtcccgaccccgtcgg

SEQ ID NO: 22974 - DNA, 740 bp, Homo sapiens
  misc_feature: GYAE6OF02ITRS0.12.40.D07.1.454.CMB.1.raw
  modified_base (473)..(473): a, c, t, g, unknown or other
  misc_feature (473)..(473): n is a, c, g, or t
  modified_base (538)..(538): a, c, t, g, unknown or other
  misc_feature (538)..(538): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtggtggagtcgtggggggacgtccggtggtccagccgtgggcgtccctgacactcgccttgtgtgcctcgtggtatttcccttataatttctattccatcgcacgtcgggtccacgacggtctccgaggaccgaaggggtcctcggaggtgggtcgctacgttattggacactagtacgtaggtcgtactaacaaaacttaacgttaccaacgtactaaacgtttccgggtaagggaccggggacctaattaccactactaccgtaccgaaggtaacaactaattaaacgaacgtaaccttaacctttagcctagaaacctaaagtacgaacagtaccganaacgtaacgacggtaccgacgaacggtctagtacttaagttacggcgagtaccgaaggtacgaanaaccgtaccgaaacgtacccttaacgccgaaaccgtaaagttacggtagggtttacggggtctttacgggtacgggtcccgggaacggggtaacccggtaacggttcggaatccgttaccgccccgtacccgtgtaccccgtacggaaccgaccgtaccgtaaccggtcggaaccgccggtaaccacggtacgggaccccgg

SEQ ID NO: 22975 - DNA, 603 bp, Homo sapiens
  misc_feature: GYAE6OF02FWCGL.12.40.D07.1.454.CMB.1.raw
  modified_base (149)..(149): a, c, t, g, unknown or other
  misc_feature (149)..(149): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (370)..(370): a, c, t, g, unknown or other
  misc_feature (370)..(370): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcggtccctgacactcgcctgtgttgcctctggactttcccttnaatttctattccatgcactgggtccnccaggctccaggcaagggctcgagtggtggcacttatgcacatgatggctacaactaaattcacgcaaattccgtggacggggtccattccacctgtctccaagacgtacaattacaaagaacctacccttttanctacgacaaatacgacagcctgaacgaccagacgacgacggctagtactattattagcgacgagagacgacaacgaccgaacctactcgaccaactacgtagtacggggtcttggtcgtcggggccgtacgggtaccgtggtactacgtccgtcctacccgtagtcccctacccgaacccgaacggtccctacgtccggttaccccgttaccccgtcggtcccgcccgtaccg

SEQ ID NO: 22976 - DNA, 1144 bp, Homo sapiens
  misc_feature: GYAE6OF02GZ3XL.12.40.D07.1.454.CMB.1.raw
  modified_base (244)..(244): a, c, t, g, unknown or other
  misc_feature (244)..(244): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtcgtggggggagccgtggtccagccgtgggccggtccctgacactcgcctgtgttgcctctggtatttccctctaatttctattccatgctacgtcgggtcccnccaggcctccgagggacgaagggggtcctcggaggttggggtcggtacctaacgttttaagttcggacctaaccgtaagtttggaacgttcgggggtacccggttaaaccaaaaaccttaaaaaacgttttcccgttaaaccggtaaacccttaaaaaaccggtttttccccggggtagggggtaaacccgggggggtaccccggttaacgtttttaccccgaaaccccgtaacttaccccgttaacccggaaaacgggtaacggttaaaaaccctaaaaagtttttaaaaccccggaaaaaacggttaaaacccccttttaaacccccctttttaaacgtaccgttaaccggtaaaacctaaaaaacgttaaaccggtaaaccgtaaccgggtaaccccgtaacggggtaaacccggaaacccgtaaaaccgggaaacccggtaaccggaacccgggttaccgtttaccggttttaccttaaacgttttacggtttaaccggacccggtaacggggtaaacggaaacgggtaaacccggaacccgtaaaaccggtaaacccccgtaaaacccgttaacccgggtaacggttaaacccccgttaaaacgttaacccgggttaaacggggtttaccgggggggttaccgtttttaccggggtttcccggggttaccggggggtaaccccgggggtaaccggggggttacccccggttaggggttacccgttaaccggttacccgggttcccccgttaacccccgggtacccggttaccccccgttaaccccggtaaaccccgggtaaccccggggttaccccgttaccgggtttcccccggggtttaccccccgtttccccccgggttacccggggtcccccgttcccccggttacccggg

SEQ ID NO: 22977 - DNA, 722 bp, Homo sapiens
  misc_feature: GYAE6OF02HABTW.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcgaggggcacctggtggagtcgtgggggagccgtggtccagcctgggccggtccctgacactcgcctgtgttgcctctggtactttcccttctaattttctattccatcgcacgttcggggtcccgccgaggcctccgagggccgaagggggcctcggaggtggggtcggcctaacgtttagttcgaccacagtgagttgggccgttacaaaactaacttctaaccggactaaaacgttttcccggtgggacgggggtcccgtactttaccgacccgtaattccctaccgaagacgaactaaacgttaaccaaacgtaaacccttaccctttatctagaactaaatacgaacacgtcctagaacgaccagaccgacgacgtactgttactagttgttacgcgacgacgagacgacaacgaaccgtaacctacgacgacctaactacgtaggtacggggtcgttcggttcggtcgggaccggtacggggtaccctcggtacgtacgttcccgtccgttaccccgcgtccctacccgaaccgtaccggtacccgtaccgttccgggttccccttccccggtcggtaccccgtcccgtacccgg

SEQ ID NO: 22978 - DNA, 643 bp, Homo sapiens
  misc_feature: GYAE6OF02IN50D.12.40.D07.1.454.CMB.1.raw
  modified_base (152)..(152): a, c, t, g, unknown or other
  misc_feature (152)..(152): n is a, c, g, or t
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
  modified_base (386)..(386): a, c, t, g, unknown or other
  misc_feature (386)..(386): n is a, c, g, or t
  modified_base (452)..(452): a, c, t, g, unknown or other
  misc_feature (452)..(452): n is a, c, g, or t
tcagatacgacgtacacgaccggtgctcgattttagtgatagagcgtaacaacagaggactcaccatggagtttgggctgagctgggttttcctcgttgcttcttttaagaggtgtccagtgtcaggggcacctggtggagtctgggggganccgtggtccagcctgggcggtccctgacactcgcctgtgttgcctntggactttccttcaattttctattccatgcactgggtccnccaggcctccaggcaaggggctcggaggtgggtgctacttntgcacatgatggcctacaaactaactttcaacgactaaacgttccggtggaacggggcctaattccaccatcctaccagacgactaatacaacgtaactacctttanctagacaaatacgacagcctaggacgtaccagaccgacgacggcttactacttattagtagtacgngaggaacagacaacaacaacctacgtacgactaatacgtaggtcggggtctttacggtcggtacggggacccgtaggggtacccttgggtacctactcccggtccctaccccgtacgtaccccgtaccgaacccgtaccggacccttacggtttcccggtaccctttccccgtcggtcccggccgtccccg

SEQ ID NO: 22979 - DNA, 740 bp, Homo sapiens
  misc_feature: GYAE6OF02IQBHE.12.40.D07.1.454.CMB.1.raw
  modified_base (720)..(720): a, c, t, g, unknown or other
  misc_feature (720)..(720): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagcctgggcgtccctgacactcgcctgtgttgcctctggtactttcccttctaattttctattccatgctacgtcgggtccgacaggcctccgaggcgaaggggtctcggaggtgggtcgctacttattgacacatgagtggcgtacaaactaattctaacgactaaacgttccggtaggacggggtaccctagtttaccaaccgtactcccgttaccgaaggtactaaaccttaaagttaaaccaaacggtaaacccttaacccgttttactaccgtagtaacctaaaagttacgacgtaacgtcccgttaagaaccgaccgaagaaccgaccgaacggtcgttacgttacgtaagtttacgttcgacgtacgaagagacgaccgtaacaccgtaacgtacgtacgaacctaacgtacgtacgggtacgggtcgtttacggttacggtcggggtaccgtaacggggtaccctggtaccgtccgtaccggttacctccccgacggtccctaccggaacccgtaacggacccctacggttcccggttacccgttcccccggnggtccccgtacccggttacg

SEQ ID NO: 22980 - DNA, 866 bp, Homo sapiens
  misc_feature: GYAE6OF02GSCTN.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcaccgtggtggagtcgtggggggagccgtggtccagccgtgggcgtccctgacactcgcctgtgttgcctctggtactttcccttctaattttctattccatcgctacgtcgggtccgccaggcctccgaggcgaaggggctcggaggtgggtcgctacttatgcacatgatggctacaataattcacgactaaacttccggtaggacgggggacctagttaccaaccctatcctaccgaagacgaacctaaaatttaccgaaacgtaaacccttacccgttttaatccgtacgaactaaaacgtacggaacctacggtcccttaaggaaccgtaacccgaaggtaacccgaaccggtaaccggtccgttaggtttaaccttaagttttacgttccgggaccgtacgggaaaggtaccggacgaaacccgtaaccgtaaacccgtaaacccgttaccgtaaccgggtaaccccttaaagttacccggtaaggggttaccgggggttcccttttagggtttacccggggaccgggggttaccccgggtaacgggggttaccccctttaggggttacctacccggtttacccggtaccccttaacccccgggtacggtcccccgttaaacccccggtaacccggtaaacccggggtcccccgtttaaccgttccccccgggggtttacccctttacccccccccgggtacgggtaccccccgttaccccgggttaccccgg

SEQ ID NO: 22981 - DNA, 776 bp, Homo sapiens
  misc_feature: GYAE6OF02IEMDA.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtactttcccttctaattttctattccatgcacgtgggtccgcacggctccgaggcaaggggctcgaggtgggtgcacttattgacactagtgagtggcgtacaaactaattcctaacgactaaacgtttccggtagggaccgggggtccgtatttccgaaccgtattccgtacccgtaaggaaccgtaactaaaacttaaaccgaaaacgtaaacccttaacccgttttataccgttacggtaactaaaaacgttacgaacgtaacgtccctaaggaaccgaaccgtacggaaccgaaccgtacggtccgttacgtaccttacgtttacgttcggacgcgaaaggacgtaacgaacctaccgaaaccgtaacccgtagtcggtaacctaaagttacgttacgggtaggggttctttacgggttcggtacggggtacccgtaacgggggtacccttagggtaccgtacgttcccgtacccgtccccgtaacggtccccctacccggtaacccggtaaccggtacccgtacgtttcccccggttcccgttacccccggcggttaccccgcccggttcccg

SEQ ID NO: 22982 - DNA, 877 bp, Homo sapiens
  misc_feature: GYAE6OF02G22XL.12.40.D07.1.454.CMB.1.raw
  modified_base (287)..(287): a, c, t, g, unknown or other
  misc_feature (287)..(287): n is a, c, g, or t
  modified_base (519)..(519): a, c, t, g, unknown or other
  misc_feature (519)..(519): n is a, c, g, or t
tcagatacgacgtacacgaccggtgctcgatttagtgatagagcgtaacaacagagggctcaccatggagtttgggctgagctgggtttcctcgttgctcttttaagaggtgtccagtgtcaggggcacctggtggagtctgggggagccgtggtccagcctgggcggtccctgacactcgcctgtgttgcctctggtactttcccttcaatttctattccatgcacgtcgggtccgccaggctccagggccaaggggcctcggagtgggtcggctacttattgcanagtgagtggccgtataaacgaacttcgtaccgactaaacgttcccggtaagggcgggggtaccctacgtttacccgaacctaacttcccgtaccccgaaaggacgtaaaacctaaactttaaccgaaaaccgtaaacccttaccccttttaaactccgtaccgtaaacctaaagttaacgaacgaacgtccccgtaagaccgtaaaccgacgaacccgtacgacccgggttntacgttaacttagtttacttacggaccgacggtagaacggtacgaaccgtaaccaaaccggtaacccttacgtacggtaaccctaaacgtttaccggtaaggggtttccggggttaccgttttagggtttacccgggggccgggggttaaacccggggttacccggggggtaccccgtttaggggtaccccgtaaccgggttttcccccgttaccccgggttaccccctaccccgggtaacccccgttacccccgtaaacccgggtaaacccccggggttccctacccgggtttaccccgggtttccccccgtttaaccccccggggccgggttacccccctcccccggttaccccgg

SEQ ID NO: 22983 - DNA, 615 bp, Homo sapiens
  misc_feature: GYAE6OF02GC416.12.40.D07.1.454.CMB.1.raw
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (456)..(456): a, c, t, g, unknown or other
  misc_feature (456)..(456): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggnggcacttatgcacatgatggcgttacaactaaacttctaacgacaaattcccggtggacggggcctattccaccatctccagacgacaatacaagaacctaccttatctagacaaatagacagtcctagacaccaacgacgacacggctgttactatttacgttggcgcgagagacacacacgaacctacgngaccaatacgtaggtacggggtacttcgttcggtcggggccgacggggacccgttgggtacctacgttccgtccctaccccggctaccctacccgaaccgaaccgggtcccctagttcccggttcccttaccccccggtcggtccccgacccgtcccgg

SEQ ID NO: 22984 - DNA, 724 bp, Homo sapiens
  misc_feature: GYAE6OF02IVIKQ.12.40.D07.1.454.CMB.1.raw
  modified_base (244)..(244): a, c, t, g, unknown or other
  misc_feature (244)..(244): n is a, c, g, or t
  modified_base (308)..(308): a, c, t, g, unknown or other
  misc_feature (308)..(308): n is a, c, g, or t
  modified_base (488)..(488): a, c, t, g, unknown or other
  misc_feature (488)..(488): n is a, c, g, or t
  modified_base (713)..(713): a, c, t, g, unknown or other
  misc_feature (713)..(713): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtggtggagtctgggggagccgtggtccagcctgggccggtccctgacactcgcctgtgttgcctctggtactttcccttcaattttcctattcccatcgcacgtcgggtccnccgaggcctccgagggacgtaacgggggcttcggagtggggtggactactttattggaccacgntggagttcggcgtacgaaactaaattccgtacgactaaacgttccgtgggaacggggtcctaacttccgaccctattcccgtaccgagaacgaaccaaagttaaccaacgaaacctaccccttttaagtcctacgactaaacgtacgacacgtcctagacgacccaggaccacgacggtntacgtcgttattagtagccgagtagacgaagaaccacgtaaacccgacctacgtacggaaccctaatacgtacgggtacggggttctttacggttcggtacggggaccgtacgggtaaaccccggttggtaaccgtacgttcccgttccgacccccggtaactcccgttaccgggaaccgggtacgaccccgttacccgacggtacggaacccgacgtaacccgngggtaccccgg

SEQ ID NO: 22985 - DNA, 860 bp, Homo sapiens
  misc_feature: GYAE6OF02GRHOL.12.40.D07.1.454.CMB.1.raw
  modified_base (210)..(210): a, c, t, g, unknown or other
  misc_feature (210)..(210): n is a, c, g, or t
tcagatacgacgtacacgaccggtgctcgatttagtgatagagcgtaacaacagagggctcaccatggagtttggctgagctgggttttcctcgttgctcttttaagaggtgtccagtgtcaggggcacctggtggagtcgtgggggagccgtggtccagcctgggcggtccctgacactcgcctgtgttgcctctggtactttcccttntaatttctattccatgcacgtgggtccgccaggcctccgaggacgaaggggctcgaggtgggtcgctacttattgcacatgatggcgtacaaactaaattctacgactaaacgttccggtaggacggggaccgtattaccaacctatcctacccgaaggaacgaactaaacgttaacaaacggtaaacctaaccccttttaatcgtacgaactaaaacgttacgaaccgaacgtaccgttacggaaacgtaacccgaaggaacccgaaccgaacccggggttaccgttacggtttaacctttaaacgttttaacgtttacggtccgggtaaccggtaaacgggaaacggtaacggaaacccgtaaacccgaaacccggtaaaccccgttaaccgtaaccgggtaaacccgtaaaacgtttaaccgttaacggggttaccgggggtttaccgttttccggggtttaccggggtaaccgggggtacccgggtaacccgggggtacccgttacgggttaccgtaaccgttcccgggttacccctaccccggtaaccgtccccgtaaccccgtaacccggtaacccgggtacccgtaccggtttcccggttccccgtttaccccccggtaccggtacccgtccccggttacccg

SEQ ID NO: 22986 - DNA, 770 bp, Homo sapiens
  misc_feature: GYAE6OF02JV89Y.12.40.D07.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
  modified_base (247)..(247): a, c, t, g, unknown or other
  misc_feature (247)..(247): n is a, c, g, or t
  modified_base (481)..(481): a, c, t, g, unknown or other
  misc_feature (481)..(481): n is a, c, g, or t
  modified_base (519)..(519): a, c, t, g, unknown or other
  misc_feature (519)..(519): n is a, c, g, or t
  modified_base (575)..(575): a, c, t, g, unknown or other
  misc_feature (575)..(575): n is a, c, g, or t
  modified_base (761)..(761): a, c, t, g, unknown or other
  misc_feature (761)..(761): n is a, c, g, or t
tcagatacgacgtacacgaccggtgctcgatttagtgatagagcgtaacaacagagggctcaccatggagtttgggctgagctgggttttcctcgttgcttcttttaagaggtgttcagtgtcaggggcacctggtggagtcgtggggganccgtggtccagcctgggcggtccctgacactcgcctggtgttcgccttntggtactttcccttctaattttccattccattgcacgttgggtcccnctagggtcctccgagggtaccaagggggtcctacgggaggttcggggtgggcctaactttagttcggacaccgtatcgacgttgggcccgttacaaaccttaaatttccgtaaccgacgttaaacgtttccccgggaggtaacggggtcccgtaaacttccgaaccctattacccgtacccgaaggtaaccgaacttaaacgttaaaccgaaaccgtaacctaccctttttaancgtttaaccgaactaaagttacggaacacgtcccgtanaccggaactaacggccgaaccacggtctacgttctagttacgttcgacggtcgaanacggacaccgaacgtaccgaaacttcgccggtaactacgttaaaccgtggttacgggtctttacgggttaccgcggggtaccgtaaccgggtcctagttccgtactccgttacccgtcccaacgtccgttaacccaccggtaccggtccacggtttacccggccccgtttaccccggcggtccccnccgttaccg

SEQ ID NO: 22987 - DNA, 713 bp, Homo sapiens
  misc_feature: GYAE6OF02GBIYZ.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcgagtggtgcacttatgcacatgatggcgtacaaactaaattctaaccgtactaaaagtttcccggtaggaacgggggtccctagttccaacctattcctaccaaggacgtaacaaatttaacgaaacgaaaccttaaccccttttaatcctagaccaaaagtagacaacgtcctagaacgaacccagaaccgaacgacggctagtacctattacgttgcgagtaagagacgacaacgaaccgaacctagacgacctaaatacgtaaggtacggggtctttacgggttcgtacggggacccgtaacgggggtaccccttagggtacctacgtttcccggtacccttacccccggaacgtccccgttacccgaaacccggtaacgggaccccctaacggttccccggtttaccccgttacccccccgggtacgggtacccccggtaccccgttaccgg

SEQ ID NO: 22988 - DNA, 599 bp, Homo sapiens
  misc_feature: GYAE6OF02HFTXL.12.40.D07.1.454.CMB.1.raw
  modified_base (149)..(149): a, c, t, g, unknown or other
  misc_feature (149)..(149): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
  modified_base (420)..(420): a, c, t, g, unknown or other
  misc_feature (420)..(420): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggganctgtggtccagcctgggcggtccctgacactcgcctgtgttgcctctggatttcccttnaatttctattccatgcactgggtccnccaggctccaggcaaggggctcgagtgggtggcacttatgcacatgatggcgtcaacaaattcacgcaaattccggngaggggccattcaccatcctccagagacaattacaaagaccaccctttanctagacaaatacgactagcctagacgaccagaccgacgacggctgtactattatgacgngagagagacacgacgaacctacgtacgacctaagtactaggtcggggtactttggttcgtcggggaccgtacggggtacccgtgggtaccacgttccgtccgtccccgacgtacccgtacccgacccgaaccgggtccctacggttcccggtcccgttcccccgtcggtcccgtacccg

SEQ ID NO: 22989 - DNA, 876 bp, Homo sapiens
  misc_feature: GYAE6OF02HAYFO.12.40.D07.1.454.CMB.1.raw
  modified_base (214)..(214): a, c, t, g, unknown or other
  misc_feature (214)..(214): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcacctggtggagtcgtgggggagccgtggtccagccgtgggccggtccctgacactcgcctgtgttgcctctggtatttccccttntaacttttctacttccatcgctacgttcgggtcccgaccgaggtcctcccgaggaccgaagggggtcctcggagggtgggtcggcctaacgtttagttcggaccacgtaagtcggaagtcgggacgtacaaacgtaaacttccgtacgactaaattcccggaggtacggggccgtattaccgacctagtcctacgaagtacgtaactaaacttaacgaaaccggtaacccttaacccgtttactacgtcgtaaaccgtaaaaacgtaggtaacctacggtacccttaggaaacgaaccccgttaaagggaacccgtaaccgaacccgggtaccgtttacggtaaccgttttaacgtttaacgtttaccggaccggtaaccgggtaacgggtaaaccggaacggtaaaccaaacccggtaaaacccggtaaacccgttaccgtaaccggttaacccgaaaccgttaaaccgttacgggttacggggttccgtttaaccgggtttcgggttacccggggtaccgtaacccgggggtacccttacgggtaccgtacggttccgtacccgtaccccgtaccggtccctacccgtaaacccggacccggtacccgtaccggttcccggtacccggtttaccccggcccggtcccggtccccgtaccg

SEQ ID NO: 22990 - DNA, 869 bp, Homo sapiens
  misc_feature: GYAE6OF02GAANE.12.40.D07.1.454.CMB.1.raw
  modified_base (236)..(236): a, c, t, g, unknown or other
  misc_feature (236)..(236): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggactttcccttcaatttctattccatgcactgggtccnccaggctccaggcaaggggctcggaggtgggtggctacttatgcacatgagtggcgtacaaactaaattctaaccgactaaaacgtttcccggtaggaacgggggtcccgtaatttccgaaacccgtattcccgttacccgaaggtaaacggaaacctaaaacgtttaaccgaaaaacggtaaacccttaaaccccgtttttaatcccgttacgaaacctaaaaagttaaggaaccctaaggtaccctaggaaccggtaaacccgaacggaaaccgaacccgaaccgggtaccttacggttacctttaaagtttactttcgggaccggtaccggaaggtaacggaacgtaaccgaacccgtaaacccgtaaacccgtaaccgtaccgggaaccctaaacgttaccgttaacgggtcggggggttacgttttacgggtttaccggtacgggggggtacccggtaaccgggggtaccccgttgggttaccgtaccgttcccggttaccccgtacccccgtaccggtacccccgttaccccggaaaccccggtaacccgggtaccccttaacccggtttccccgggttccccgtttaccccccgggtcgggtacccccggttccccgttacccggg

SEQ ID NO: 22991 - DNA, 762 bp, Homo sapiens
  misc_feature: GYAE6OF02JGX67.12.40.D07.1.454.CMB.1.raw
  modified_base (289)..(289): a, c, t, g, unknown or other
  misc_feature (289)..(289): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcggagtgggtgctacttattgcacatgatggctnaaactaaattctacgctaaattcccgtgacgggccgattccaccatctcaggacgactaagttacaacgaactacccttttatctagaccaaatacgacacgcctaggacaccgagacgacgaccggctcgtcttaattctagccgtacgaagtagaacgaccaacgaaccgtaaacccttacgtacgggtacctaaacgttaacgttacgggttacggggggttacccttttagggttttcccgggtacggggggtacccccgttaaaccggggggggtacccctttacgggggtacccgttaacgttacccggttaccccgttaaccccccggtaacgggttacccccccctttaccccggggaaaccccgttaacccgggggtaccccccttaaccgggtttcccccgggttcccccccgttttaacccccccggttcggggtacccccggttacccccgtttccccggg

SEQ ID NO: 22992 - DNA, 811 bp, Homo sapiens
  misc_feature: GYAE6OF02J0RDM.12.40.D07.1.454.CMB.1.raw
  modified_base (154)..(154): a, c, t, g, unknown or other
  misc_feature (154)..(154): n is a, c, g, or t
tcagatacgacgtacacgaccggtgctcgatttagtgatagagcgtaacaacagaggactcaccatggagtttgggctgagctgggttttcctcgttgcttcttttaagaggtgtccagtgtcaggggcaccgtgggtggagtcgtgggggacnccgtggtccagccgtgggccggtccctgacactcgcctgtgtgcctcgtggtactttcccttataatttctattccatcgctacgtcgggtcccgccaggtcctacgacggcgaacggggtcctacggtagggtgggttcggaccttactttagttcggaccaatagttggaacgttcggtaccgtaaccctaaaataaacgttccttaacggaacctaaacggttttcccggagggaccgggggtaccctaatttaccccgaaccttacgtccctacccgaaagggaaaccgtaaaccttaaaagttaaaccgaaaaccggtaaaacccctttacccccttttaataccggtaacgtaaaacctaaaacgttaacgaaccgaacgttcccgaagtaaaccgacccgaaaggtacccgagtacccgtgtacgttactaagtttacgtcgacgtacgaagcgacgacacgtaaccgactcgtaccgctaaacgtcgtacgggtacgggtcgttacgtcgggtacgggacccgtacgggtacccgttaggtaccgccgtaccgttaccctcccgggtaactaccccggtccgaaaacccggtcccggtacctacccggttcccggtccctttacccggacccgttcccgccccttacgg

SEQ ID NO: 22993 - DNA, 782 bp, Homo sapiens
  misc_feature: GYAE6OF02F9P9N.12.40.D07.1.454.CMB.1.raw
tcagatacgacgtacacgaccggtgctcgatttagtgatagagcgtaacaacagagggctcaccatggagttgggctgagctgggtttcctgttgctcttttaagaggtgtccagtgtcaggggtcacctggtggaggtctgggggagccgtggtccagccgtgggcggtccctgacactcgcctgtgttgcctcgtggtatttcccttctaatttctattccatgcacgtcggtccgcaggctccaggcaagggggtcctacggagtggggtggctacttagtgcacgtagtgtagtcggaccgtaactaaactaacgtttctaaccgacgtaaacgttccggtagggtaacgggtaccgtactaccgaaccgtactaccttacgaacgacgtaactaaacgtaacgaaaacgtaacctaacccgttttatacgtacgaactaaacgtaacgacgtacgtaccgtagtaaccaaccgacgaaccggtaccgaaccggtacgttacgtacgttaacgttacgtacggacgtacgaacggtacgaacgaaccgaaccgtaaccgtaaccgtaccgtacgtaaccctaacgttaaccgtaggttaccggggttagtttaccgggtttacgggacggggttacccggtaaccggtacggttcgggttaccgtaccgtccgttacccgtacccggtaccgttacccgaccccgtaaccggtaaccgggtcccgtaccggttccccgggttacccttacccccggtccggtacccgttcccggtccg

SEQ ID NO: 22994 - DNA, 808 bp, Homo sapiens
  misc_feature: GYAE6OF02JXBAS.12.40.D07.1.454.CMB.1.raw
  modified_base (724)..(724): a, c, t, g, unknown or other
  misc_feature (724)..(724): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctctggactttcccttcaactttctattccatcgcacgtgggtccgccaggcctccgaggcgaagggggctcgaggtgggtcgctacttattgctaacatgacgttcgggacgtaccaaataaagtttccgtaacggaccttaaaagttttccccgtagggaacgggggtccctaagttttacccgaaccaacgttccttacccgaaggtacggaaccctaaaatttaccgaaaaacgaacccttaccctttaaacttcacggtaaccaaaagtttaacggaacctacgggtaccctaacggggaacaacccggaagaaaccggttaccgaaccgggcctttacgtaccgttttaattaacgttggtaaccggcgtaaacgggagaacggaaccaaaccggtaaaccgaacccgttaacggacggtaaaccaaacgttaacttaacgggtacggggtccttttacggttcggtcggggaaccttacgggggtaccttgggtaacctaaccgttcgttaccgttacccccnggttcccctaacctaaccggtaaccgggaccccgtaaggttccccgggtacccgtttcccccggtacggtcccgtccccgtccg

SEQ ID NO: 22995 - DNA, 646 bp, Homo sapiens
  misc_feature: GYAE6OF02F2B6K.12.40.D07.1.454.CMB.1.raw
  modified_base (154)..(154): a, c, t, g, unknown or other
  misc_feature (154)..(154): n is a, c, g, or t
  modified_base (271)..(271): a, c, t, g, unknown or other
  misc_feature (271)..(271): n is a, c, g, or t
  modified_base (401)..(401): a, c, t, g, unknown or other
  misc_feature (401)..(401): n is a, c, g, or t
tcagatacgacgtacacgaccggtgctcgatttagtgatagagcgtaacaacaggagggctcaccatggagtttgggctgagcgtgggttttcctcgttgctcttttaagaggtgtccagtgtcaggggcacctgggtggagtcgtgggggganccggtggtccagcctgggcggtccctgacactcgcctgtgttgcctctggatttcccttcatttctattccatgcactgggtccgccaggcctcgaggcaaggggctcgaggtgggngcacttatgcacatgatggctacaaactaagttccaaccggactaaacgtttcccggtaggaacgggggcctaagttcccaacctatcctaccgagacgtactaaacttacaaagtaccctacctttaanctgacaaatcgacacgctagacggaacagaccgacacggctacgtactaattatgacgacgagagacgacgtacaacgaacctacgacgtacaagttaacgtaggtcggggtactttcggtaccggtcggggaccgacgggtacccgtaggtaccgtacgttccgtacccgtaccccgtcgacccgtaccgacggtacccgaccgtacccgtaccggtacggaccgaccgaccgtacggcccggg

SEQ ID NO: 22996 - DNA, 620 bp, Homo sapiens
  misc_feature: GYAE6OF02IC8E1.12.40.D07.1.454.CMB.1.raw
  modified_base (151)..(151): a, c, t, g, unknown or other
  misc_feature (151)..(151): n is a, c, g, or t
  modified_base (212)..(212): a, c, t, g, unknown or other
  misc_feature (212)..(212): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (364)..(364): a, c, t, g, unknown or other
  misc_feature (364)..(364): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (600)..(600): a, c, t, g, unknown or other
  misc_feature (600)..(600): n is a, c, g, or t
tcagatacgacgtacacgaccggtgctcgatttagtgatagagcgtaacaacagaggactcaccatggagtttgggctgagctgggtttcctcgttgctcttttaagaggtgtccagtgtcaggggcacctgggtggagtcgtgggggganccggtggtccagccgtgggcggtccctgacactcgcctgtgttcgcctctggatttccctnaatttcattccatgcacgtgggccgaccaggctccaggcaaggggtctcgagtgggnggcacttatgacanatgatgcgtacaacaatctacgacaaatccggtgacgggccagttcacctatctacagagacaattacagaactaccttanctgactaaatacgacacgacctgaagacccaagaccgactaacggctgtacctattatcggcgtacgngaagntaaccacacgtaaccaagtcgacctaatactacggtaggggacctttacgggtcgttaccggggaccgaccggggtacccgtacggttacgacgtccggtaccctcccggacgtaccccggtccaaccgggtaacccgccgagttacccggtcccttccccgngggttacccgcccgttcccg

SEQ ID NO: 22997 - DNA, 683 bp, Homo sapiens
  misc_feature: GYAE6OF02G4ZML.12.40.D07.1.454.CMB.1.raw
  modified_base (288)..(288): a, c, t, g, unknown or other
  misc_feature (288)..(288): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
  modified_base (587)..(587): a, c, t, g, unknown or other
  misc_feature (587)..(587): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtgggggagccgtggtccagccgtgggcggtcctgacactcgcctgtgttgcctctggtactttcccttcaatttctacttccatgcacgtgggtccgccgaggctccgaggccgaaggggctcggaggtgggtgctacttatgcanagtgatggcgacaaacaaatttccgacgacaaattccggtaggacggggcctaattccaaccattcctaccaagacgtaactaaacttacaaaacgtaaccttaccctttanaccgttanaaccgtaaaataacgaacgtacgtacctaggacggtaacccaaggaaccgaccgacggctacgtacttattacgtgcggtacagaaggacacgtacgaacccacgtagtacgtaaccaagttactgggttaccgggtgtttacgttcggtaccgggccgtaaccgggtactcgggtacncgttccgaccgttaccccgcgtaccctacccggaaccgtaccgggccctacggttccccggttacccgttccccggacggtccccgccgtacccgg

SEQ ID NO: 22998 - DNA, 682 bp, Homo sapiens
  misc_feature: GYAE6OF02GX7IF.12.40.D07.1.454.CMB.1.raw
tcagatacgacgtacacgaccggtgctcgatttagtgatagagcgtaacaacagagggctcaccatggagtttgggctgagctgggttttcctcgttgctctttaagaggtgtccagtgtcaggggcacctggtggagtctggggggagccggtggtccagcctgggccggtccctgacactcgcctgtgttgcctctggatttcccttcaatttctattccatgcactgggtcccgccaggctccaggcaaggggctcggagtggggtcggctacttatgcacagtgatggctacaaacaaattcacgacaaattccgtaggaggggtccattacacctatcctccaagacgaactaaacttaacaaagaaacctaccctttatccgtagaactaaaagtacgaacacgtcctaggacgaacccgtaagaccgaccgacggtctagtacttaattagttacggcgacgagacgagaacctacaaccgtaacctacgtacgactaaacgtacctaggtacggggtcgtttggtacggttcgggaccggtacggggtacccgtggtacctacgtaccggttcccgaccccgtacggtccccttacccgaacccggaccgggtaccccgtacgttcccgggttacccccttacccccggtcgggtaccccgtcccgtacccggg

SEQ ID NO: 22999 - DNA, 610 bp, Homo sapiens
  misc_feature: GYAE6OF02HO0JJ.12.40.D07.1.454.CMB.1.raw
  modified_base (211)..(211): a, c, t, g, unknown or other
  misc_feature (211)..(211): n is a, c, g, or t
  modified_base (434)..(434): a, c, t, g, unknown or other
  misc_feature (434)..(434): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagccgtgggcggtccctgacactcgcctgtgttgcctctggatttcccttnaattttctattccatgcacgtgggtccgccaggcctcaggcaaggggctcgagtgggtgcacttattgcacatgatggctacaaactaaattctacgctaaaattccgtaggaggggcccattccaccatcctacagagaacaattaacaaagaactaccctttaatctgacaaaatagactagcctagacgaccagacgacgacgtctagtcttaattatgngtacgagagagacacacaactactcgaccaatacgagtcgggtacttgtacgtgggaccaggggtaaccctggtactacgtccgtaccctcccgaactccctaccgaaccctaaccggggacccttaacgtcccgggttccctttacccccggtcggtccccgtccccgttaccgg

SEQ ID NO: 23000 - DNA, 644 bp, Homo sapiens
  misc_feature: GYAE6OF02GA0DV.12.40.D07.1.454.CMB.1.raw
  modified_base (147)..(147): a, c, t, g, unknown or other
  misc_feature (147)..(147): n is a, c, g, or t
  modified_base (203)..(203): a, c, t, g, unknown or other
  misc_feature (203)..(203): n is a, c, g, or t
  modified_base (495)..(495): a, c, t, g, unknown or other
  misc_feature (495)..(495): n is a, c, g, or t
  modified_base (561)..(561): a, c, t, g, unknown or other
  misc_feature (561)..(561): n is a, c, g, or t
tcagatacgacgtacacgaccggtgctcgatttagtgatagagcgtaacaacagagggctcaccatggagtttgggctgagctgggtttcctcgttgctctttaagaggtgtccagtgtcagggcaccgtggtggagtctggggganccgtggtccagcctgggcggtcctgacactcgcctgtgtgcctctggatttccctnaatttcattccagtgctacgtgggtccgcaggcctccaaggctaaggggctcgaggtgggtgctacgttatgcgacagtgatggcgtacaaactaagttccacgactaaacgttccggtaggacggggcctagttcaacccgtatccgtaccagtagaactaacttaacaacgaacctaccctttatccaggactaaatcggaactcaccgtagaaccgaacccgtaaggaaccgtacgccgattacgtctaattactgcgacgtagaactagacacgaacctaacacgtanacctaagtaccgtaggtcgggtagtttccggtcggtacggggtccgacgggtacccgtggttaccncgttccgtccgtacccgcggtacctacccgacgtaaccgggcccttacggcccgttacccgttcccgacggccgtacgtcccg

SEQ ID NO: 23001 - DNA, 653 bp, Homo sapiens
  misc_feature: GYAE6OF02G9N9T.12.40.D07.1.454.CMB.1.raw
  modified_base (151)..(151): a, c, t, g, unknown or other
  misc_feature (151)..(151): n is a, c, g, or t
  modified_base (238)..(238): a, c, t, g, unknown or other
  misc_feature (238)..(238): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
tcagatacgacgtacacgaccggtgctcgatttagtgatagagcgtaacaacagagggctcaccatggagtttgggctgagctgggttttcctcgttgctcttttaagagggtgtccagtgtcaggggcacctggtggagtctgggggganccgtaggtccagccgtgggcggtccctgacactcgcctgtgttgcctctggactttccttcaatttctattccatgcactgggtccncaggctccaggcaaggggctcggagtgggtgctacttatgacactagtgagtggcgtacaaactaaattcaacaactaaacgttccggtagggacggggcctattaccgaactatcctaccgaaganaacctaattacaaacgtaaccttacccttancctagaacaaagtacgacagccgtagaacggaaccaggaccgacacggtactacgtacttattactcggcgtacgaaggtagacgaacaacgtaaccgaacgtacgacggaaccaataacgtaggtcggggtacttcggttacggtcgggaccgtacgggtacctggtaccacgtcgtcccacccgatcccctaacgtacccgaaccggtccctaacgttcccggtcccttacccccggaggtcccgtcccgtaacg

SEQ ID NO: 23002 - DNA, 699 bp, Homo sapiens
  misc_feature: GYAE6OF02GZSW8.12.40.D07.1.454.CMB.1.raw
  modified_base (155)..(155): a, c, t, g, unknown or other
  misc_feature (155)..(155): n is a, c, g, or t
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (343)..(343): a, c, t, g, unknown or other
  misc_feature (343)..(343): n is a, c, g, or t
  modified_base (401)..(401): a, c, t, g, unknown or other
  misc_feature (401)..(401): n is a, c, g, or t
  modified_base (436)..(436): a, c, t, g, unknown or other
  misc_feature (436)..(436): n is a, c, g, or t
  modified_base (483)..(483): a, c, t, g, unknown or other
  misc_feature (483)..(483): n is a, c, g, or t
  modified_base (630)..(630): a, c, t, g, unknown or other
  misc_feature (630)..(630): n is a, c, g, or t
tcagatacgacgtacacgaccggtgctcgatttagtgatagagcgtaacaacagagggctcaccatggagtttgggctgagcttgggttttcctcgttgccttcttttaagaggtgtccagtgtcaggggcaccgtggtggagtcgtggggggancccgtggtccagcccgtgggccggtccctgacactcgcctgtgttcgccttctggactttccccgttnaaatttttctnttccctgtcgctaccgttggggcccaccaggtcctaccgagggcgtaaggggtcctacgaggtggggtcgacctacttagtcgactacgagtcgagtgacgtactaaanaacgttctaaccgactaaacttccgggcggtaacggggtcctaactttccggaacctnttaccgccgaagacgtaactaaaacttaccgaaanaaacccttacttaacgtcgtaacgactaaaggacaaccaggtacccnggaacgacgacgaacgcgtaacgctaggtactattagtcgtacgcgaagaccgaagacaccgtaaccgactacgtacgacctaagtacgtagtacgggcttacgtcggcgggacgtcccgggactcggtcgtacgtccgttaacccnccgtacccgtacctacccggacgtacccggtactaccgtcccgttccgtacccggtcggccctcccgcc

SEQ ID NO: 23003 - DNA, 845 bp, Homo sapiens
  misc_feature: GYAE6OF02GUIQX.12.40.D07.1.454.CMB.1.raw
tcagatacgacgtacacgaccggtgctcgatttagtgatagagcgtaacaacagagggctcatcatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcacgtgggtccgccaggctccaggcaaggggctcggagtgggtgcacttattgcacatgatggcgtacaaactaaattcctaacggactaaaacgttcccggtaggacgggggccctagtttccaacctaattcctacccaaggaggaaacctaaattaaaccgaaacgtaaacccttaacccccgtttttaatccttacggaacctaaaaagtaacggaaccaacggtccccttaggaaacggaaccccgaaggaaccggaaccgtaaccgggtccttacggttaccgtttaatttaacgtttcggaccggacggtaacggaagaacggaaccaaaccgaaacccgtaaacccttacgtaccggaaccctaaacgttaaccgttaaggttcggggggttccttttacgggtttccggtaccggggggttacccgggaaaccgggggttaccccgttcggggttaaccgttaccgttcccgggttaccccgttacccccggaacccggttccccccttaacccccgaaacccggtaaccccggggtacccccgttaaccggttacccccgggtttacccccgttttcccccccggtacccggggtcccccgttacccccggg

SEQ ID NO: 23004 - DNA, 719 bp, Homo sapiens
  misc_feature: GYAE6OF02IPTVY.12.40.D07.1.454.CMB.1.raw
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (363)..(363): a, c, t, g, unknown or other
  misc_feature (363)..(363): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagccgtgggcggtccctgacactcgctgtgtncctntgtactttcctntatttctattccatgctacgtcgggtcccnccgagtcctccgagggcgaacggggctcggaggtggggtcgctactttagtgacacgtatgagtcggactacaaactaacttctaacgactaaacgttccggagggacggggcctagttccaactntccgacaagtagaactaagttaaccaaacgtacccttaaccttatctagaactaaagtacgaactacgaccgtagaacgaaccaggtaaccgaccgtacggtccgttagtacgttaatttacgtcggacgacgaagacgacgaacaccgaaaccgtaacccgttacgaccggtaacccaaagttaccgtacggggttacggggttcctttacggttccgggtacggggacccgtaaccgggggtcccttacggtacgtaccgttcccgtacccgttaccccgccgttacccgacccgtaaccggaccggtacccctacgtcccggttcccgtccccgccggtacccgtccgtcccg

SEQ ID NO: 23005 - DNA, 783 bp, Homo sapiens
  misc_feature: GYAE6OF02HHV2P.12.40.D07.1.454.CMB.1.raw
  modified_base (220)..(220): a, c, t, g, unknown or other
  misc_feature (220)..(220): n is a, c, g, or t
  modified_base (336)..(336): a, c, t, g, unknown or other
  misc_feature (336)..(336): n is a, c, g, or t
  modified_base (408)..(408): a, c, t, g, unknown or other
  misc_feature (408)..(408): n is a, c, g, or t
  modified_base (441)..(441): a, c, t, g, unknown or other
  misc_feature (441)..(441): n is a, c, g, or t
tcagatacgacgtacacgaccggtgctcgatttagtgatagagcgtaacaacagagggctcaccatggagtttgggctgagctgggtttcctcgttgctcttttaagaggtgtccagtgtcgaggggcacctgggtggagtcgtggggggagcccggtgggtccaggccgtgggcggtccctggacactcgcctgtgttgcctctggacttttcccgttntaattttcctattccgtatgctacgttcgggccgaccagggtcctacccgagggaccgaaacgggggtctcggtaagggtgggggtggacctacttattcggaccacgtattgagngggactacaaaacgtaatttccgaacgtactaaacgtttccggtgggaacggggcctattcacctatctacngaacgacctaatacgaacgaccttacccgttanactagaacctaaagtagtaccagacctaggaaccgtaaccgaacgtaacgtaccgacggcttacggttaatttacgttacttacggccgacggaaggacgtaacaacgaacccgtaacgaaccttaccgtacggtaacctaacttaaacggtacgggttcgggtacctttagggtcccggttaacgggaccgtacgggggtacctcgggtactccggtcccgttaccgtaccccgtacggtaccccgtaacccggtaaaccggacccggttaaccccggtccgttaccccggggttccccgttaaccccccggggtcgtacccccggtccggtaaccccggg

SEQ ID NO: 23006 - DNA, 776 bp, Homo sapiens
  misc_feature: GYAE6OF02HHHZD.12.40.D07.1.454.CMB.1.raw
  modified_base (240)..(240): a, c, t, g, unknown or other
  misc_feature (240)..(240): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagccgtgggcggtccctgacactcgcctgtgttgcctctggtactttcccttcaattttctattccatgcactgggtccnccaggctccaggcgaggggctcggaggtgggtgacacttattgcactatgagtggacgtacaaaactaaatttcctaacgacctaaaacgtttcccggtaggaaccggggggcctaattccaaccctatcccgtaccaggtaacgaactaaacttaacaaaacgtaaacccttaaccccttttaatactacggaaactaaaacgttagaaccaacgtccttaggaaccgaacccgaaagacccggtaacgacgggtacttacggttactttaacgtttacgttcggacgtacggaagaaggaacgaaccaaccgtaaacccgtaacccgtaacgtaccggtaccctaaacttaacgtacgggttacgggggttctttcgggtttaccggtacggggccggtaaaccggggtccgtacggtaccgtagttcccgtacccgtccccgaacgtcccttaacccgaaccccggacgggtaccccttacggttccccgggttacccctttccccccgggcgggtacccgtccccgtaccgg

SEQ ID NO: 23007 - DNA, 779 bp, Homo sapiens
  misc_feature: GYAE6OF02JA7Y4.12.40.D07.1.454.CMB.1.raw
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctcgtggtactttcccttnaatttctacttccatgcactgggtccncaggctccaggcaggggctcggagtgggtcgactacttagttgctacagtgatcgggctaacaactaaacttccgtaacgactaaacgttccggtaggaacgggggtccactttccgaacctatcccgtaccgagacgtaaccaatttaaccgaacgtaacccttaccccttttagacttacgaaactaaaacgttacgacgtacgaccttaggaaaccgtaccgaggaactacggaccgtacgttacgttagttaacttagttacggtaccgaacggtacggaacgtaacgaacctaacgtaacccgtaacccgttaccgtaacggtaacctaacgtttaacgtaacgggttcggggttacgtttaacggttcgggtaccggggtaccggtaccgggttaacccgtcgtaacggttaccgttacccgttcccgtaacccgtcgttaacccccgtccgtaaaccccgggaccgttaccccgttacgggtaccccgttttcccccgtaccccgggtaccggtaccccgtcccgttacccgg

SEQ ID NO: 23008 - DNA, 675 bp, Homo sapiens
  misc_feature: GYAE6OF02HA17S.12.40.D07.1.454.CMB.1.raw
  modified_base (239)..(239): a, c, t, g, unknown or other
  misc_feature (239)..(239): n is a, c, g, or t
  modified_base (289)..(289): a, c, t, g, unknown or other
  misc_feature (289)..(289): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtggtggagtcgtggggggagccgtggtccagcctgggcggtccctgacactcgctgtgttgcctctggtactttcccttcaatttctattccatgcacgtgggtccnccaggcctcagggcaaggggctcggaggtggggtgctacgttatgacacntgagtggcgtacaaataaattctaacgactaaagttccggtagggaacggggccctattaccaacctatcctaccagaacgaactaaactaacaaacgtaacctaaccctttagactaggacctaaaagtacgaacacggtacctaggacgaaccagaaccgacgcggtctgttacttagtttagtcgcgacgtaggacgaacgaccaacgaaccgaaaccttagacggaactaacgttagtaacggtcggggttcctttaggttccgggacggggacccgtaacgggggtacccttggtacaccgttcccggtccctacccgagtccccacgtaacccggaacgtcccacgttccggttcccttccccggcggtcccgccctacg

SEQ ID NO: 23009 - DNA, 703 bp, Homo sapiens
  misc_feature: GYAE6OF02F4E3F.12.40.D07.1.454.CMB.1.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (450)..(450): a, c, t, g, unknown or other
  misc_feature (450)..(450): n is a, c, g, or t
  modified_base (473)..(473): a, c, t, g, unknown or other
  misc_feature (473)..(473): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcgtccctgacactcgcctgtgttgcctctggtactttcccttnaattttctattccatgcacgtcgggtccnccaggctccgaggcgaagggctcgaggtgggtgctacttatgcacatgatggctacaaactaaattcctacgactaaagttccggnggacggggcctattcaacctntccgtaccagtaacgacctaaagttaaccaaacgaacccttaaccctttagtacctagaacctaaataacggacacgtccgtagacgacccgagacgacacggntcgttatattgtcgcgacgaganagacaacgaacgtaaactacgacgtaacctaagtaaccgttagggtaccggggttacgtttcgggtttacggtaccgggggtacccgggtaacggggtcccctttagggtcccgtaaccgttcccggtacccgtacccccgacggtacccctaccccggaaccggtaacccggacccctacggtttccccggttacccgttcccccggacgggtccccgtacccgtccgg

SEQ ID NO: 23010 - DNA, 904 bp, Homo sapiens
  misc_feature: GYAE6OF02GZ9LM.12.40.D07.1.454.CMB.1.raw
tcagatacgacgtacacgaccggtgctcgatttagtgatagagcgtaacaacagagggctcaccatggagtttgggctgagctgggtttcctcgttgctcttttaagaggtgtccagtgtcaggggcacccgggtggagtcgtgggggagccgtggtccagcctgggcggtccctgacactcgcctgtgttgcctctggattcccttctaatttctattccatcgctacgtgggtcccgccgaggtcctccgaggcgaaggggctcggagtgggtgctacttattgcacatgagtggcgtacaaactaaattcgtaaccgactaaacgttccggtaggacggggtccctaagttccaaccgtattccgtacccgaaggaacgtaacctaaaagttaaccgaaaacgtaaaccccttaaccccgtttttaataccgtacgtaaaccgtaaaattacggaacctaaccggtcccgttaaggaaaccgaacccgaacggtaaccgtaaccggtaaccggtaccgtttacggttaccgtttaacgttttaacggttaccggtaccggtacgggtaaacgggaacggtaaaccggtaaccgtaaacccgtaacccggtaaaaccccgttaccggttaccgggtaaacccttaaaacgttaaccgggttaaacgggttcgggggggttaccttttcggggtttaccggggtaccggggggtaccccgggttaaccggggggttaaccccgttacgggtaccgtacccgggttacccgttccccgttaccccggtaaccgtacccccgtaacccgtaacccgggaaccccgggtaccccgttaacgggttaccccggttccccggttcccccggttacccggtaccccggtccccgttaccggtcccccgg

SEQ ID NO: 23011 - DNA, 624 bp, Homo sapiens
  misc_feature: GYAE6OF02FKGGW.12.40.D07.1.454.CMB.1.raw
  modified_base (149)..(149): a, c, t, g, unknown or other
  misc_feature (149)..(149): n is a, c, g, or t
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcggtccctgacactcgcctgtgttgcctctggactttcccttcaatttctattccatgcactgggtccncaggctccaggcaaggggctcggaggtgggtgctacgttatgcacatgatggctacaaanaattcacgcaaagttccgtggacggggccagtttccacctatctccaagagaactaattaacaagtaacctaccctttancngtacaaatacgacagccctaggaacaccagaccgacacggctcgtntattntgcgcgaganacgacacgacgaacctatcgacctaatacgtacggtaggggtcttcgttcggtcgggccgtaacggggtccgtgggtcctacgttccgtccgacccccgtacgtaccccttacccgaacccggtaccgggacccgtaccgttcccggttccccgttaccccccgtccggccccggtcccgttccgg

SEQ ID NO: 23012 - DNA, 586 bp, Homo sapiens
  misc_feature: GYAE6OF02IQAH7.12.40.D07.1.454.CMB.1.raw
  modified_base (235)..(235): a, c, t, g, unknown or other
  misc_feature (235)..(235): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccnccaggctccaggcaaggggctcggagtgggtgcacttatgcacatgatggcgtacaacaaattctaacgacaaattccggtggaggggcctattccaccatctaccagagacaattacaagaacctaccctttatctagacaaagtgaacacgcctagacgaccagacgacacgactcgtactattagtgcgcgagagagacaacaccgaacctactacgactaatacgtagtcggggtcttgttcgtagggccgtaggggtaccctggtcacgttcgtcctcccgagccctaccgacccgtacgggcccacggttcccggttcccttaccccgtcggtcccgcccgtcgg

SEQ ID NO: 23013 - DNA, 921 bp, Homo sapiens
  misc_feature: GYAE6OF02F543B.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctggggcggtccctgacactcgcctgtgttgcctctagtactttcccttcaattttctattccatcgcactcggggtcccgccaggcctccgagggccgaagggggcctcggaggtggggtggctacttattcgcacatgagtggcgtacaaactaattcctaacgactaaacgtttccggtagggacggggggtccctaacgtttaccgaaccctacttccctaccgaacggaacgaactaaaactttaaacgaaaacgtaaacccgttaaccccttttatacgtacgtaacctaaaacttacggaaccaacgtacccttaacggaaccgaacccgaaccgggtaaccgaaccgtaacccgggtaccgtttacggttaacccgtttaatttaacggtttcgggaccggtaacgggtaaacggaaccggtaaggaaacccgtaaccgtaaaccgttaaaccccgttacgggttaacccggaaacccctttaaagttaaaccggttaggggtaccggggggtttccttttaaccggggttttcccgggtacggggggggacccgttaaccgggggggttaccccgttacggggttaccgttaaccggttcccggttacccccgtacccccgtaaaccgggttccccccgttaaccccggaaccccgggttaaacccgggtcccccgtaaccggttttacccccgggttcccccccgttttccccccgggtccggggttacccccggtaccccccttccggg

SEQ ID NO: 23014 - DNA, 819 bp, Homo sapiens
  misc_feature: GYAE6OF02G743I.12.40.D07.1.454.CMB.1.raw
  modified_base (181)..(181): a, c, t, g, unknown or other
  misc_feature (181)..(181): n is a, c, g, or t
  modified_base (310)..(310): a, c, t, g, unknown or other
  misc_feature (310)..(310): n is a, c, g, or t
  modified_base (399)..(399): a, c, t, g, unknown or other
  misc_feature (399)..(399): n is a, c, g, or t
tcagatacgacgtacacgaccggtgctcgatttagtgatagagcgtaacaacagaggactcaccatggagttgggctgagctgggttttcctcgttgctctttaagaggtgtccagtgtcgaggggcaccgtgggtggagtcgtgggggagtccgtggtccaggcccgtgggccggtcccngacactcgcctgtgttgcctcgtggtactttcccttcaagtttctatttccatcgcacgtcggggtccaccgaggcctccaagggcgaagggggctcggaggttgggcgctacttatggacacatgagnggtacgtcaaactaattcctacgactaaagttccgtggacgggtcctattcgaccagtccacctaggacgtaactaaattaccggaaanaacccttacctttagtacctaggtaacaaaacgttacgaacgtaaaccgggcttaacgggaaccgtaaaccgaacgggtaaccgaaccggtaaccggtcctacggtttaccttaaagtttaacgtttcggacccgtaggaaacggtaacgaacgaaccgtaaacgaacccgttaaacccacggtaccgaaccgtaaacgttaacgttaacgggtcgggttaccggtttacggttacgggttcccggggacggtaaacccgggtaccgtaccgggttacgtaccggttccgtaccccgtacccccggaaccggtttccccgaaccccgaacccgggttaaccgggtaacccccgtcggttaaccccggtttcccggtttccccccgtaccggggtcccccggtttacccccgtaacccggg

SEQ ID NO: 23015 - DNA, 551 bp, Homo sapiens
  misc_feature: GYAE6OF02HLL9D.12.40.D07.1.454.CMB.1.raw
  modified_base (150)..(150): a, c, t, g, unknown or other
  misc_feature (150)..(150): n is a, c, g, or t
  modified_base (237)..(237): a, c, t, g, unknown or other
  misc_feature (237)..(237): n is a, c, g, or t
  modified_base (371)..(371): a, c, t, g, unknown or other
  misc_feature (371)..(371): n is a, c, g, or t
  modified_base (404)..(404): a, c, t, g, unknown or other
  misc_feature (404)..(404): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
  modified_base (500)..(500): a, c, t, g, unknown or other
  misc_feature (500)..(500): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggganccgtggtccagcctgggcggtccctgacactcgcctgtgttgcctctggattttcccttcaattttctattccatgcactgggtccnccaggctccaggcaaggggctcgagtgggtgcacttatgcacatgatggcgtacaaacaaattctaacgctaaaattccggtggaggggccattccaccatctccagagacaaattacaagaacctacccttanctgcaaaatagacagcctagacgaccagacganacggctgtactattattgcgacgagagagaacacacgaacctacngcaatanagtggggcttgttctgggcacgggacctgtcactcgtctcccgngccctccaaccgacggcccacgtccggtccttccccgtcggccgtccctcg

SEQ ID NO: 23016 - DNA, 700 bp, Homo sapiens
  misc_feature: GYAE6OF02HEQNC.12.40.D07.1.454.CMB.1.raw
  modified_base (147)..(147): a, c, t, g, unknown or other
  misc_feature (147)..(147): n is a, c, g, or t
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (264)..(264): a, c, t, g, unknown or other
  misc_feature (264)..(264): n is a, c, g, or t
  modified_base (574)..(574): a, c, t, g, unknown or other
  misc_feature (574)..(574): n is a, c, g, or t
tcagatacgacgtacacgaccggtgctcgatttagtgatagagcgtaacaacagagggctcaccatggagtttgggctgagctgggtttcctcgttgctcttttaagaggtgtccagtgtcaggggcacctggtgagtctggggganccgtggtccagcctgggcgtccctgacactcgcctgtgttgcctctggactttccctnaatttcattccatgcactgggtccnccgaggctccgaggcgaaggggctcgaggtgggngcacgttatgacacatgagtggcgtacaaactaattctaacgctaaattccgaggacggggcctattacaccgtatcctaccgagacgactaaacttacaaagtaacctacccctttatctacgactaaagtacgacgacggtcctagacgaaccaggaccgaccgacggtctagttacttactttaagttcggacgtacggaagtacgaacgacgaaccgtaaccggtaaaccctcggtacgaacctaattaccgtaggtaggggtacctttaggttccggtacggggtaccgtaccgggggtaacccngggttacctaacggttcccgtaccccgtaccccggaacgtcccccgtaaccggtaacccggaacccggtccccgtaacgttccccggttccccttaccccccgggtacgcccggtcccccgtacgg

SEQ ID NO: 23017 - DNA, 768 bp, Homo sapiens
  misc_feature: GYAE6OF02JGD4U.12.40.D07.1.454.CMB.1.raw
  modified_base (150)..(150): a, c, t, g, unknown or other
  misc_feature (150)..(150): n is a, c, g, or t
  modified_base (236)..(236): a, c, t, g, unknown or other
  misc_feature (236)..(236): n is a, c, g, or t
tcagatacgacgtacacgaccggtgctcgatttagtgatagagcgtaacaacagaggactcaccatggagtttgggctgagctgggttttcctcgttgctctttaagaggtgtccagtgtcaggggcaccgtggtggagtcgtggggganccgtggtccagcctgggcgtcctgacactcgcctgtgttgcctcgtggtactttcccttcaatttctattccatgcacgtggtccncgaggctccgaggcaagggctacggagtgggtgctactttattcgcacatgatcggcgttacaactaacttctaacgacgtaaacttccggtaggacggggtaccctaagtttcccaacctagttcctacccgaaaggtaacgtaaccttaaagttaaccgaaaaccgtaaacccgttaccccttttaatccgtaagtaacctaaagtaacgacgacgtaccctaggaaccgtaccgtaacgaccgaaccgtacggtacgtacgttacgttacgttacgttcggaccgtagaacggaacggtaacgaccgtaaaccgaacccgtaaacccgttaccgtaacggtaacccaaacgttaacgttaacgggttacgggtaccgtttcgggttaaccggtcgggggaacccgtaaccgggggtacccttcggtaccgtacgttcccgtacccgtaccccgtaccgtacccgtcccgaacccgttaccggccctacggtcccgtaccccttccccggacggtccccgtacccgtccg

SEQ ID NO: 23018 - DNA, 760 bp, Homo sapiens
  misc_feature: GYAE6OF02I8DM0.12.40.D07.1.454.CMB.1.raw
  modified_base (240)..(240): a, c, t, g, unknown or other
  misc_feature (240)..(240): n is a, c, g, or t
  modified_base (298)..(298): a, c, t, g, unknown or other
  misc_feature (298)..(298): n is a, c, g, or t
tcagatacgacgtacacgaccggtgctcgatttagtgatagagcgtaacacagagggctcaccatggagtttgggctgagctggtttcctcgttgctctttaagaggtgtccagtgtcaggggcacctgggtggagtctgggggagccgtggtccagccgtgggccggtccctgacactcgcctggtgttgccttctggtactttcccttcaattttccattcccatgacactgggtccnccgaggtcctccagggccgaaaggggcctcggaggtgggtggctactttagtgaccanagtgagttggccgttacaaactaaacgtttcctaacgtacctaaaactttcccgggtaggacgggggtacccactttaccgaaccccttacgtaccaacggaagaactaacttaaaaccgtaacaaaccgtaaccctttaacgttcttacaaccgaaataaacggtacgaacctacggtcgaacggaacccaacggaacgtaacgaccggtaactccgttacttatttaagttcgacggaccgtaggaacgacgggacaacctaaccgaaccgtaaccgtccgtaaccgaacttaacgtacgtacggggttacggttagttacggtcgggtaccggtaccgggacgggtacccttcgaacgttccgttacctaccggacctacccgtaccaaccgacccggtaccctaccggtccgtttaccccgttacccccgttacggccccgttacccgtccgtacccg

SEQ ID NO: 23019 - DNA, 688 bp, Homo sapiens
  misc_feature: GYAE6OF02JDLLI.12.40.D07.1.454.CMB.1.raw
  modified_base (240)..(240): a, c, t, g, unknown or other
  misc_feature (240)..(240): n is a, c, g, or t
tcagatacgacgtacacgaccggtgctcgatttagtgatagagcgtaacaacagagggctcaccgatggagtttgggctgagctgggttttcctcgttgcttcttttaagaggtgtccagtgtcaggggcaccgtggtggagtctgggggagccggtggtccagcctgggcggtccctgacactcgcctgtgttgcctctggtactttcccttcaatttctattccatgcactgggtccnccaggctccgaggcaaggggctacgaggtgggtgcacttatgcacatgatggcgtacaactaattcctaacgctaaagttccggtggacggggccctattccacctatcctaccgagagaacctaagttacaacgaacctacccgttatcgtagacaaatacgacacgtcctaggaacgaccaacgaacggaccgacggtctacggtccttaagtttacgtacgtcgacgtaacggaacgtacgaccgaacacccgaaaccgtacgtacgaacctaagttaccgtacgggtggggtactttcggttcggtcggggaccgtacggggtacccgttggtacctacgtacccggtccgtaccccgacggtccccgtacccggaccgtaaccggggcccctaacggtttcccggtccccgtttacccccggcgggtcccgtcccgttaccgg

SEQ ID NO: 23020 - DNA, 761 bp, Homo sapiens
  misc_feature: GYAE6OF02HPE06.12.40.D07.1.454.CMB.1.raw
  modified_base (385)..(385): a, c, t, g, unknown or other
  misc_feature (385)..(385): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcgaaggggctcgagtgggtggcacttattgcaacatgatggcgtacaacaattcacgcaaagttccgtaggacggggccgtattccaccgattacctccgaagagtaactaagttaacaaagtaaacctacccttttanacctagactaaaatagacacgccgttacgagtaacccgagaccgaacgacgggtacctggtactttaagttacgtttcggcgtacggaagtaaggaaccgaaccgtaccaaccggaaacccgtttacgaccgggtaccctaaaacgttacgttaagggttacgggggttacctttagttccgggtacgggggtcccgtaaccggggggtaaccctcggggttccaaacggtttcccggttcccttaccccggaaccgggtacccccttaccccgggaaacccggtaaccccggggtaccccttaacccgggtttcccgggttaccccccgttttacccccccgggtacgggttcccccggtaccccgttccccggg

SEQ ID NO: 23021 - DNA, 651 bp, Homo sapiens
  misc_feature: GYAE6OF02GOCE1.12.40.D07.1.454.CMB.1.raw
  modified_base (153)..(153): a, c, t, g, unknown or other
  misc_feature (153)..(153): n is a, c, g, or t
tcagatacgacgtacacgaccggtgctcgatttagtgatagagcgtaacaacgaggagggctcaccatggagtttcgggctgagctgggttttacctccgttgctcttttaagaggtgtccagtgtcaggggcacctggtgagtctggggganccgtgggtccagcctgggcggtccctgacactcgcctgtgttgcctctggatttcccttcaatttctattccatgcactgggtccgccaggctccaggcaaggggctcgagtgggtggcacttatgcacatgatggcctcaacaattctacgctaaattccggtgacggggccattccaccatcctccgagacgaacaattacaagtaaccaccctttatctgactaaagtcgaacagtcctagacgtacccaggaaccgacgacggactgtacctagtttaactgcgacggaagagacgacctaactaaccggtaaccttacgtcggacctaaagtaccgttaaggtcggggtactttacggttcggtcggggtaccgtacggggtacccgtcgggtactaacggttccgtacccgtcccgaacggtaccccttaccggaaagggtccgtaccgtacccgtccggaacggacgtacccaacggtccggtaccccggg

SEQ ID NO: 23022 - DNA, 992 bp, Homo sapiens
  misc_feature: GYAE6OF02GUV6Q.12.40.D07.1.454.CMB.1.raw
  modified_base (243)..(243): a, c, t, g, unknown or other
  misc_feature (243)..(243): n is a, c, g, or t
tcagatacgacgtacacgaccggtgctcgatttagtgatagagcgtaacaacagaggactcaccatggagtttgggctgagctgggttttcctcgttgcttcttttaagaggtgtccagtgtcaggggcacctggtggagtcgtgggggagccggtggtccagcctgggcggtccctgacactcgcctgtgttgcctctggactttcccttctaatttctattccatgctacgtcgggtcccnccgaggcctcccgagggtcgaacgggggccttcggacgggttggggtacggacctaaccgtttagtttcggacctacagttacggaagttcgggcgtaccaaaactaaactttccgttaaaccggacctaaaagtttcccggtaggggaacgggggtccctaactttacccgaaccccgtatttacccgtacccgaaaggtacgtaaaccgttaaagtttaaacccgaaaacggtaaaccccttaaccccgtttttaacgtaccgtaggtaaacctaaaaagttaaccggaaaccgaacggttcccgttaacggaaaccggtaacccgaaacggaacccgggaaacggtaacccgggttaccgttaacggtttaaccttaagttttaaccggtttacgggaccgggtaaccggacggaaacggaacccggaaacttaaacccggaaacccgttaaaccccgttacggttaacccggtaacccgtaaacgttaaacccgtttaggggtacccgggggggtttaccttttaccggggtttaccggttacccgggggtaacccggtaaccgggggttaccccgttagggttacccgtacggtttaccccggtacccccgttaccccggaacccggttaccccgtaccccggtaaacccggtaaccccggggttacccccggttaaccgttttacccccgggtacccccgttccccccggtttaccggggccccgtttaaccccgggtccccg

SEQ ID NO: 23023 - DNA, 739 bp, Homo sapiens
  misc_feature: GYAE6OF02FIIN1.12.40.D07.1.454.CMB.1.raw
  modified_base (242)..(242): a, c, t, g, unknown or other
  misc_feature (242)..(242): n is a, c, g, or t
  modified_base (476)..(476): a, c, t, g, unknown or other
  misc_feature (476)..(476): n is a, c, g, or t
tcagatacgacgtacacgaccggtgctcgatttagtgatagagcgtaacaacgagagggctcaccatggagtttgggctgagcgtgggttttcctcgttgctcttttaagaggtgtccagtgtcaggggcacctggtggagtctgggggagccgtggtccagcctgggcgtccctgacactcgcctgtgttcgcctcgtggtactttccttctaatttctattccatcgcacgtcgggtccnccacggtcctccgaggcgaaggggcttacggaggttcgggtggctacgttattggcacagtgtagtggccgtacaactaaactttcgaacgactaaacgtttccggtaggacggggtcctacgttcaaccctattcctaccaacggagtaaaccgtaattaccgaaacggacctttaacccctttagtccttacgaacgtaaaagtacgtacaacggtcccttaggaccgaacncggaaaccgacgaccggtctagttacctaatttacttacggcggtacaggtacgagaaccgaccaacggtaccttacggtcgtaaaccgaacgttacgtacggttcggggttacctttcggttacggttcgggttaccgccggggtaacccgttggtaccgtacttaccgcccgttaccggtaacgcccgttaccggaaccctacgggacccgtccggttccggttaccccgtttcccgtccgggttaccctcccgttaaccg

SEQ ID NO: 23024 - DNA, 603 bp, Homo sapiens
  misc_feature: GYAE6OF02GGHGD.12.40.D07.1.454.CMB.1.raw
  modified_base (146)..(146): a, c, t, g, unknown or other
  misc_feature (146)..(146): n is a, c, g, or t
  modified_base (238)..(238): a, c, t, g, unknown or other
  misc_feature (238)..(238): n is a, c, g, or t
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (546)..(546): a, c, t, g, unknown or other
  misc_feature (546)..(546): n is a, c, g, or t
tcagatacgacgtacacgaccggtgctcgattagtgatagagcgtaacaacagagggctcaccatggagtttgggctgagctgggtttcctcgttgctctttaagaggtgtccagtgtcaggggcaccctggtggatctggggganccgtggtccagcctgggcggtccctgacactcgcctgtgttgcctctggatttccccttcaacttctattcccgatgccactcggggtcccnccaggcctccgaggccaggggcctcggagtgggtggcacttntgcaacntgatggcgtcaaccaattctacgcaaattccgtgagggccattaccaccgatctacccgagacacaattaccagaaccctacccttatccgacgtacaaatacggactagcctgggacacctagccgacacggtctagtctatacgttgccgacgcgaggacaccgacacccgaactacgtcggcccaatactactggggtcttcgtaacgtgggtaccgagggacccgtgtaccgacttcgtccctcccaacgtcccncccaccgtaacgggcccaacgttccggtcccgtttcccccgacggccgtcctaccgg

SEQ ID NO: 23025 - DNA, 646 bp, Homo sapiens
  misc_feature: GYAE6OF02IOLSL.12.40.D07.1.454.CMB.1.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (396)..(396): a, c, t, g, unknown or other
  misc_feature (396)..(396): n is a, c, g, or t
  modified_base (441)..(441): a, c, t, g, unknown or other
  misc_feature (441)..(441): n is a, c, g, or t
tcagatacgacgtacacgaccggtgctcgattttagtgatagagcgtaacaacagagggctcaccatggagtttgggctgagctgggttttcctcgttgctcttttaagaggtgtccagtgtcaggggcacctggtggagtctgtgggagccgtggtccagcctgggcggtccctgacactcgcctgtgttgcctctggtatttcccttnaattttctacttccatgctactcgggtccnccaggcctccgaggcaaggggctcggaggtgggtggctacttattgcacatgagtggctacgaactaaacttctaacgctaaacgtttccggtgggacggggtacctattccacctatcctaccagtagactaataacaacgtaacctacctttanctagaactaaatacgacacgctacgacaccgaagacgacgaccgnttacgtattacttagttcgacgtacgacgagtacgaaccaacgaaccgtaaacctacgtacgtaccgtaatacgtaggtcgggtacgttgtcggtacgggtacgacgggtccgtacggtactacgtccgttccgacccgtacgacccgtacgacccgtaacggtccctacggttcccgtacccgttaccccgtcgtcccgtcccg

SEQ ID NO: 23026 - DNA, 720 bp, Homo sapiens
  misc_feature: GYAE6OF02FMQ8F.12.40.D07.1.454.CMB.1.raw
  modified_base (149)..(149): a, c, t, g, unknown or other
  misc_feature (149)..(149): n is a, c, g, or t
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcgtccctgacactcgcctgtgttgcctctggatttcccttnaatttctattccatgcacgtcggggtccnccgaggcctaccgaggcgaagggggctacggaggtggggtcgctacttagttgactacgattgagtacggtcgtacaaaacgaaatttcacgacgaaaactttccggtggacgggcctaagtccgaaccagtcctacgacgaagtaactaaagttaccaaacgtaaacccttaaccctttaatacccgttacgaactaaaagttacggaactacggacctaacggaacgtaaccgaaggacccgaaacggtaccggacttaccgtactttaagtttagtaccggtacgtaaccggaggtaacgaacggtaaccaacgaacgtaacctacgtacgtaactaacggttacgtacgtaggggttacttaggttcggtcgggaccggtaccgggtacgtcgactaccgttcgacccgtaccgaccgtacccacgtaacccgaacggtaccctcgttaccgtccgttacccggcggtccctccggtacg

SEQ ID NO: 23027 - DNA, 792 bp, Homo sapiens
  misc_feature: GYAE6OF02HITEJ.12.40.D07.1.454.CMB.1.raw
  modified_base (148)..(148): a, c, t, g, unknown or other
  misc_feature (148)..(148): n is a, c, g, or t
  modified_base (784)..(784): a, c, t, g, unknown or other
  misc_feature (784)..(784): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggcacctggtggagtctggggganccgtggtccagccgtgggccgtcctgacactcgcctgtgtgcctctggattttccctctaatttctattccatgcacgtcgggtccgccgaggcctccgagggcaagggggtcctcggaggtgggtggacctacgttattgccgtacagtgattcggacgttaccaaataaattcctacggactaaacgttccgtggaacggggcccgtaattccgaccgtactccgtaccaagtacgaacctaaagttaccgaaacgtaaacccttacccctttaaatcctacggaactaaaagtacgtaccaacggtaccgtaacggaacgtaacccgaagtaacccggaaccggtaaccgtacgttacgttaccgtttaactttaacgttccggaccggtaccggtaacggtaagggtaaccgtaccgtaaacccgtaaccgaaacccgttaaccgtacgggtaccctaaaacgtttaccgtaacgggttacggggttccgttttcggtaccgggttacggggacccgtaccgggggtaccctgggtacccgtagttccgttcccgtacccgtaccggtaccctacccggaacccgtaaccgggacctcgttacccggttcccttcccccggtacgggtcccnccgtaccg

SEQ ID NO: 23028 - DNA, 840 bp, Homo sapiens
  misc_feature: GYAE6OF02J0VQA.12.40.D07.1.454.CMB.1.raw
  modified_base (215)..(215): a, c, t, g, unknown or other
  misc_feature (215)..(215): n is a, c, g, or t
  modified_base (295)..(295): a, c, t, g, unknown or other
  misc_feature (295)..(295): n is a, c, g, or t
  modified_base (424)..(424): a, c, t, g, unknown or other
  misc_feature (424)..(424): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccggtggtccagccgtggggcggtccctgaccactcgcctgtgttgcctctggtactttcccttnaatttctattccatgcacgtcgggtccgccaggcctccgaggcgaacggggcctcggaggtgggtcgctacttatgcacntgatggacgtacaaactaattctaacgctaaacttccggtaggacgggggtccctatttaccgacctacttccgtacccaggaacgtaacctaaattaaccaaaacggtaacccttacccgttttaacncgtacgtaaccaaaagtagaacctacggtacctacggaacgaacccgtaaggaaccgacgacggtacgtacgttacttaacgtttacttacggtcggtaacggaacggtaacgacggtaacccgtaaccgtaaaccgtaaacccgttaaccgtaccgggtaaaccctaaccgttaaccgtaacgggttaccgggggttaccgttttacgggtttacccggggtacgggggtacccggtaacgggggtaaccccggtttcgggttacccgtaaccgttcccggtttacccgtaccccggtaacccggtacccccgtaacccggaaacccgggtaacccgggtaccccgttaccggtttacccccggggttaccccgtttaccccccggtaccgggtcccggtaccccccgttaacgg

SEQ ID NO: 23029 - DNA, 758 bp, Homo sapiens
  misc_feature: GYAE6OF02ICXFX.12.40.D07.1.454.CMB.1.raw
  modified_base (92)..(92): a, c, t, g, unknown or other
  misc_feature (92)..(92): n is a, c, g, or t
  modified_base (149)..(149): a, c, t, g, unknown or other
  misc_feature (149)..(149): n is a, c, g, or t
  modified_base (207)..(207): a, c, t, g, unknown or other
  misc_feature (207)..(207): n is a, c, g, or t
  modified_base (401)..(401): a, c, t, g, unknown or other
  misc_feature (401)..(401): n is a, c, g, or t
tcagatacgacgtacacgaccggtgctcgatttagtgatagagcgtaacaacagaggctcaccatggagtttgggctgagctgggttttccncgttgctcttttaagaggtgtccagtgtcaggggtcacctggtggagtctggggganccgtggccagcctgggcggtccctgacactcgcctgtgttgcctctggactttccctnaatttctattccgatcgcacgtgggtcccgccaggctccaggcaagggctcgagtgggtgctacttattcgcacagtgactggtccgtactaataaaacttctaacgactaaaacgttccggtaggtaccggggaccgtactttccgacctatctaccagacgtaactaagttacaaagtaaccacccttttanacgtgtaactaaacgtagaactacgtcctcggaacacccgtaagaacccggaacaacgggccttacgttaccgtttaagttaccgtttaggaccgttacgggtaaacggaacggttaacgaaaccgaaccgtaacccggtaaacttaccgttacgggtaaccaaacttaaccgggttagttaccgggggttcttacgggttcggtaccggggtaccgtacgggggtaccctaacggtccgaccgtccgttacccgtacccggtccgacccgttaacccgacccggaaaccggtccccgtacccgttcccgggtacccccgtttacccccgaccggttacccccgtcccgttacccgg

SEQ ID NO: 23030 - DNA, 845 bp, Homo sapiens
  misc_feature: GYAE6OF02JP23R.12.40.D07.1.454.CMB.1.raw
  modified_base (237)..(237): a, c, t, g, unknown or other
  misc_feature (237)..(237): n is a, c, g, or t
  modified_base (625)..(625): a, c, t, g, unknown or other
  misc_feature (625)..(625): n is a, c, g, or t
tcagatacgacgtacacgaccggtgctcgatttagtgatagagcgtaacaacagaggactcaccatggagtttgggctgagctgggtttcctcgttgctctttaagaggtgtccagtgtcaggggcacctggtggagtctgggggagccgtggtccagcctgggcggtccctggacactcgcctgtgttgcctctggactttcctcaatttctattccactgccacgtcggggtccnccaggtcctcccgaagggccaaaggggggtcctcgggtacggttggggtcgggtcctaaccgtttaagtttcggacgaacctaagtggaaacgttggggtccggttaccaaaacctaaacgtttcgtaacccggtctaaaaacgtttcccggttacggaggggggtaccctaactttccgaaaccctaagtccctccggaaagaccgaacttaaactaaccgtaaacggtaaacccttaaccccgttttaatacccgttacggaaactaaaacgttacggaaaccgttaacgaccgtttaacggaacggtaccccctaaaagggaccggtaaaccgtacgggtacctaggttaacccttaatttacgttacgtcggacgaaccggtanaacggtacaaaccgtacgaaaccgttcgtaaggacccaaagttaacgtagggtcgggtaccttggtaccggtcggggtaccgtacggggtaaaccctggtaccgtacgtccggttaccctccccggtaaacggtccccgttaccgaaacccggtaccggtacccgttacggtaccccggttcccgttaccccccggtcggtacccggtccccgttaccgg

SEQ ID NO: 23031 - DNA, 1031 bp, Homo sapiens
  misc_feature: GYAE6OF02HN1CR.12.40.D07.1.454.CMB.1.raw
  modified_base (150)..(150): a, c, t, g, unknown or other
  misc_feature (150)..(150): n is a, c, g, or t
  modified_base (357)..(357): a, c, t, g, unknown or other
  misc_feature (357)..(357): n is a, c, g, or t
tcagatacgacgtacacgaccggtgctcgatttagtgatagagcgtaacaacagaggactcaccatggagtttgggctgagctgggtttcctcgttgctctttaagaggtgtccagtgtcaggggcacctgggtggagtcgtgggggganccgtggtccagccgtgggccgtccctagacactccgcctggtgttcgcccttgtacggtactttcccttataaacttttcctaattccctaagtcgtactacgttccggggtcccgccgaggtccttaccggaagggtacccggaaggggggtacctcggggtaaggtcggggtacgggtaccttaccttaaggttcgaccaacgtntagtacgtcgggtacgtaccaaaacgtaaaccgttcgtaaccggtactaaacgttccggttaagggaccggggtaccttaaccttaccgaacctactccgtacgaagtacgtaactaaacgttaacaaacggttaaaccctaccttaagtccgtactaacgaaaaacgtcaaacccgtcggtacgttacgaaacgtaacccggaaacggacgggttaaccgaaccggttaccgttacgttaacccttaagttacgggttcgtaccgggtacggtaaacgtaaccggaacggtaaaccgttaaacccggtaaaccgtaaaccggtttaaccggtaaccggtaacccggttaaaaaccggtttaacccgggttaaacggggttttaccgggggggtttacccggtttaaacgggttttacccggggtaaccccgggggggttaacccgttaaaacccgggggggggttaaccctttaccccggggttaaccggttacccggttaaccccggtttcccccggtacccccggtaacccgggtttaacccccgtaacccgggttaaaccccggttaacccggggtaaccccgttttaacgggttacccccccggggttttaacccggttaacccccccggggtcccgggttttccccgggaaccccgtttcccccgggg

SEQ ID NO: 23032 - DNA, 814 bp, Homo sapiens
  misc_feature: GYAE6OF02INBRZ.12.40.D07.1.454.CMB.1.raw
  modified_base (154)..(154): a, c, t, g, unknown or other
  misc_feature (154)..(154): n is a, c, g, or t
  modified_base (476)..(476): a, c, t, g, unknown or other
  misc_feature (476)..(476): n is a, c, g, or t
tcagatacgacgtacacgaccggtgctcgatttagtgatagagcgtaacaacagagggctcacatggagtttgggctgagcgtgggttttcctcgttgcttcttttaagaggtgtccagtgtcgaggggcaccgtgggtggagtcgtggggganccgtggtccagccgtgggcggtcccgtgacactcgccgtgtgttcgcctgtagtctttccctactaatttctatcagtcgcacgtcgggtccgcaggctcgaggcgaacgggctcggaggtggggtacgctacgttagtgacctaatagtggacgtcggtacgtaacgtaaactaaagttccgtaacgaacgtaaaacgtttccggtaggacggggtacctacgttaccacctacgtccgtaacgacgaacttaacgaaagttaacctaacggtaaacccttaccttttacacctaacggtaaaccaaataacggtaaccgngtaacccgtagaccggtaaacccagggtaacccgacggaaacgtccgtacggttaacgttaacgttacgttaccggacggtaaccgtaggaaggaacaaccgaaaccgaaacgtacccgtaacgtacgaaacctaaggttaccgtaacgggttacgggtaccgtttcgttacccggtacggggtaccggtaacccggggttaccgtacgggttacccgtaggttacccgttacccgttaccccggaacccgttacccgaaccgggttacccggaccggaccccggttacccggtaacccgaacggtaaccgaacccggaccgttacggggacccccgg

SEQ ID NO: 23033 - DNA, 844 bp, Homo sapiens
  misc_feature: GYAE6OF02JOYE5.12.40.D07.1.454.CMB.1.raw
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
  modified_base (775)..(775): a, c, t, g, unknown or other
  misc_feature (775)..(775): n is a, c, g, or t
tcagatacgacgtacacgaccggtgctcgatttagtgatagagcgtaacaacagaggactcaccatggagttgggctgagctgggttttcctcgttgctcttgtaagaggtgtccagtgtcaggggcaccgtggtggagtcgtgggggagtccgtggtccagccgtagggcgtccgtgacnctcgcctgtgtgctntggtactttcctgaattttcacttaccgattcgctacggtcgggtccaccgaggcctccgaagggccgtaaagggggtccctaggaggttcggggtaggcctaactttacgttggccaacgttagtggacgttcgggactacgaaactaaaacctttcgtaaccgggacttaaacgttccggtaggtacgggggtcctaagtttccggaccaacgtttccgtaccaagggtaaccaaacggtaacttaccgaaacgtaaccgtaaccccttttagcctaacgtacaaaagttacggaaacgtacgggaccttacggaaaccggaaccgtaacgggtacccggaacgtaaccgggtcgttaacggttaccgtttaaaggtttaactccggggtacgggtaccgtaaagggtaaccggtaacggaacctaaccggtaaaacccggaccgttaacgaccggtaacccctaagttaccgttaacgggtcggggttacgtttcggtaccgggtacggggaccgtaccgggggttaacctcgggttaccgacggttaccggtccgtaccccgaacggtttacccncccggtaacggaacggtccccggtagttcccgggtaccccgtttcccgggttccggacccggtcccggg

SEQ ID NO: 23034 - DNA, 705 bp, Homo sapiens
  misc_feature: GYAE6OF02GCMZL.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtgggggagccgtggtccagccgtgggccggtccgtgacactcgccgtgttgttgcctcgtggtactttccttactaatttctattccatgcgtacgtcgggtccaccgagcctaccgaggcgagggtctcggaggtgggtcgctagtttagtcgctagtagtgtacgtcggctaacaaactaacgtttcacggtactaacgtcggtaggcgggaccttctacgactatccgacagaactactaaagttaccgaaactaacctaccttatacgtagaaaacctaagtaacgacacggtacctaacggaccgtacgtaacgaaaccgacgacggtaattacgtaactttagtacgttcgacggtaacgacgtaagaacgaccaacgtaaccgtaccgtaacgtacgtaacctaagtacgttaggtccgggttctttcgggtaccgggtcggaccgggttaacggtaccggtcgttaacgcttcccgcttacccgcgtaacccgccaacccgggtaccgaccccgttcccggttacccctccgtaccggtccctacccgagtcccg

SEQ ID NO: 23035 - DNA, 820 bp, Homo sapiens
  misc_feature: GYAE6OF02JAZR3.12.40.D07.1.454.CMB.1.raw
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
  modified_base (345)..(345): a, c, t, g, unknown or other
  misc_feature (345)..(345): n is a, c, g, or t
  modified_base (594)..(594): a, c, t, g, unknown or other
  misc_feature (594)..(594): n is a, c, g, or t
tcagatacgacgtacacgaccggtgctcgatttagtgatagagcgtaacaacagaggactcaccatggagtttgggctgagcgtgggttttcctcgttagctcttttaagaggtgtccagtgtcagggcaccgtggtggagtcgtgggggtagccgtggtccagctgggcggtccctgacactcgcctgtgttcgcctntggtactttcccttnaattttcattacccatcgtcacgttcggggtccnccgtaggcctcccgaagggaccgaagggggccttaggagggtttcggggtacggtaccgtacgtttagttggcctacagttagagttcggacctaanaaacctaagtttcccgaactaactaaaacgtttcccggtagggtacggggtaccgtaacgtttcaaacccggtatcccgttacaaggtacgaaccttaaaacgtttaacgaaaacgttaccctaaacccttttaagccgttagaaactaaacgttaggactaacgtccgtaagaaccgacctaaggaccgaagtaccgcgtcggttacttaacttacgttgccgtaaggaacggaagacgaaccgtaanaaccgtaaacccgttaacgacgtaccgaaacgttagtacgggtttagggttccgtttaccgttccgggggtagggaccccggtaacgggggtcccgttacggtaaccgtcttcccgttaaccgttcccccgaacggtacccttaaccggacccgggttaaaccggaccccgtttacgtacccccggtttcccggtacccgtcccgggacccttcccgttacccggg

SEQ ID NO: 23036 - DNA, 734 bp, Homo sapiens
  misc_feature: GYAE6OF02IFXHD.12.40.D07.1.454.CMB.1.raw
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctgggtggagtctggggggagcccgtgggtccaggccctgggtacggtcccgtgacgacgtcggcctgttgttcgccttctggtattttccccgtanaatttcgtaattccagttgcacgtgggtccaccaggcctaccaagggcgaaggggctccggaggtgggttcgactacttagttgcaaccagtanaggttcgggcttaaccaataaaacttcctaaacggtctaaaacctttcggtaggtaccggggaccgtactttaccaccctaagtccgtacccgaagacgtaactaaatttaaccggaaacgtaacccttaacctttacggtataccgactaaagagaaccttggaccttaagaccggaccgtagaaccgtcgtaacgggtctcttagttacgtagttcgaccggacgtacggtaagacggactaacgtaacccgactacgacgtacgaaaacttcgaaccggttgggacttcgggttacgtcgggaccggtacggtaccgtgtacgcgtacgtccctacccggactcccgtacgaacccggttaccgaccttcgttacccggttccgtacccggtctccccggtccgtaccgg

SEQ ID NO: 23037 - DNA, 746 bp, Homo sapiens
  misc_feature: GYAE6OF02HQP43.12.40.D07.1.454.CMB.1.raw
  modified_base (214)..(214): a, c, t, g, unknown or other
  misc_feature (214)..(214): n is a, c, g, or t
  modified_base (245)..(245): a, c, t, g, unknown or other
  misc_feature (245)..(245): n is a, c, g, or t
  modified_base (374)..(374): a, c, t, g, unknown or other
  misc_feature (374)..(374): n is a, c, g, or t
  modified_base (427)..(427): a, c, t, g, unknown or other
  misc_feature (427)..(427): n is a, c, g, or t
tcagatacgacgtacacgaccggtgctcgatttagtgatagagcgtaacaacgagagggctcaccatggagtttgggctgagctgggttttcctcgttgctctttaagaggtgtccagtgtcgaggggccacctggtggagtcgtggggggagccgtggtccagcctgggccggtcctgacactcgcctgtgttgcctctggtactttcccttntaatttctattccatcgccacgtcgggtccnccgaggcctccgagggccgaaggggctcgaggtgggtcgctacttattgctacgatgatgggctacaacgaacttcacgacaaacgtttccgtaggaggggtcctacgtcctaaccattccgacctagngaacgtaattaacaagtaaacctccttactctagacaaatacgacacgcctanacgtacagtaccgacgtacgtactacgtttaccttaaagttcgttacggacgacggtaggaacgaacgtaaccgaacgtaaacccggaacccttacgtaccgggtaacctaaaccgttaacgttacgggtaccgggggttctttacgggttcccggtagggggaccccgggtaacggggtaccccgtagggttaccctacggttcccgttaccccgttacccggaacccgtccccgtaacccgtaaccggacccgggtacccgttaccggttacccgttccccggtccccccgttacggtccccggtacccttcccggg

SEQ ID NO: 23038 - DNA, 1141 bp, Homo sapiens
  misc_feature: GYAE6OF02GRHNL.12.40.D07.1.454.CMB.1.raw
  modified_base (212)..(212): a, c, t, g, unknown or other
  misc_feature (212)..(212): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtactttcccttntaatttctacttccatgcacgtcgggtccgccgaggcctccgaggcgaacgggggtctacggaggtggggtcggacctaacgtttattcgacactaagtgaactggggaccgttaacaaaacgtaaaacttccgtaaccgaacctaaaaacgttttccccgggttagggaaccgggggggtcccctaaagtttacccgaaccctaagtttacccctacccgaaaggaaccggtaaaactaaaacgtttaaacccgaaaaacgttaaaaccccttaccccttttaaagtcccgttaaggtaaccctaaaaaagttaacgggaaacctaaacgggtaccccttaagggaaaccgtaaaccccgtaaagggaaacccggtaaccgaacccggggttaacccgtttaaccggttttaacccgtttaaaagtttttaacggtttacgggaacccgggtaccgggtaaaggggaaacggtaaaccggggaaaacccaaacccgggtaaaaaccccggtaaaaccccggttttaaacccggttaaacccggggaaaaccccttaaaaaaccggttttaaaccgggtttaaacgggggtttaaccccgggggggggtttaccgtttttaacccggggggttttcccggggttaacccggggggggtaaaccccggttaacccggggggggtaaccccccggttttaaggggtttaccccgtaaacccgggttttacccgggtttaacccccccgttaaccccccggtaacccgggtttaaccccccgttaacccccggggtaaaaccccggttaaacccccgggggggtccccccttttaaacccggggtttcccccggggttttacccccccggttaaccccccccggggttttaccccggggaacccccgttccccccccgggtttaacccgggg

SEQ ID NO: 23039 - DNA, 809 bp, Homo sapiens
  misc_feature: GYAE6OF02F6HCP.12.40.D07.1.454.CMB.1.raw
  modified_base (150)..(150): a, c, t, g, unknown or other
  misc_feature (150)..(150): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (308)..(308): a, c, t, g, unknown or other
  misc_feature (308)..(308): n is a, c, g, or t
tcagatacgacgtacacgaccggtgctcgatttagtgatagagcgtaacaacagagggctcaccatggagtttgggctgagctgggtttcctcgttgctctttaaggaggtgtccagtgtcgaggggcacctggtggagtcgtggggganccggtggtccagcctggggcggtccctagaccgactcgcctggtgttcgcctntggattccctntaatttctatccatncacgtggtccncngcctcgngacgagggctggacggtgggtcgactacgttagtcgcacacgtgtaacgtgggccgtanaaactaaacgttctaaccgtactaaaacgttcccggtgggaacggggttccgactttaccaccgtactcctacccgaagacgtacctaaaacttaaacgaaacggtaacctaaccccctttttaagtaccgtacgtaaaccaaaagtttaaacgacaacggtaccgttacgaacggaaacccgtaaggaacccgaccggtaacggaccgtacggttaccttaacgtttacgttacgtaccgaccggtaaggtaacgaacggtaacgaaccgtaaaccgtaaccgtaacccgttaaccgacccgtaaacaacgttaacggtacggggttacgtttcggttaccggtaccgggtcgggtaaccgggtaacccggttcgggtaccgtccgttaccggtcccgttaccccgacgtacccctacccggtaacccggtaacccggtacccgtacccgttcccgttaaccccggttcccccggtacggtacccccgtcccgtacccgg

SEQ ID NO: 23040 - DNA, 587 bp, Homo sapiens
  misc_feature: GYAE6OF02HJEPV.12.40.D07.1.454.CMB.1.raw
  modified_base (234)..(234): a, c, t, g, unknown or other
  misc_feature (234)..(234): n is a, c, g, or t
  modified_base (382)..(382): a, c, t, g, unknown or other
  misc_feature (382)..(382): n is a, c, g, or t
  modified_base (434)..(434): a, c, t, g, unknown or other
  misc_feature (434)..(434): n is a, c, g, or t
  modified_base (454)..(454): a, c, t, g, unknown or other
  misc_feature (454)..(454): n is a, c, g, or t
  modified_base (484)..(484): a, c, t, g, unknown or other
  misc_feature (484)..(484): n is a, c, g, or t
  modified_base (525)..(525): a, c, t, g, unknown or other
  misc_feature (525)..(525): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggcctccaggcaaggggctcggagtgggtgcattattgcacatgatggcgtcaaacaaattctaagctaaattccggtagacgggggccattcaccatcctcagagactaattacaagaacctacccttatctagacaaaagtanaacacgcctagacgacccagacgaacacggactgtactattattgcgacganagagacaacacgaacctacncggaccaaatactagtggggtcttgttcgnggggaccgacggggtaccctaggtcagtcgtctaccccgtnccctccgaaccgaccgggacccacgttccgggtacccttcccccgcggtaccgtccccgtcg

SEQ ID NO: 23041 - DNA, 726 bp, Homo sapiens
  misc_feature: GYAE6OF02FN554.12.40.D07.1.454.CMB.1.raw
  modified_base (198)..(198): a, c, t, g, unknown or other
  misc_feature (198)..(198): n is a, c, g, or t
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
tcagatacgacgtacacgaccggtgctcgatttagtgatagagcgtaacaacagagggctcaccatggagtttgggctgagctgggttttcctcgttgctctttaagaggtgtccagtgtcaggggcaccgtggtggagtcgtggggggagccgtggtccagcctgggcggtccctgacactcgcctgtgttcgcctntggtactttcccttctaatttctattccatgactcgtcgggtccnccgaggcctaccgaggcgaaggggctcggaggtcgggtaggctacttntcgcaacgntgtagtggctacaataattcactactaagttccggngacgggtcattcgacctagcctacagtaacgactaaatacaaacgtaacctaccttatactacgaactaaactacgaacacgtacccgtaggaaaccacgacgaaccgaccgaccgtcgagttacttaagttacttaggaccgtacgtaacggaacggtaacgtaaccgaaccgtaaccgtaacccgtaccgtacggaacccgtaaagttaaccggttaagggtcggggttaccgttttacggggtacggttaccggggaaccgtaaccgggtacccgttagtaccgtaccgtaccgttcccggtaacccgtacgtaccccgtaccgtaacccggaccgtaccgtaccggtcccggttccccgtaccccggtaccggccgtcccgtaccg

SEQ ID NO: 23042 - DNA, 862 bp, Homo sapiens
  misc_feature: GYAE6OF02HWO1H.12.40.D07.1.454.CMB.1.raw
  modified_base (149)..(149): a, c, t, g, unknown or other
  misc_feature (149)..(149): n is a, c, g, or t
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcgtcctgacactcgcctgtgttgcctctggtactttcccttnaatttctattccatcgctacgtcgggtccnccaggtcctcgaggccaaggggctcggaggtgggtgctacttagttcgacgacgtataggacgttcgggcgtacaaaacgtaaactttccgaaccggtacctaaaacggttttccgggtaggggaaccgggggtcccgtaactttacccgaacctacgttcccgttaaccgaaggtacgtaaacctaacgtttaaaaccggaaaccggttaaaaccctttaccccttttaaagtaccgttaaccgggtaaaccttaaaaaacggtcgggaaacctaacggttacccggttaacggaacccggtaaaacccgtaaaccgggaacccggttaaaccggtaacccggtcccgtttaacgggtttaacctttaacgttttaacggttacggaccggggtaccggtaaaggtaaacggaacgtaacccgaaacgtaacccggttaaacccgttaacgtacgggtaaccctaaacgttacggtaacgggttggggttaccgttcgggttccgacggggtaccggtaacgggtaccgtggtacgtacgttccgtaccctacccggacgtcccgtaccgaaccgtaccggtaccacggttccgtccccgttccggccggtcccgtcctccgg

SEQ ID NO: 23043 - DNA, 668 bp, Homo sapiens
  misc_feature: GYAE6OF02GY5BU.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcggtccctgacactcgcctgtgttgcctctggtatttcccttctaatttctattccatgcacgtgggtcccgcgaggctccgaggcgaaggggctcggaggtggggtgctactttatgcaatatgagtggcgtacaaactaaattctacgactaaaagttccggtggacggggtccgaattaccacccgtatcctaccaggacgaactaaattaacaaacgaaactacccctttaatcgtagaactaaattacgactaacgcctagaacgaaccagaacgacgacgtctgtactattatcggcgcgaagagaacgaccacgaaccaacctacgtcgaactaactacgtaggttcggggtactttcggttacggtacggggtacccggtaccggggtacccgtggttacccgaccgttccttcctacgtaccgcccgtacgaacccgacggcccttacggtcccggttccctacccccggttcggtccccgtccgtaccgg

SEQ ID NO: 23044 - DNA, 818 bp, Homo sapiens
  misc_feature: GYAE6OF02HUUCS.12.40.D07.1.454.CMB.1.raw
  modified_base (294)..(294): a, c, t, g, unknown or other
  misc_feature (294)..(294): n is a, c, g, or t
  modified_base (540)..(540): a, c, t, g, unknown or other
  misc_feature (540)..(540): n is a, c, g, or t
tcagatacgacgtacacgaccggtgctcgatttagtgatagagcgtaacaaacgagagggctcaccatggagtttgggctgagctgggttttcctcgttgctcttttaagaggtgtccagtgtcaggggcacctggtggagtcgtgggggagccggtggtccagcgtgggcgtccctgacactcgcctgtgttgcctctgtactttccttctaatttctattccatgcacgtgggtcccgaccaggcctccgaggcgaacgggctcggaggtggtgactacttattcgactacngtagatggcgtaactaacgtaatttaccgaacgtacctaaacgttccggtagggaacggggtccgtacttacgaccctattccgtaccgtaagacgtaaacgtaactttaaacgaaacgtaaacccttaacccgttttataccgtaggtaacctaaaagttaacgacgtacgtacccgtagaaccgaaccgaacgtaccgacaccggtcttacgtacttagttacgtcgcggtacgagacggaacncgaaaccgtaacgtaaccgtacgaccggtaaccttaaacgtcggttaacgggttcgggtaccttttacgggtccgggttaccggggaccgggttaaccggggtttcccaaggggtttacccaccgggtttacccgttaccccgggtaccccacccggttaacccccgttaaacccgggaaccccgttaacccgggggtcccccgttaacccgggttacccgggtttccccccggttttacccccccggcggggttaccccccttaccccggttcccgg

SEQ ID NO: 23045 - DNA, 871 bp, Homo sapiens
  misc_feature: GYAE6OF02GJK0W.12.40.D07.1.454.CMB.1.raw
  modified_base (224)..(224): a, c, t, g, unknown or other
  misc_feature (224)..(224): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcaccgtggtggagtcgtgggggagccgtggtccagccgtgggccggtccctgactacctcgccctgttgttcgccctcgtcggtacttttccccttntaactttcttacttcccaagttcgacctacgtcggggttcccgcccgtacgggcctccggaagggaccggaaagggggtccttccggagggttggggggtacggaccttaaccgttttaagttcgacctaaccgtaagtcgagtcggaccgttacaaaaacttaaacgttccgtaaccgacttaaaacggtttcccggtaaggtacgggggccttaacttacccgaaccgtaactcccgtaacccgaagtaaccgtaaacttaaacttaaccgaaaacgtaaaccctttaacccgtttatcgtacgtaactaaaagtacgaacctacgtacgtacggaaccaccgaacggaaacccgtcgtaaccggtcgttacgttaccgtttaacgtttacggttaggacccgtaggaaacggacgggtaaacaaccgtaaccgaaacccgtaaacccgtacggttaaccgaaccgttaaacgtaaccggtaagggtcgggtttaccgtttagggtccggtcggggaacccggtacgggtaccggtacgtcgttaccgttcccgtacccgtccgacccgtaccctaacccgtaccggtaaccggtcccgtaccggtcccggttccccgtcccggtccggacccgtcccgtaccgg

SEQ ID NO: 23046 - DNA, 718 bp, Homo sapiens
  misc_feature: GYAE6OF02JM24B.12.40.D07.1.454.CMB.1.raw
  modified_base (242)..(242): a, c, t, g, unknown or other
  misc_feature (242)..(242): n is a, c, g, or t
  modified_base (413)..(413): a, c, t, g, unknown or other
  misc_feature (413)..(413): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccgtggtccagccgtgggcggtccctgacactcgcctgtgttgcctctggactttcccttcaattttctattccatcgcacgtcggggtccnccaggctccgaggaccgaaggggccttcgggaggtgggtgcctaacgtttatcgacgactacgttgagtcggtctacaaacgtaaattccgtacgactaacgttccgtgggacgggcctatccacatctaccgaagacaacctaatacgaaactaacctaccgttatcganaactaaatacggcagtctacgacgtacacgaacgcgtccggtactacgttacttaacgttacgttacggtacgtacggaacggtaacgaacgtaacaaacccggtaccaaccggttaaccgtaacgtaacctaacgtaacgtaaggttccgggtacgtttacggttccggtacgggtaccggtaaccgggtcggttaccgtacgtaccgtccgttaccgcccgtaacggtccctaaccggacccgtaaccggaccgtaccggtcccggttaacccgttccccggcggttacccgtcccgtaccgg

SEQ ID NO: 23047 - DNA, 677 bp, Homo sapiens
  misc_feature: GYAE6OF02ILV6T.12.40.D07.1.454.CMB.1.raw
  modified_base (461)..(461): a, c, t, g, unknown or other
  misc_feature (461)..(461): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctggtggagtcgtggggggagccgtggtccagccgtggggcggtccctgacactcgcctgtgttgcctctggtactttcccttctaattttctattccatcgcacgtgggtcccgccaggcctaccgaggccgaagggggctcggaggtggggtaggcctacgtttattcggcacacttgatgggcgtacaaacaaattctaacgactaaacttccggtgacgggggcctaatttcaccatcctaccagagacaattacaagaacctacctttaatcacgacaaatagacagcctagacgaccagaccgaactacggcttgtactaattntggcgacggagagaagacgaacaaccgaacctacgtcgacctaaatacgttaggtacgggggtcctttacgggttcggtacggggtacccgaacggggtacccgtgggtacctaggttcccgtaccgtccccgaaggtccccttacccgaacccggacgggacccctaggttccccggttcccgttcccccggtaggtccccggtcccgtacccgg

SEQ ID NO: 23048 - DNA, 582 bp, Homo sapiens
  misc_feature: GYAE6OF02FNVW8.12.40.D07.1.454.CMB.1.raw
  modified_base (314)..(314): a, c, t, g, unknown or other
  misc_feature (314)..(314): n is a, c, g, or t
  modified_base (367)..(367): a, c, t, g, unknown or other
  misc_feature (367)..(367): n is a, c, g, or t
  modified_base (450)..(450): a, c, t, g, unknown or other
  misc_feature (450)..(450): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttatgcacatgatggcgtcaactaattctacgctaaattccggngagggggccattcaccatctaccagagacaattacaaagaacctaccctttanctagacaaagtagacagcctagacgacccagaaccgacgacggctgtactattattgcgacgagagagacacacgaacctacncgaccaatacctagtggggcttcgtcgtggggccaggggtacccttggttactcgtcctcccgacgtccctaccgaccgacgggaccctagttcccggttcccttcccccggcggcccgtccctcgtacccg

SEQ ID NO: 23049 - DNA, 886 bp, Homo sapiens
  misc_feature: GYAE6OF02GPGPB.12.40.D07.1.454.CMB.1.raw
tcagatacgacgtacacgaccggtgctcgatttagtgatagagcgtaacaacgagagggctcaccatggagtttgggctgagctgggttttcctcgttgctcttttaagaggtgtccagtgtcgaggggcacctggtggagtcgtgggggagccggtggtccagcctgggcggtccctgacactcgcctgtgttgcctcgtggtactttcccttctaattttctattccattcgctacgtcgggtccgccgaggcctaccgagggacgaagggggtcctacgggaggtggggtcggctacgtttattgactactatgagtcggaccgtacaaaactaaattccgtaacgacttaaacgtttccggagggaaccggggtcctacttccgaacctcgttcctaaccgaaggtaacctaactaaacttaaccgaaaacggttaacccttaaaccccgttttagtaccgtaacgaaacgtaaaaatacggtaaccaacggtccctaagggtaacgaacccgtaacgaacccggaccgtaccgggtactttacgtacgtttaaacgtttcggtacggaccgtacggtaacggaacggtaaacgtaacccggtaaccgtaaaacccggtaaacccgtttaacggaaccgggtaaaccgttaaaacgttaccgggttaaacggggtttcccggggggtactttttaccggggttacgggtaccgggggggtacccggttaaaccggggtccccgtagggtacccgtaccgtttccccgtacccgtaccccgtacggttaccccgtaaacccggtacccgggaaaccggttcccctaccggttacccggttaccccccgttccccggtaccgggtacccccgtcccgtaccggg

SEQ ID NO: 23050 - DNA, 818 bp, Homo sapiens
  misc_feature: GYAE6OF02FLHBE.12.40.D07.1.454.CMB.1.raw
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccggtggtccagccgtgggcggtccctgacactcgcctgtgttgcctctggatttcccttctaatttcctattccatgcacgtcgggtccgccacggctccaggcgaaagggggctcggacggtggggtacggctacgtttagtgcaacatcgagtcgggacgtacaaactaaactttctacgactaaagttccgtaggaacggggcctattccacctacgtcctaccgaagagtaaccgaaaatttacaaaacccgtaaactaaccccttttaagtaccgtagtaacaaaattaccggaaacctaggcccttaggaacgaacccgaaagggaaccgtaaccggacccggtacgtacgttaccttaaagtttaacgttcggaccgtaacgaaacgggtaaaggaaccgaaaccgaaacccgtaaaccggttaaacccctaacggtaccggtaacccttaaaaccgttaacgggttaaggttccggggggtttaccgtttacggtttccgggtaacgggggtacccgtaaccgggggtacccttaggggtaccgtacgttcccgttacccgccccggtaacgacccttaccccggaacggttaaaccccggcccgttacccgtccgggttaacccctttcccccggacggtccccggacccgttaccgg

SEQ ID NO: 23051 - DNA, 736 bp, Homo sapiens
  misc_feature: GYAE6OF02JBNQQ.12.40.D07.1.454.CMB.1.raw
  modified_base (145)..(145): a, c, t, g, unknown or other
  misc_feature (145)..(145): n is a, c, g, or t
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (705)..(705): a, c, t, g, unknown or other
  misc_feature (705)..(705): n is a, c, g, or t
tcagatacgacgtacacgaccggtgctcgatttagtgatagagcgtaacaacagagggctcaccatggagtttgggctgagcgtgggttttcctcgttgcttcttttaacgaggtgtccagtgtgaggtgcagctggtgagtcgnggggagcttggtcagcgtgggggtcccgagagtctctgtacactcnggattnatgttagtacntattgatgacgtgggtccncgtaggctccgagggggaacgggctggagtggggtcgaccaaacgattaaacgacgaagagttaggaacgttgaacgtaaaataccgtagtgtaggtacctcgtaggtcggaacggggacctacgttactaacaactccccgtacaggaacgacaaaccgccgaaaacaccgtactactacgtaacttctacgaactaaaaacgttaacacgggtacctaaggaaacggtaccggaacgtttaacgcgggacgtttacgttggtttacgttttcgtagtacgggtcgggaacgggtaccggtttaacccgtgggtttaacgaaacttttaaacgttacgttaaccgaaactaacgtaaacggttaacttttaccggttacgaaccctaacggacccgtacttaaccttaacgtttaccgttaacgacgaccggtcgacgggtaccgacgggaccctttgaccgttactcccgtaaccnccgtaccacccgtacgtacccgaccgtcccg

SEQ ID NO: 23052 - DNA, 841 bp, Homo sapiens
  misc_feature: GYAE6OF02F77YK.12.40.D07.1.454.CMB.1.raw
  modified_base (148)..(148): a, c, t, g, unknown or other
  misc_feature (148)..(148): n is a, c, g, or t
  modified_base (208)..(208): a, c, t, g, unknown or other
  misc_feature (208)..(208): n is a, c, g, or t
tcagatacgacgtacacgaccggtgctcgatttagtgatagagcgtaacaacagagggctcaccatggagtttgggctgagctgggttttcctcgttgctcttttaagagtgtccagtgtcaggggcacctggtggagtctggggganccgtggtccagcctgggcggtccctgacactcgcctgtgttgcctctggtatttcccttnaatttctattccatgcacgtgggtccgccaggcctcaggcaagggctcgaggtgggtggctacttatcgcacatgatggcgtacaaacaaatttctaccgacaaacgtttccggagggtacggggccctaacgtttccaacccgtattacctacccgaaaggtaccggtaaacctaaaagtttaaccgaaaaacggtaaacccgttaacccctttttaagtcccgttaacgggaaacccttaaaacgttaaacgggaacccttaaacggtaccccgttaaggaaaccggaaacccccgtaaacgggtaacccgaacccggtaaaccgggttacccgtttacgtttaccgtttaaacgttttaacgtttacgggtaccggtaaccgggtaacgggaacggtaacggaacccgaaaccgtaacccgtaaaccgttaaccggtaccggaacctaaacgttaacgttagggttacgggggttccgtttacgggtttccggtacgggggtacccgtaaccggggtaccccgttgggtccgtaacgttccgtaccctcccgacgtccctacccggtacccgtaccggacccgtaacgtccggttacccgttccccggtacggtcccgtcccgtacccgg

SEQ ID NO: 23053 - DNA, 824 bp, Homo sapiens
  misc_feature: GYAE6OF02JGUN3.12.40.D07.1.454.CMB.1.raw
  modified_base (148)..(148): a, c, t, g, unknown or other
  misc_feature (148)..(148): n is a, c, g, or t
  modified_base (210)..(210): a, c, t, g, unknown or other
  misc_feature (210)..(210): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtgagtctggggganccgtggtccagccgtgggccggtccctgacactcgcctgtgttgcctctggtactttccctnaattttctagttccatcggccacgtgggtcccaccgaggtcctccgagggcctaaggggcctggagtggggtcgctactttagtgcccagtatgatcgggtctaccaacgtaaacttccgtacggctaaactttccggaggaccgggggtaccctaatttccaccccgtaattccgtacccaagggacaaacccttaatttaacccgaaaagtaaaccccttaccccgttttaagcctagtaaaccgtaaaactttaagggacctacgtcccgttaagaacgtacccgaaacgacggtaccgtaccgggtacccttaggttacccttaaagtttccgttaggtaccggaaccggaggtaacgaaacggaacctaaacccgaaccgttaaacccttaccgtacggaaccctacggttaacccgtagggttacggggtaaccgtttcggtttaacggggtacccgggtccggtaacccgggggtccctacggttacgtcccgtttacccggtacccgttcccccggacccgttacccgtacccggaaccccggtaaggtccccgtccgttcccgggttaccccttccccggtcccggaccccggtcccgtacccgg

SEQ ID NO: 23054 - DNA, 798 bp, Homo sapiens
  misc_feature: GYAE6OF02HBJ2I.12.40.D07.1.454.CMB.1.raw
  modified_base (152)..(152): a, c, t, g, unknown or other
  misc_feature (152)..(152): n is a, c, g, or t
  modified_base (442)..(442): a, c, t, g, unknown or other
  misc_feature (442)..(442): n is a, c, g, or t
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
  modified_base (792)..(792): a, c, t, g, unknown or other
  misc_feature (792)..(792): n is a, c, g, or t
tcagatacgacgtacacgaccggtgctcgatttagtgatagagcgtaacaacgagagggctcaccatggagtttgggctgagctgggttttcctcgttgctcttttaagaggtgtccagtgtccaggggcacctggtggagtcgtggggganccgtggtccagccgtgggcgtccctgacactcgcctgtgttcgcctcgtggactttccctcgtaatttctaattccatcgcctagtgggtcccgccaggtcctccgaggcgtaaacgggggtcctacggaaggttggggtcgactaccttagttcggaccacaattggattcggacgtacaaactaattcctaacgactaaacgtttccgcggtaacggggccctaattccaacgtacttccgtaccaggaacgtaacgtaactttacggaaactaaccgttccccttanctacggaacaaaagtcaacncgacctanaacggaccgttacgacgagtaccggtactcggttactaacgttcgttacgaccgtaacggtacgaacgtaaggtacccaacggaaccctttaaacccgagttaccgggaaacctaaacgttcccgtaaagggttcgggggttaccttcgggttaccggaccggggttacccggtaacggggtaaccccttacggggtacttaacccggttcccggttaaccctaccccccggtaaggaccccgttacccgaaacccgggtacccggtaccccgttaacgtcccgggtttaccctttcccccgggacccggtcccgttacccncccggg

SEQ ID NO: 23055 - DNA, 706 bp, Homo sapiens
  misc_feature: GYAE6OF02JQRNW.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtgggggagccggtggtccagccgtgggcggtccctgacactcgcctgtgttgcctctggtactttcccttctaatttcttattcctatgctactcgggttcccgccgacggtcctccacgggcgaagggggccttcggacggtgggtgggactacttagttgcacagtgatggcgtacaaacgtaacttactacgtacgtaaactttccggtaggaacggggccgtaagttccacctacttcctaccagaacgactaaacttaacaaacgaaacctaccctttatctaaccgtacaaaacttacgactacggtacctacggaaccgaaccgtaacgaacggtaccaaccgggcttacgtacgttattacgtagtcggacgagaacgacacaaccaacgacctacgtacgaccagttacgtaaggtcggggttcttcggtccggtacgggtacccggtacgggaaccgttcggtacgtacgtccgtaccctcccgcctaccggtaccctaaccggacgtcccgtacgttcccggtacccttccccggacggtcccgtacccgtcg

SEQ ID NO: 23056 - DNA, 753 bp, Homo sapiens
  misc_feature: GYAE6OF02GVCWN.12.40.D07.1.454.CMB.1.raw
  modified_base (150)..(150): a, c, t, g, unknown or other
  misc_feature (150)..(150): n is a, c, g, or t
  modified_base (209)..(209): a, c, t, g, unknown or other
  misc_feature (209)..(209): n is a, c, g, or t
  modified_base (428)..(428): a, c, t, g, unknown or other
  misc_feature (428)..(428): n is a, c, g, or t
  modified_base (446)..(446): a, c, t, g, unknown or other
  misc_feature (446)..(446): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggganccgtggtccagcctgggcgtccctgacactcgcctgtgttgcctctggactttccctanaatttctattccatgcactgggccagctcaggacagggctcggagtgggcgactacgttagttcgccaacgtagttcggaagttcggaccggttaccaaacgtaaatttaccgtacgaactaaaacgtttccggtagggtacggggacctacgtaccaaccccgtattaccgtccgaagaacgaactaaacttaaccgaaagtaacctacccgttttanctacggaactaaaaggtnaacgtacggcctacgaacggtaccaacgtaccggaactaccgggactcggtactagtttacgtcggcgacggagacggtaacgaccgaacgaaccgtaaaccgtacggtaacgaccgttaaattccggtaagtccggggttacgtttcggtaccggtaccgggggacccgttaccggggtaacccggtcgggtttaccgaacgttcccggtaccctaccccggagtaccccttaacccggaaccggtacccgggtaccctacggtacccggtttccctaccccggtacggtccccgtacccgtccgg

SEQ ID NO: 23057 - DNA, 717 bp, Homo sapiens
  misc_feature: GYAE6OF02HUIIU.12.40.D07.1.454.CMB.1.raw
  modified_base (153)..(153): a, c, t, g, unknown or other
  misc_feature (153)..(153): n is a, c, g, or t
  modified_base (216)..(216): a, c, t, g, unknown or other
  misc_feature (216)..(216): n is a, c, g, or t
  modified_base (244)..(244): a, c, t, g, unknown or other
  misc_feature (244)..(244): n is a, c, g, or t
  modified_base (414)..(414): a, c, t, g, unknown or other
  misc_feature (414)..(414): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcagggggcacctgggtggagtcgtgggggganccggtggtccagcctgggcggtccctgacactcgcctgtgttgcctctggtacttttcccttntaatttctattccatgcacgtgggtccncgacggctccgaggaccgaaggggctgaggtgggtgcactttagtcgcacatgatggctacaagtaacttcaacgactaaacgttccggagggacgggacccgtatttccaaccgtattccgaccgagtaacgaactaagtaaaccgaaacgtaaaccctaaccttttanaccgtagaaacctaaaagttacgaaccgtactcccggtaagaaccggtaaacccaggaacccggtaccgacgggttactttacggacttttaacgttcgtggacgtacgggagacggacaaccgacaaccgtaactaccggtagacctaagttacgtgggtagggttccttaggtccggagggggttacccgaacgggtcgtccgtaccgacgtttcccgacctccccgacgtaccctaccgtaaccgaccggtaccctcggttcccgttccccttcccgggccgttccctaccccgtacccg

SEQ ID NO: 23058 - DNA, 873 bp, Homo sapiens
  misc_feature: GYAE6OF02HHZ23.12.40.D07.1.454.CMB.1.raw
  modified_base (182)..(182): a, c, t, g, unknown or other
  misc_feature (182)..(182): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcacctggtggagtcgtggggggagccgtggtccagccgtgggcggtccctgacnctcgcctgtgtcgcctctggtactttcccttctaattttcctattcccgatacgaccacgtcggggtacccnccgnggcctccgagggccgaggggctcggaggtgggtcgcctacttattcgacacgagttgagttcggctacaaaacgtaacttccgtaacgtacctaaaacggttccggtacgggaacgggggtaccttaattacccgtaccgtacttaccgttacccgaaaggaaccgttaaacctaaaagttaaacctaaaccggttaaaccctttaacccttttaagtccctaaggtaaccgaaacgtaacggtaacgtacggtacctaaggaaccgaccgtaacgggaacccgtaacgtaaccggtcttacgttaccgtttaatttacggttcgacgggtccggtaaagtcgggaaacaaccggtaaccgtaaacccggtaaacccgttaccgacgtaaacctaaacttacgggttacgggttaacgggttccgttttacgggttacgggttcccggggtaccgggtaaccgggttacccggttacgggtactttacggtacccccgttccgtaccccggcccgttaccccggaccggttaacccggaacccgtaccccggtttaccggtacccccggtttccccggttaccccggccgggttacccccgtcccggtttcccgg

SEQ ID NO: 23059 - DNA, 887 bp, Homo sapiens
  misc_feature: GYAE6OF02IYGCZ.12.40.D07.1.454.CMB.1.raw
  modified_base (241)..(241): a, c, t, g, unknown or other
  misc_feature (241)..(241): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctggggcgtccctgacactcgcctgtgttgcctctggactttcccttctaattttctattccaatcgctactgggtcccncctaggcctaccgaggcgaaggggctacggaggtgggtgcacttagtgcacagtgatggacctacaaactaaacttctaacgactaaaacgtttcccggtaggacgggggtccctaagtttccaaccctaagttaccctaccgaacggtaacgtaaacctaaattaaaccgaaaacgtaaaccctttaaccccgtttaataccgtaagaacccgtaaaaattaacggacaacgggtaccctaggtaaacgaacccgaacgggaacctaacccggaaccgggtaccttcgggttaaccttaaacttttacgtttacggaccggaacgggtaacggaacgggaacggtaaccgtaaacccgtaaaccgggtaaaccccgttaacggttaccgggtaaccctaaaaggtttaaccgttaacgggttaggggggttaccgtttacgggttttacgggtccggggggtaacccggtaaacgggggtaccccgttaagggttacctaacggttacccgttacccgttacccccggaaccgtcccctaaccccggaaacccggtaacccggggtaccccgttaacggtttacccggggtttacccccgtttaccccccgggaccggggtacccccgttccccgttaacccggg

SEQ ID NO: 23060 - DNA, 849 bp, Homo sapiens
  misc_feature: GYAE6OF02I5GZO.12.40.D07.1.454.CMB.1.raw
  modified_base (135)..(135): a, c, t, g, unknown or other
  misc_feature (135)..(135): n is a, c, g, or t
  modified_base (208)..(208): a, c, t, g, unknown or other
  misc_feature (208)..(208): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggnggagtcgtgggggagccgtggtccagcctgggcgtccctgacactcgcctgtgttgcctctggatttcccttnaattttctactttccatcgctacgtgggtcccgccaggcctaccagggaccaaagggggcctacggaggtggggtgctaacgtttagttcgacacatgactgggaccgtacaaaacgtaaattcctaacggaactaaaacggtttccgagggacgggggtacccatttaccgaacctacgttcctaccgaggaactaaactaaacttaaccgaaacgtaaaccccttacccttttaatacccgtaggaaacctaaacgttaaacgaacctaacggccctaacggaagaaccccaaggaacccgacgaaccgggacctttacggtaaccttaaagtttaacgttacggacggtaaccgtaaaggaaacgaacggtaaaccaactaaacccggaaaccttaccggtaaccggaacctaaacgtaacgttagggtacgggggttacctttcgggtttaccgggtacgggggtaacccgtaaccggggggtacccgttaagggtaccctacggttacccgttaccccgtaacccgtaccggtacccccgtttaaacccggaacccgttaaaccgggaccccgttaacggttacccgggttttacccccttccccccgggtacggtacccccgtacccgttaccgg

SEQ ID NO: 23061 - DNA, 767 bp, Homo sapiens
  misc_feature: GYAE6OF02GH40T.12.40.D07.1.454.CMB.1.raw
tcagatacgacgtacacgaccggtgctcgatttagtgatagagcgtaacaacagagggctcaccatggagtttgggctgagctgggttttcctcgttgctctttaagaggtgtccagtgtcaggggcacctggtggagtctggggggagccgtggtccagcctgggcggtccctgacactcgcctgtgttgcctctggactttcccttcaatttctattccatgcactgggtccgcaggctccaggcaaggggctcggagtgggtgcacttatgcacatgatggcgtcaaacaattctaacgcaaattccgtaggaggggccaattcaccatctaccagacgactaattacaaagtaacctacccttttaagctagaccaaaattggaactagtccctggaactaacccgaagaccggaacacgggtacctaggttaccttaagttaacttggcgacggtaacgagtaacggaacaaccgaaccgaaacccttacgaacgggtccctaaaatacccggttaaagttccggggggtacttttagggttacccggttacggggggacccgtaaaccggggggtaccccgtttaccggggaaccgttaaccgttcccgggttacccctacccccccggtaaaccgggtcccccgtttaaaccccggaaccccgggtaaacccggggtaccccttaaccggggtttccccggtttaaccccggttccccccccggttaggggtaacccccccgttccccgttacccccggg

SEQ ID NO: 23062 - DNA, 672 bp, Homo sapiens
  misc_feature: GYAE6OF02GEKIK.12.40.D07.1.454.CMB.1.raw
  modified_base (150)..(150): a, c, t, g, unknown or other
  misc_feature (150)..(150): n is a, c, g, or t
  modified_base (236)..(236): a, c, t, g, unknown or other
  misc_feature (236)..(236): n is a, c, g, or t
  modified_base (355)..(355): a, c, t, g, unknown or other
  misc_feature (355)..(355): n is a, c, g, or t
  modified_base (411)..(411): a, c, t, g, unknown or other
  misc_feature (411)..(411): n is a, c, g, or t
  modified_base (438)..(438): a, c, t, g, unknown or other
  misc_feature (438)..(438): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggganccggtggtccagcctgggcggtccctgacactcgcctgtgtgcctctggctttccctctaatttctattccatgcactggggtccncgagctccgaggcgaaggggtctcgaggtgggtgctacttgtgcacatgtacgtggcgtacaaataactttcgacgtactaaacggttccgagggtaccggggactattccaaccgttntccgtaccaagtagaactaacttacaaacgtacctacctttactcagaactaaganacgtcgtctacgacgacacgaccgacncggtatcttactattacgtcgacgcgtaggacgacgacacgacctaacgtacgtacgactaacgtcgttagggtcgggttactttggttccggacgggtccgtaccgggaccgttcgtaccgtacgttcccggtaccctccccggtacgtacccgttaaccccaccgggtaaccggtaccccgtacgtcccggggtttccccctacccgggtcgggtaccccgtccggtaccgg

SEQ ID NO: 23063 - DNA, 789 bp, Homo sapiens
  misc_feature: GYAE6OF02JHQM5.12.40.D07.1.454.CMB.1.raw
  modified_base (234)..(234): a, c, t, g, unknown or other
  misc_feature (234)..(234): n is a, c, g, or t
  modified_base (332)..(332): a, c, t, g, unknown or other
  misc_feature (332)..(332): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccnccaggctccaggcaaggggctcgagtgggtgcacttatgctacatgatggcgtcaaacaatttcaacgcaaattccgtagacgggggccattcaaccntcctaccaggagaccaattacaaagaacctaccgtttatctagactaaaagtcgactaggcctaggaacgtacccaaggaacccgacgaacgggtctacggtttactaagtttaacgttcgaccggtaccgtaaggacggtaacgaaccgaaccgaacccggtaaacccgtaaccgttcgggaacccctaaaattaacccgttaagggttacggggggtaccttttacgggttttaccggtccgggggggtacccgtaaaccggggggttaccccgttaggggttacccgtaacgttacccggtttacccgttaccccccggtaaacggtccccccgtttaaccccggaaccccggttaaacccgggggtaccccccttaacgggtttaccccggggtttacccccgtttcccccccggtaaccgggggttccccgttaacccccccgttcccgggg

SEQ ID NO: 23064 - DNA, 707 bp, Homo sapiens
  misc_feature: GYAE6OF02JRK9R.12.40.D07.1.454.CMB.1.raw
  modified_base (121)..(121): a, c, t, g, unknown or other
  misc_feature (121)..(121): n is a, c, g, or t
  modified_base (227)..(227): a, c, t, g, unknown or other
  misc_feature (227)..(227): n is a, c, g, or t
  modified_base (437)..(437): a, c, t, g, unknown or other
  misc_feature (437)..(437): n is a, c, g, or t
  modified_base (506)..(506): a, c, t, g, unknown or other
  misc_feature (506)..(506): n is a, c, g, or t
tcagatacgacgtacacgaccggtgctcgatttagtgatagagcgtaacaacgagagggctcaccatggagtttgggctgagctgggttttcctcgttgctcttttaagaggtgtccagtntcaggggcacctggtggagtctgggggagccgtggtcagcctgggcggtcctgacactcgcctgtgttgcctctggtactttcctctaatttctacttccatgacncgttcgggcccgcagcctcgaggcgaacgggctacgtaaggtgggtcggacacgtttatcgacacgtacgtgagtacggtccgtaactaacctaaacttactaacggtactaaacgttcgggtacggacgggggtaccacttaacccacacctccgtaccaagaccgaaactactaacaaacgaaccttacccttatacgtacgactaanaaacgtcagtaccgtagacgaccacggacgacgacgtctatattacgtagttgcgtaggacacggtaanaaccgactaacgacccttacggtacgtaaccaaattacccggttaggtccggggttacttcgggttaccggtcgggacccggtacgggtccggtacggtcttaccgtcgtacccgtacccgtaccggtaccgtacccgaacccggttacggccctacggttcccggtacccggttcccctcgggtaccccggtcctcccgg

SEQ ID NO: 23065 - DNA, 868 bp, Homo sapiens
  misc_feature: GYAE6OF02IIJB6.12.40.D07.1.454.CMB.1.raw
  modified_base (93)..(93): a, c, t, g, unknown or other
  misc_feature (93)..(93): n is a, c, g, or t
  modified_base (152)..(152): a, c, t, g, unknown or other
  misc_feature (152)..(152): n is a, c, g, or t
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
tcagatacgacgtacacgaccggtgctcgatttagtgatagagcgtaacaacgagagggctcaccatggagtttgggctgagctgggtttccncgttgctcttttaagaggtgtccagtgtcgagggtcaccgtggtggagtcgtggggganccgtggtcctagcccgtgggtccggtccctggacctactccgtccgtagtgttcgcccttagtggtacttttccccttntaaacttttcctaattccgatcgctaacgtcggggtccnccgtaggtcctaccgaggacctaacgggggcttccggaaggtgggtacgtacctaactttaacgttcgacctaacgttaatggcttaacgggcctacaaaaacgtaaactttcgaaccggtactaaaacgtttcccgggtagggaccggggtacctaactttacccggaccctacgttccgtacccgaagttaccgaaaacgttaaacttaaccaaagggtaacccttaacccccggttttataccgttacggaaacttaaaacggtacgggaaaccttaacggtcccggtcgtaaacggtaccccgaaagtttaaccgggaccgttaaacggggtcccttaagggtctttaaactttacggccgtaaggacccgtagagttaccgaaacccaacgttaaccgaacccgttaacgtaccggtaaacctaaacgttcgtagggttaaccgggggttctttacgggtccgggtacggtaccgtaggggtacccttagcgttaccggacgttccccaacccgtggaaccctttccggaaacggttaccccgatcccgggttacggttacccctcccgggttaacgcccttacccgtaccgg

SEQ ID NO: 23066 - DNA, 756 bp, Homo sapiens
  misc_feature: GYAE6OF02GPD9P.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagagtgtccagtgtcaggggcaccctggtggagtctggggggagccgtggtccagcctgggccggtccctgacactcgcctgtgttgcctctggtacttttcccttcaattttctattcccatcgctacgtgggtccgccacggcctccgaggcgaaggggcctcggaggtgggtcgacactttatcgacacagtgatggccgtacaaaacgtaattctaacgactaaacgttccggtagggacggggtcctattaccaacctaactcctaccgaagacgtaactaattaacgaaacgttaaacccacccttttaatcgttacgaactaaaacgttaggaaccgtacgtacccttaggaactaaccccggaagggaacccgaaccgtaaccggtacgtcggttacttaagtttcgttaggaccgtacgaaggtacgacgacgaacgtaaccgtaaccctacgttacgaacctaacgtacgttagggtcggggtaccgttttgtaaccggcggggtacccggtacggggtacccttgggtcctacggttcccgtacccgtaccccgaacggtaccccgtaccgaacccgggtaccgggcccttacgtccccgggttcccgttacccccggtcgggaccctccccggtacgg

SEQ ID NO: 23067 - DNA, 828 bp, Homo sapiens
  misc_feature: GYAE6OF02IHRZQ.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtactttcccttctaattttctactttccatgcacgtgggtccgcaggctccgaggcgaagggctcgaggtgggtaggctacttattgcacatgagtcggcttacaaactaattactacgtactaaacttccggtagggacggggtaccgtactttaccaacctacgtccttaccgaagaacgtaactaaacgtttaaccaaaacgtaaaccttaacccgtttttaataccgttacgaacgtaaaaactacgaaaccgtacggcccttagaacggtaacccaacggtaaccgaaccgaacgggtccgttcggtttaccttaacgtttacgttacggcggtacggaaaggtaacggaacgtaaccgaccgaaaccgtaaacccgttaccgtacgggtaccctaaacgtttaacgtacgggtttacggggggtcttttacggggtttccggttacgggggtaacccgttaaccggggggtaacccgttacggggttaccgtaccgttacccggtcccgtttaccccgaaccggtaccccgtaacccgtaaccccgggtaaccgggttaccccgtaacccggtttcccggttcccccgtttacccccggttccgggccccgtcccgtacccggg

SEQ ID NO: 23068 - DNA, 790 bp, Homo sapiens
  misc_feature: GYAE6OF02FIQWJ.12.40.D07.1.454.CMB.1.raw
tcagatacgacgtacacgaccggtgctcgatttagtgatagagcgtaacaacagagggctcaccatggagtttgggctgagctgggtttcctcgttgctctttaagaggtgtccagtgtcaggggcacctggtggagtctggggggagccgtggtccagcctgggcggtccctgacactcgcctgtgttgcctctggtactttcccttcaactttctacttccatcgccacttcggggtcccgccagggtcctcccgaggcaaggggggtctcggaggtgggtggcacttatgcacatgatgggcgtacaactaacttcacgactaaattccggtaggacggggtccgacttaccaccatcctaccgagtaacgactaattaccgaaagaacctaccctttagcctagaacgaaactacgaaccgacgtccgttacggaacgacccgtaagaacccgaaccgtaaccggccgtagttacctaactttacgtttacgaccgggtaacgtacggtaacggacggaaccgaaccgaacccgtaaacccgtaccgtacggaaccctaaaggtaccttaacgggtaggggggttacctttcggtttaaccgggtccggggacccgggtaacgggggtaccccgttacgggttacctaccgttcccggtacccgtaccccgggtacctaccccggttaaccccgaaccccgggtaaccgggtacccccgttaaccggttcccgggtttcccccgttaccccgggtcccggttcccgggtaccccgttaaccccggg

SEQ ID NO: 23069 - DNA, 984 bp, Homo sapiens
  misc_feature: GYAE6OF02ISI4G.12.40.D07.1.454.CMB.1.raw
  modified_base (149)..(149): a, c, t, g, unknown or other
  misc_feature (149)..(149): n is a, c, g, or t
  modified_base (195)..(195): a, c, t, g, unknown or other
  misc_feature (195)..(195): n is a, c, g, or t
  modified_base (210)..(210): a, c, t, g, unknown or other
  misc_feature (210)..(210): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcggtccctgacactcgcctgtgttgcctntggtactttcccttnaattttctattccatgcacgtgggtccgccaggctccgaggcaaggggctcggaggtgggtgctacttagttcgcactagtgagtcggacgtacaaactaaattccgtaacgactaaaatttccggtaggacgggggccctaagtttaccaaccgtattccctaccgaaggtaacgtaacctaaagttaaccgaaaacggtaaacccttaacccccgttttaagttcccgttaacggaaaccctaaaaacgtttaacggaaacctaaccgggtcccttaacgggaaaccgtaaccccgaaacggtacccggtaaaccggtaacccggggttacttaccggttaacgtttaaacgttttaccgttacgggtacccggtacgggtaaacgggtaacgggtaaaccggtaacccgtaaacggtaaacccggttaaaacccggttaaccgttaacccggggtaaaccctaaaccggtttaaaccggttaagggggtaccggggggtttacccttttacgggggtttacccgggttaccggggggtaaccccgggttaacgggggggtaaacccccgtttcggggttaacccgttaacgggttccccgttaccccggtttaccccccggtaaacgggttccccccccgttaaacccgggttaaaccccggtaaccccggggttaaccccccgttacgggtttacccccccggggttttaccccccgtttaccccccccggggtaccggtaccccccgggttacccccgttaccccgggg

SEQ ID NO: 23070 - DNA, 805 bp, Homo sapiens
  misc_feature: GYAE6OF02GTI9M.12.40.D07.1.454.CMB.1.raw
  modified_base (150)..(150): a, c, t, g, unknown or other
  misc_feature (150)..(150): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtcgtggggganccgtggtccagcctgggcggtccctgacactcgcctgtgttgcctctggtactttcccttacaattttcctattcccattcgccacgtcgggtcccgccagggcctccgaggcgaaggggctcggagtgggtggcacttattcgcacatgagtggcgtacaaacgtaaattctacgtacaaagtttcccggtggaacgggggcctaatttccaacccgtactccgtaccaaggaacggtaactaaacgttaaccgaaacggtaaaccctacccctttttaagtccttacgaacctaaaaacttacggaaccaacggtaccctggaaaccggtaaccgaaacgggtaaccgaacccgacggtaccgttaggttaccttaagtttacgttcggacggacggtaaggaaggtacgaaccaaccaacccggtaaaccctacgtaacgtaacctaaacttaacggtacggttacgggggtacctttacgggtttcgggtaccggggtccggaaccggggttaccccgtgggttacccgtaacgttccgttaccccgtcccgtaaccgtaccccgtacccggaacccggaacccgggtccccgtaccggttaccccgggttccccttaccccccgggtacggtccccggttcccctcccgg

SEQ ID NO: 23071 - DNA, 911 bp, Homo sapiens
  misc_feature: GYAE6OF02FRQ7Z.12.40.D07.1.454.CMB.1.raw
  modified_base (152)..(152): a, c, t, g, unknown or other
  misc_feature (152)..(152): n is a, c, g, or t
  modified_base (227)..(227): a, c, t, g, unknown or other
  misc_feature (227)..(227): n is a, c, g, or t
  modified_base (690)..(690): a, c, t, g, unknown or other
  misc_feature (690)..(690): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcaccgtggtggagtcgtagggggancccgtggtcccaggcccgtggggccggttccctgactacgtccgcctggtgttgcccttctggtattttcccctntaaagttttctacttccaattgacctacgtcgggtcccgaccgtagggccttaccgaggaccgaaagggggtcctcggaggttcggggtcggacctacttttaagttcggaccaactaggttagacgttacgggaccgtactaaaacgtaaatttccgaaccggtaactaaaacgttttccgggcggtaacggggggtccctaacgtttaccgaacccttagttcccgtaacccggaaggtaaactaacggtaaaactttaaaccggaaacggtaaaccctttaacccgttttacgtacccgtagtaaacccgtaaaattaacggacccgtaagtaaccccgttaaggaaacccgtaacgaaaccggtacccggaaaccgtccgtaccgttacgtaagttacgtttacgtcggacggtaccgaaggtacgaaacggtccaaccttaaccggaacccgttaacncgggtaaccctaaagttcggtaacgggttcgggttacgtttcgggttaccgggaccggggtaaccggtaccgggttacccgttaggaccttaaccggttcccggttcccaccccggttaccgccccgtttaacccggaccccgtaaccggggtcccaccgggtttaccccgttccccggttcccccggtacgggtccccgtaccccgtttgaacccccggg

SEQ ID NO: 23072 - DNA, 912 bp, Homo sapiens
  misc_feature: GYAE6OF02IX3ZZ.12.40.D07.1.454.CMB.1.raw
tcagatacgacgtacacgaccggtgctcgatttagtgatagagcgtaacaacagagggctcaccatggagtttgggctgagctgggtttcctcgttgctcttttaagaggtgtccagtgtcaggggcacctgggtggagtctggggggatccggtggtccagccgtgggcggtccctgacacctcgcctgtcgttgcctctggatttcccttactaatttctattccatcgcactgggtccgcaggtcctccaggcaagggggctcgaggtggtcggacacttattgcacagtgatggcgtacaataaacttcgtaacgataaaacgttccggtagacggggggaccgtaacgttcctaacctactacctaccccgaaggtacggaactaaaactttaaccgaaaacggtaaacctaacccccgttttaagtacctttacgaactaaaaactaacggtaacctaacggtacttaccggacggaaacccgtaacgggtaaacccgtaaccggaccgggtaccgttacggttaaccgtttaaagttttaacgttacggtaaccggacggaacgggtaaacggaaacggaaccctaaaccggtaacccgtaaacccgtaaccgttaaccgggtaaccctaaaaacgttacggttaaaccgggtttcggggggtacccgttttacgggggttttacggtccgggggtaacccgggggtaaacccgggggttaaccccggttaagggttacccgtaacccggtacccggtttcccgaaccccccgttaccggggtaacccccctttaaccgggaaccccccgtaaacgggggtaaccccccgtaaaccgtttccccggggtttaaccccctttacccccccgggtcggggttaccccccgtcccccgttaccccggg

SEQ ID NO: 23073 - DNA, 961 bp, Homo sapiens
  misc_feature: GYAE6OF02I1ABQ.12.40.D07.1.454.CMB.1.raw
  modified_base (193)..(193): a, c, t, g, unknown or other
  misc_feature (193)..(193): n is a, c, g, or t
tcagatacgacgtacacgaccggtgctcgatttagtgatagagcgtaacacagagggctcaccatggagtttgggctgagctgggttttcctcgttgctctttaagaggtgtccagtgtcgaggggcaccgtggtggagtcggtgggggacgccggtcggtaccaggccgtggggtccgggtccctggaaccnccgtccgtccgttgtggttcgccctcgtcggtactttcccttactaatttcctacttccatcggcctacgtcgggtccgaccgaggtcctaccgaagggcggaacggggtccgtaggtacggtgggtcgccgttacgttagtcgacacgtaagtggaacggtcggtaaccttaacgaaacttaactccgtaaccgaacgttaaacgttccggtacgggacgggtcctaacttaccacctacgtacctacggtaacgtaacgtaaacgtaacgtaaaccgtaaactaaccccgtttaaccttactacgtaacaaacgtaaacgtacgtaacctacgggtacctaacggaacgtaaccgaacggacccgtaaccgggtaacttaccgttacgttaaacggttacctttaaggcggtaacgacggtaacggaacggacgtaaaccctaacggtaaccccggtaaacggttctaaccgggtaaaccttaaacgttaccgggtaaccggggtttaccgggggttaccttttaaccccggggggtcgggtttaacccccgggggtaaccggggttaccccgggggttaaacccgttaccggggtttaacccggtaacccggtttcccgttaaccccgggttaaccccccgggaccttaacccccgggttacccggaaacccccggttacccggaccccggttaacccggttccccggtttaaccccgggtttcccccgggaacccggtttccccgggaaccccgtttccccggg

SEQ ID NO: 23074 - DNA, 767 bp, Homo sapiens
  misc_feature: GYAE6OF02IW3R0.12.40.D07.1.454.CMB.1.raw
  modified_base (478)..(478): a, c, t, g, unknown or other
  misc_feature (478)..(478): n is a, c, g, or t
tcagatacgacgtacacgaccggtgctcgatttagtgatagagcgtaacaacagaggactcaccatggagtttgggctgagcttgggttttcctcgttgctcttttaagaggtgtccagtgtcaggggcacctggtggagtcgtggggggagccgtggtccagcctgggcggtccctgacactcgcctgtgttgcctctggtactttcccttctaatttctattccatcgctacgtcgggtcccgccgacggcctccgagggcgaagggggcctcggaggtgggtggactacgttatgcacatgatgggactacaaactaaattccgaacgactaaaacgtttccggtagggacgggggaccctaacgtttaccaacccgtaacttccgtaacccgaaggaaccgtaaactaaaactttaaaccgaaacgtaaaccctaaaccccttttatccttaacgaactaaaaatacgaaccgngtaccgtagaacgacccaggaaccgacgaccggtactcgttacttaagtttacgttcggacgtacgaagaggaacaaccgacaacccgtaaaccacgttacgaactaacgttaactagggttcgggtacctttgggttaccggtacggggtacccggtacggggacccttcgggtactacgttccgaccccgttccccgaaccggtcccctaacccggaaccgtaacccgggtccccttacggttcccggtttacccccgtcccccgtcgggtacccgtcccgtacccg

SEQ ID NO: 23075 - DNA, 881 bp, Homo sapiens
  misc_feature: GYAE6OF02FMAE4.12.40.D07.1.454.CMB.1.raw
  modified_base (124)..(124): a, c, t, g, unknown or other
  misc_feature (124)..(124): n is a, c, g, or t
  modified_base (245)..(245): a, c, t, g, unknown or other
  misc_feature (245)..(245): n is a, c, g, or t
tcagatacgacgtacacgaccggtgctcgatttagtgatagagcgttaacgaacgagagggctcaccatggagtttgggctgagtcgtggggtttcctcgttgctctttaagaggtgtccagtntcagggcaccctggtgagtctgggggagtcctggtccagccttagggcgtccctgaccactcgcctggtgttcgcctctggattcccttcaatttcctattcccatcgctactcggtaccnccgaggcctccacggcaaggggctcggagtgggtaggctacgttatgactacgattgacgttcggacgttacaactaaacttcgtaaccgcgttaaacgttcccggttacgggaccggggttaccctagtttaaccgtacccggtaaacttcccgtaccggtaccggtaaacgggtaaaccttaaaccggtttaaaaccgggaaaccggtaaaccccttaaaccccgtttttcgacccggttagtaacccggttaaaaagttcggaaaccggaacctaccccgggttaggtaaaccccaaccggtaacgggaaacccgtaccggtaacccgtttccgggtaattaccccgggtttaatttccggtttacggccggttaaccggttacggaacggtaaaccgggttacctaaccggaacccgttaacccgttaaaccgttccggtaaacccttaagtaccggttaacggttacgggggtccttttaacggttacggttcccgggaaccgttacggggtaccggttaccggttcgtaccggtaccgtcccgacccggtcacccggttaccgaaccgtaacccgggtcccttagtacccggttcccgttaccccggtcggtaccccgttcccgtaccgg

SEQ ID NO: 23076 - DNA, 834 bp, Homo sapiens
  misc_feature: GYAE6OF02I2A6U.12.40.D07.1.454.CMB.1.raw
  modified_base (149)..(149): a, c, t, g, unknown or other
  misc_feature (149)..(149): n is a, c, g, or t
  modified_base (190)..(190): a, c, t, g, unknown or other
  misc_feature (190)..(190): n is a, c, g, or t
  modified_base (241)..(241): a, c, t, g, unknown or other
  misc_feature (241)..(241): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
tcagatacgacgtacacgaccggtgctcgattttagtgatagagcgtaacaacagaggactcaccatggagtttgggctgagctgggttttcctcgttgctcttttaagaggtgtccagtgtcaggggcacctggtgagtctggggganccgtggtccagcctgggcggtcctgacactcgcctgttgtncctctggtactttccctcaattttctacttccatgactacgttcgggtccnccgaggtcctcccgaggaccggaaggggtcctcggaggtggggtcggcctactttagtcgacctaacagttcggagttcgggcgttaaacaaacgttaaaacttccgtaaccgtaactaaaacggttccggtagggaacgggggttacctaacgtttacaaacctaaagtttcccaaccgaaaggaacgtaaacccttaaagttaaaccgaaaaccggtaaaccttaaccccgttttanaccgttanaaccgtaaaagtaactaccgaacgtcccgtaagaaaccgtaaacggaaccgtaaccgaacggtaccggtaccgttcggttaacttaacgttttacgttacggtacggacgtacggaaacgaccgaaacgtaacccgtaaaccgtaaccgttaccgtaccgtaaccgtaaacgtacgttacgggttccgggttacgttcggttccgggtaccggggtccgtaaaccggggtcccgttacgtccgtaccgtccggttaccctacccgtacctacccgtaccgtaacccggaccggtacccgtacgttcccggttacccgttaccccggcggttccccgaccgtcccgg

SEQ ID NO: 23077 - DNA, 778 bp, Homo sapiens
  misc_feature: GYAE6OF02FVZ46.12.40.D07.1.454.CMB.1.raw
  modified_base (150)..(150): a, c, t, g, unknown or other
  misc_feature (150)..(150): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
tcagatacgacgtacacgaccggtgctcgatttagtgatagagcgtaacaacagaggactcaccatggagtttgggctgacgctgggttttcctcgttgctcttttaagaggtgtccagtgtcaggggcacctggtggagtctggggganccgtggtccagccgtgggcggtccctgacactcgcctgtgtgcctgtggactttccctnaatttcattccatgcacgtgggtccnccaggcctcgaggcgacggggctcggaggtgggtcgctacttagtcgacatagtcgagtggccgtaactaactaactttccgaacgacgttaaacgttcccggagggtacgggggtcctacttccgaacctatcctccgaagacgtaactacgttaacaaaccgtaacctacccgttttatcgtataaaccgtaaatacgaacgtacgtacccgttaggaaaccggaccgaacggtaaccggtaaccgtaaccggttcgtacggtttaactttaaatttcggtacggtaccgggaacgtaacggaacggtacgaaccgtaaccgtaaaccggtaacctaacgtacgactaaagtaccggttaaggttccggggtactttaacgggtcgggtacggggaccggtaaccgggttcgttcgggtacttaccgtcccggttcccgtacccgtaaccggtccccttaacccggaacccggtccggaaccccgtacgtttccccggttaccccgttccccggtcgggtacccccggtccttaacccggg

SEQ ID NO: 23078 - DNA, 808 bp, Homo sapiens
  misc_feature: GYAE6OF02FTZG3.12.40.D07.1.454.CMB.1.raw
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
tcagatacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggggagccgtggtccagcctgggcggtccctgacactcgcctgtgttgcctctggactttccctnatttctattccatgcacgtcgggtccncgaggcctccgaggcgaacggggctacggaggtgggtgctacgttatcgcacatggatcgggacgtactaaactaatttccaaccgactaaaacgtttcccggtagggaacgggggtcccgatttccgacctacttctaccgaaggacgtaaccaatttacgaaacgtaaacctacccgttttatccgtacgtaacctaaaacgtaggaaccacggtaccctaggtaacgtacccgaaacgaccgaccgaccgggtacctacgtttacgttaagtttacgttacggaccggacggtaaggaggtaaccgaaccgaaaccgtaaccggtaaaccgtaacgttaccggggaacctaacgttaacgttacgggttacggggggtacttttaccgggttacggtaccgggggtaccgtaaccgggggttacccgttcgggtacttacccgttaccggttaccctccccggtaaccggtacccgttaccccgaacccgggtaaccgggtccccttacgggttaccccggtttcccccgtttaccccggtaccgggttccccggtccccgttacccgg

SEQ ID NO: 23079 - DNA, 728 bp, Homo sapiens
  misc_feature: GYAE6OF02FT5YZ.12.40.D07.1.454.CMB.1.raw
  modified_base (150)..(150): a, c, t, g, unknown or other
  misc_feature (150)..(150): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (281)..(281): a, c, t, g, unknown or other
  misc_feature (281)..(281): n is a, c, g, or t
  modified_base (427)..(427): a, c, t, g, unknown or other
  misc_feature (427)..(427): n is a, c, g, or t
tcagatacgacgtacacgaccggtgctcgatttagtgatagagcgtaacaacgaggggactcaccatggagtttgggctgagctgggtttcctcgttgctcttttaagaggtgtccagtgtcagggcaccgtggtggagtcgtggggganccggtggtccagccctgggccgtccctgacactcgcctgtgttgcctctggactttccctanaatttctattccatgcacgtcgggtccncaggcctccgaggcaaggggctcggaggtgggtgcaacttntgccactagttgagttacggctacgaaactaaagttcctaacgactaaacgttccgtaggacggggcctattccgaacctatcctaccaagaacgactaacttaacgaacaaccgttaccttatcgtacgaactaaagtagaacgngtaccgtaggtacaaccgagtaaccgacgtaaccggtcgtagtccttaagttacgtgacgtagacggtacgacgaacaccgaacgtacctacgtcggaactaacgtacgtacggtagggttcttcgggtacgtccggggaacggtaccggggtaccccgtttggacttaccggcccgtttccgaccccggtaccgtccgttaaccccgaaacccggttaccggtaaccccgtccggtttcccccggttacccggtttcccccggtacggttaccccgtcccccgtacgggttaccccccgg

SEQ ID NO: 23080 - DNA, 706 bp, Homo sapiens
  misc_feature: GYAE6OF02GZLSC.12.40.D07.1.454.CMB.1.raw
  modified_base (149)..(149): a, c, t, g, unknown or other
  misc_feature (149)..(149): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggganccgtggtccagcctgggcggtccctgacactcgcctgtgttgcctntggatttccctnaatttctattccatcgcactgggtccncaggctccgaggcaaggggctacggagtgggtgctacttatgcacatgagtggacgtacaaacaaactttctacgactaaagttcccggtaggacgggggtcccaagtttccacctagtccctaccgaaggagtaacctaaagtttaaccgaaacggaaacccttaccccgttttagccgttacgaactaaaagtacgacgaacgtccgtaggaacgaaccctagggaaccgacgaccggtcttacgtacttaagttacttcggacgtacgagtacgaacgaccacgaaccgtaactacgtacggacctaagtactacgggtacggggttcttaggttaccggtacggggtccgtaaccggggtccttacgggtactacgttaccggtccgtaccccgtcggtaccctaccgtaccgaacccggtccctacggtcccggttcccttcccccggtaggcccgtcccgtaccgg

SEQ ID NO: 23081 - DNA, 759 bp, Homo sapiens
  misc_feature: GYAE6OF02HKL1P.12.40.D07.1.454.CMB.1.raw
  modified_base (181)..(181): a, c, t, g, unknown or other
  misc_feature (181)..(181): n is a, c, g, or t
  modified_base (198)..(198): a, c, t, g, unknown or other
  misc_feature (198)..(198): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcacctggtggagtcgtgggggagccgtggtccagccgtgggcggtccctgacnctcgctgtgttcgcctntgactttccctacaattttctattccatcgcacgtgggtccgccaggtcctccgagggacaacgggggcctcggaggtggggtcgactacttagtggacactagttgagtcgggacgtacaaactaaattcgaacgactaattccggaggacgggccattaccacctatcaccgtagacgtaactaattaacgaacgtaacctcccgttaatccgtaagtaccaaaagttcgaaaccgtacgtacccgtaggtaacaaacccggaaggaacccgacggtaccgggtcttcggttaaccgtttaatagttacggacggtacgaaggaaacgtacgaaccgtaacgtaaaccgaacccttacgtacgtaccgtaaatttaacgtaaccgggtggggttaccctttggttaccgggtcgggtaacccgtacggggaccctttcggtaacgccgtttcccggcccgttaccccgaaccggtaccccgtcccggtaccggttaaccggcccgtacggtttcccggttaccccgttaccccggttcggtaccccgccccggttacgg

SEQ ID NO: 23082 - DNA, 741 bp, Homo sapiens
  misc_feature: GYAE6OF02JMPR5.12.40.D07.1.454.CMB.1.raw
  modified_base (155)..(155): a, c, t, g, unknown or other
  misc_feature (155)..(155): n is a, c, g, or t
  modified_base (256)..(256): a, c, t, g, unknown or other
  misc_feature (256)..(256): n is a, c, g, or t
  modified_base (305)..(305): a, c, t, g, unknown or other
  misc_feature (305)..(305): n is a, c, g, or t
  modified_base (432)..(432): a, c, t, g, unknown or other
  misc_feature (432)..(432): n is a, c, g, or t
tcagatacgacgtacacgaccggtgctcgatttagtgatagagcgtaacaacgaggagggctcaccagtggacgtttgggctgagctgggttttcctcgttgctcttttaagaggtgtccagtgtcaggggcaccgtggtggagtctgggggacnccgtggtccagccgtgggccggtccctgacacgtcgcctgtgttgcctcgtaggtactttcccgtactaattttcctagttccatcgactacgtgggtccnccgaggtcctccgagggctaaggggctcggaggtgggtcgactaacttntcgacaacgattggatgggccttacgaaactaattcgtaacgctaaacgttccggtaggacggggtcctaatccacgtatccgtcaaggtcaactaactacgaacgtaaacctcccttttaagcgtnaacgtaaagtacgtaacgacgttacctaggaacgtacccaaggacccgtacgtaaccggtctacggttactaggttactcggtaccgagtacgagtacgacgaactaacggtacctaacgtcgtacctaacgttacgtaggtaccgggtactttcggtacgggtaccgggtaccgtaaccgggtaccgtcgggtaccgtaacgttcccggtacccgttaacccggccgttaccctaccggtaacccggaacccgggtaccctaccgggttcccgttcccgtaccccggtccgtcccggttcccgaccgg

SEQ ID NO: 23083 - DNA, 1195 bp, Homo sapiens
  misc_feature: GYAE6OF02HZXPI.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcgaggggcacctggtggagtcgtgggggagccgtggtccagccgtgggcggtcctgacactcgcctgtgttgcctctggtacttttcccttactaacttttctaactttcccaagttcggacctaaccgttcgggggtcccgacccgtaacgggtcctcccggaaggggaccggaaacggggggtccttacgggtaagggttcgggggttcggaccttaaccgttttaagtttcggacctaaccgtaagttggaacggttcgggaacccgttaacctaaaacgttaaaacttttcccgtaaaccggtaaccgttaaaaaccgtttccccgggggtaggggtaaccggggggtacccgttaagttttaccccgaaacccgttaaacgtttccccgttaaacccgggtaaaaggtaaccggtaaaaccgtaaaaccgttttaaaaccggaaaaccggttaaaaaccccgtttaccccttttttaaacgtacccggtttaaaggaaacccttaaaaaacggttaacggtaaaccgtaaacggtaccccgttaacggtaaacccggaaaacccgttaacgggaaaccccgggtaaacccggtacccggggttaaccggtttaccggttttaaacccgtttaacgtttttaaacggtttacggggtaacccgggtaaccgggttaaacgggaaacgggtaaacccggtaaaacccgtaaaaccccgttaaaacccggggttaaaaccccgtttaaaccgggttaaccccgggggtaaaacccttaaaaacccggttttaaacccggtttaaacggggggtttaccgggggggttaccggtttttacccggggttttaaccgggggtaaccccgggggggtaccccgggtttaaaacccggggggtacccccggtttaaccggggttaacccgttacccgggttttaccccgttaccccccggttacccccggtaacccgggtttaacccccggtaaaccccgggttaaaccccccggttaaacccggggtaaccccccgtttaaccgggtttacccccccgggttttacccccggttaa

SEQ ID NO: 23084 - DNA, 883 bp, Homo sapiens
  misc_feature: GYAE6OF02GO3KG.12.40.D07.1.454.CMB.1.raw
  modified_base (203)..(203): a, c, t, g, unknown or other
  misc_feature (203)..(203): n is a, c, g, or t
tcagatacgacgtacacgaccggtgctcgatttagtgatagagcgtaaacaacagagggctcaccatggagtttgggctgagcttgggttttcctcgttgcttcttttaaagaggtgtccagtgtcgaggggcaccgtgggtggagtcggtgggggagccgtggtccagccgtgggcggtcctgacactcgctgtgttgcctntgtactttccttataatttctattccatgctacgtcgggtccgccgaggcctccgaggacgaaggggctacggagggtggggtcgactactttagtcgacctaacgagttcgagtcggtcgtaacaaaacgtaaactttcgtaaccgtaactaaaccgttccggtagggaccggggtaccttacgttcaacccgtactcctaaccgagtaaacgaaacttaaaacgttaacgaaacgtaacccttaaacccttttagactaagtaaaacctaaagtaacgtaacgaccgtaccgtaaaggaaccgaaccgaacggaacccgaacggaccggtacttacgtttaaccgttttaagttacggtacgacgggtaaaccggaaggtaacggaaacgtaaacccgtaacgtaaaaccccgaaaccgtttcgaaccggtaaacttaaacgtacggttacgggttccgggggttactttaccgggtttcgggtaccgggggtacccgttaacgggtccccggtttaagggaccccgtttacgtaccccggttccccgtaacccccgggtaaccgttccccgaaaccccgggtaaaccggacccccgggtttaacccgtacccggtttcccccgggtttaacccccgtttcccccgggtacgggtcccccggtacccccgttaaccgg

SEQ ID NO: 23085 - DNA, 796 bp, Homo sapiens
  misc_feature: GYAE6OF02I5CBR.12.40.D07.1.454.CMB.1.raw
  modified_base (150)..(150): a, c, t, g, unknown or other
  misc_feature (150)..(150): n is a, c, g, or t
  modified_base (275)..(275): a, c, t, g, unknown or other
  misc_feature (275)..(275): n is a, c, g, or t
  modified_base (376)..(376): a, c, t, g, unknown or other
  misc_feature (376)..(376): n is a, c, g, or t
tcagatacgacgtacacgaccggtgctcgatttagtgatagagcgtaacaacagagggcctcaccatggagtttgggctgagctgggttttcctcgttgctcttttaagaggtgtccagtgtcaggggcacctggtggagtctggggganccgtggtccagccgtgggcgtccctgacactcgctgtgttgctctggatttcccttgtaatttctattccattcgctacgtcgggtcccaccgaggcctcccgagggccgaaggggccttacggnggtgggtacggctactttagttcgactactatgagtggcgtacaaacctaattctaaccggtataaacgttccggtaggacggggcctaacttccaacctntaccgtccaaggaacgtaacctaattaaccaaacgtaaccttacccttttaactacgtacgaaactaaacgttaacggaacctaacggaccgttacgaaaccggttaacccaacgggtaaccgaccgtacccgtacgttacgtaccgtttaatttacgttcggacggacgtaaggacgaagtaccaaccgtaaccgtaccgtacgaccgtacctaacctaacggttcgggtaccgggttcgttttacgggttccgggtaccgggggtacccggttaccggggtacccgttcgggtaccgtacccgttacccggtccctacccgtaacccgttaccccgtcccgaacccgggtacccggaccgttacccgtttcccgggttacccccgttccccggtcccggtccccgtacccgttcccgg

SEQ ID NO: 23086 - DNA, 639 bp, Homo sapiens
  misc_feature: GYAE6OF02FL74W.12.40.D07.1.454.CMB.1.raw
  modified_base (384)..(384): a, c, t, g, unknown or other
  misc_feature (384)..(384): n is a, c, g, or t
tcagatacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggtatttcccttcaattttctattccatgcacgtgggtccgccaggctccaggcaaggggctcgagtgggtcggcacttatgcacatgatggcgtacaaactaaacttctaacgctaaagttccggtgacgggggccgattcaccatcctaccagtagactaaagttacaagtaacctacccttttanctagacctaaagtagaccagaccctagacgaccacggaacgaccgacggcgttgtactatttagttacggcgcgaaggacgagacaacgaaccgaaccgtacgtacggaccaagtaccgtaagttcgggggcttggttcgtggggccgtacgggggtaccctgggtcacgtccgtccgtccccgtacgccctacccgacccgtacggtaccctacgttcccggtccttcccccgtggccccgtcccgtcgtcccg

SEQ ID NO: 23087 - DNA, 816 bp, Homo sapiens
  misc_feature: GYAE6OF02ISDAN.12.40.D07.1.454.CMB.1.raw
  modified_base (256)..(256): a, c, t, g, unknown or other
  misc_feature (256)..(256): n is a, c, g, or t
tcagatacgacgtacacgaccggtgctcgattttagtgatagagcgtaacacagagggctcaccatggagtttgggctgagctgggttttcctcgttgctctttttaagaggtgtccagtgtcaggggcacctggtggagtcgtgggggacgccggttggtccaggccgtgggcggtccctgacactcgcctgtgttcgcctcgtggtacttttcccttactaatttttctacttccagtcgcacgtcgggtcccnccgacggcctaccgagggaccgaagggggtcctcgggaggttcggggtcgaccgtaacgtttagttcgacctaacagttggagtcggaccgttaacaaaacgttaaaacgtttccgtaacgtaaccgtaaaacgtttccgggtagggaacgggggtacccgttattacccaaccgtactttcccgacgaaggtaacgaaactaaacgtttaaccgaaaacgtaacccttaacccgttttatccgtaagaactaaagtaacgacgtacgcctagaacggaaccgaacggaccgtaaccgacggtacttacgttacttaagtttacgtacggacggtaacgacggacgaacgtaaccaaccgaaaccgttaacccgtacgtaaccgaacctaaacgttacggtaggttacggggttctttacggttacggcggggtacccgtaacgggtacccttaggtaccaccggttccgtacccgtccccgaacggtccccaaccgaacccggtacggtcccttaccgttcccggttacccctcccggtccggtcccgtccgtacccgg

SEQ ID NO: 23088 - DNA, 702 bp, Homo sapiens
  misc_feature: GYAE6OF02GUS3U.12.40.D07.1.454.CMB.1.raw
  modified_base (150)..(150): a, c, t, g, unknown or other
  misc_feature (150)..(150): n is a, c, g, or t
  modified_base (251)..(251): a, c, t, g, unknown or other
  misc_feature (251)..(251): n is a, c, g, or t
  modified_base (360)..(360): a, c, t, g, unknown or other
  misc_feature (360)..(360): n is a, c, g, or t
  modified_base (444)..(444): a, c, t, g, unknown or other
  misc_feature (444)..(444): n is a, c, g, or t
  modified_base (533)..(533): a, c, t, g, unknown or other
  misc_feature (533)..(533): n is a, c, g, or t
  modified_base (553)..(553): a, c, t, g, unknown or other
  misc_feature (553)..(553): n is a, c, g, or t
  modified_base (622)..(622): a, c, t, g, unknown or other
  misc_feature (622)..(622): n is a, c, g, or t
tcagatacgacgtacacgaccggtgctcgatttagtgatagagcgtaacaacagagactcaccatggagtttgggctgagctgggttttcctcgttagcttcttttaagaggttgtccagtgtcaggggcacctggtgagtctggggganccgtggtccagcctgggcgtcctgacactcgcctagtcgttgcctcgtggtacttttccccttagaaatttttcaatttcccgattgctacgtgggttccnccgtaaggctaccagggcaaggggctcggaggtgggtgctactttagtgaccaacattgaagtcggactacaaaataacttttcgaaccggtataaaacttttccgggnggaacggggtccctaattccgaacctagtcctaccgaagaccgtaacaaaacgtttacaaacgtaaacccttacccgttttaanccgtagaaaccgtaaatacggaactacgtacctaggaaactaccggaagtacgaccgtaagtctagtactattacgtgacgacgaaganacgacaaccgtacgtaaccncggtacactaactacggtaggtacgggttctagggttacgtcggggaacctcggggtaccttgggaccncgttaccgtccgacccgtcgaccctaccgaaccgtacgcccgtagtcccggttaccctccccgtagggtcccacttccgg

SEQ ID NO: 23089 - DNA, 1018 bp, Homo sapiens
  misc_feature: GYAE6OF02G8P7O.12.40.D07.1.454.CMB.1.raw
tcagatacgacgtacacgaccggtgctcgatttagtgatagagcgtaacaacagagggctcaccatgggagtttgggctgagctgggttttcctcgttgctcttttaagaggtgtccagtgtcaggggcacctgggtggagtcgtggggggagccggtgggtccaggccgtggggccggtccctgacactccgcctggtcgttgcctcgtggtacttttcccttactaattttctaacttccgatcgctacgtggggtccgaccgagggcctaccgagggaccggaacgggggtccgtacggaaggggttgggggttacggccttaacggtttaattcggacaaccgtaagttcgaggttcggggccttaaccgaaaaccttaaactttcccgtaaccgtacgtaaaacgttcccggtaagggaccggggggtaccttaactttccgaacctattaccccggtaccgaaaggtaaccgtaaacctaaattaaaccgtaaaacggttaaaccctttaaccccgtttttataccgtaggtaaaacccttaaaaggttaactacccggaaacggtccctaaagggggaacccaaacccttaaccgggaaacccggtaaacggacccgggtaccctaggtttaaacccgtttttaagttttacggttacggaccggtaacggacgggaacgggtaacgaaccgttaaaacccgtacggaaaccccgttacggaacccgggttaaacccttaaacgggtaaccggtttaacggggttacggggggtttacgtttttaaccgggggttccggggttaaccgggggtacccgggtacgggggttaacccgttccgggggtttaaccgacccggtttaccgggttaaccccctccccggtaaaccctaccccgttaaaccccccggtaacgggtaaccccggggtcccgttacccggggtttacccccggttaccccgttttacccccccgggggtccgggttacccccggtccccgttacccggg

SEQ ID NO: 23090 - DNA, 594 bp, Homo sapiens
  misc_feature: GYAE6OF02G5C1C.12.40.D07.1.454.CMB.1.raw
  modified_base (108)..(108): a, c, t, g, unknown or other
  misc_feature (108)..(108): n is a, c, g, or t
  modified_base (152)..(152): a, c, t, g, unknown or other
  misc_feature (152)..(152): n is a, c, g, or t
  modified_base (185)..(185): a, c, t, g, unknown or other
  misc_feature (185)..(185): n is a, c, g, or t
  modified_base (241)..(241): a, c, t, g, unknown or other
  misc_feature (241)..(241): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (503)..(503): a, c, t, g, unknown or other
  misc_feature (503)..(503): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (540)..(542): a, c, t, g, unknown or other
  misc_feature (540)..(542): n is a, c, g, or t
  modified_base (544)..(544): a, c, t, g, unknown or other
  misc_feature (544)..(544): n is a, c, g, or t
  modified_base (549)..(550): a, c, t, g, unknown or other
  misc_feature (549)..(550): n is a, c, g, or t
  modified_base (555)..(555): a, c, t, g, unknown or other
  misc_feature (555)..(555): n is a, c, g, or t
  modified_base (559)..(559): a, c, t, g, unknown or other
  misc_feature (559)..(559): n is a, c, g, or t
  modified_base (569)..(570): a, c, t, g, unknown or other
  misc_feature (569)..(570): n is a, c, g, or t
  modified_base (573)..(573): a, c, t, g, unknown or other
  misc_feature (573)..(573): n is a, c, g, or t
  modified_base (578)..(578): a, c, t, g, unknown or other
  misc_feature (578)..(578): n is a, c, g, or t
  modified_base (587)..(588): a, c, t, g, unknown or other
  misc_feature (587)..(588): n is a, c, g, or t
  modified_base (591)..(592): a, c, t, g, unknown or other
  misc_feature (591)..(592): n is a, c, g, or t
tcagatacgacgtacacgaccggtgctcgatttagtgatagagcgtaacaacagagggctcaccatggagtttgggctgagctgggtttcctcgttgctcttttaagnggtgtccagtgtcaggggccaccgtggtggagtcgtgggggganccgtggtaccagcctggggccggtccctagacnctcgctgtgttgcctctgtctttcctcaatttctattccatcgcacgtcgggtccnccagggcctccgaagggtaccgaacgggggtcctaggtaggtggggttacgacctaacttttacgttacgaccacgaagttggaacttcggggaccttaacaaaacctaaaatttcccgtaacgactaaaaccgtttccgggaggaaccggggtccctaattccaaccgtattccgaaccgaagacgtaacctaaagtaaccaaaggaaaccctccttttagctacgaactaaatccganancgtanacgaacagactacgngctgtactatcgtancgacganaganacacacactannntnagcanncgagnacgntagcatcgannagnacgtnacagtacannganncg

SEQ ID NO: 23091 - DNA, 878 bp, Homo sapiens
  misc_feature: GYAE6OF02IASAU.12.40.D07.1.454.CMB.1.raw
  modified_base (152)..(152): a, c, t, g, unknown or other
  misc_feature (152)..(152): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcgaggggcacctggtggagtcgtgggggganccggtggtccagcctgggcgtccctgacactcgcctgtgttcgcctcgtggtactttcccttataacttttctacttccatcgctacgtgggtccgccgaggcctccgaggacgaaggggctcgggaggtcggggtgcctactttagttgacactagtgaacgttcgggactaaccgaaactaaacgttttaccgaacggaaccttaaaacggttttcccgggaggggtaaccgggggacccttaacgtttcccgaacccctaacgtttcccgtaacccggaaagggtaaaccgtaaaccgtaaattaaaaccggaaaacgtaaaccctttaaccccgttttaagacctagaaacgtaaaactaacggaacctacgaccgttacggaaaccgtaccaaggtaccgaaccgacgtactacggttacttattacgtcgacgtcgaaacgtagaacgaaccgaacctaaccgtaaaccgtaccgtaacgaacctaagttaccggttagggttacgggttcctttacgggttaccggggtaccggggtaaccggtaccgggggtaacccgttaagggttaccctacgggttccccgttaccccgttaccccggaacccgttaccccgtaccccggaaacccgggtaacccgggttaaccccgtaccggtttcccccgggttacccgtttaccccccggtccgggttaacccccggtccccgttacccggg

SEQ ID NO: 23092 - DNA, 715 bp, Homo sapiens
  misc_feature: GYAE6OF02GUP0G.12.40.D07.1.454.CMB.1.raw
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (303)..(303): a, c, t, g, unknown or other
  misc_feature (303)..(303): n is a, c, g, or t
  modified_base (393)..(393): a, c, t, g, unknown or other
  misc_feature (393)..(393): n is a, c, g, or t
  modified_base (467)..(467): a, c, t, g, unknown or other
  misc_feature (467)..(467): n is a, c, g, or t
tcagatacgacgtacacgaccggtgctcgatttagtgatagagcgtaacaacagaggactcaccatggagtttgggctgagctgggttttcctcgttgcttcttttaaagaggtgtccagtgtcaggggcacctggtggagtcgtgggggagccgtggtccagccgtgggcggtccctgacactcgcctgtgttcgcctntggactttcccttcaattttctattccatgcacgtgggtccnccaggctcaggacaaggggccnggagtgggtgacacgttatcgcaacagtgagtggactanaaactaaattcaacgactaaacgttccgtaggacggggcctaattccaccagtctaccagaacgactaattacaacgtaaccttaccttnactgaaccaaaagtacgactagcctagacgaaccaagaccgtaacgacggtctaggttactattagtagtccgngaagacgtaacgacaaccgtacgaaaccgttacgtcggaacctaaatacgtaacggtggggtacctttggttccggtacggggaccgtaccgggtaccgtgggttacctaacggttccgttacccctaccccggtaaccggtaccccgtacccgtaaaccccgggaaccgggtacccccttaacgggttccccggttaaccccggtttacccccccgtacgggggtaccccctccccgggttacccgg

SEQ ID NO: 23093 - DNA, 847 bp, Homo sapiens
  misc_feature: GYAE6OF02FL28T.12.40.D07.1.454.CMB.1.raw
  modified_base (309)..(309): a, c, t, g, unknown or other
  misc_feature (309)..(309): n is a, c, g, or t
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccgtggtccagcctgggcgtccctgacactcgcctgtgttgcctctggtactttcccttactaatttcctattccatcgctacgtgggtccgccgaggcctccgaggcgaagggggctcggaggtggggtgctacgttatcgcactatggatggcttnaaactaattccgacgactaaacgttccggtaggacggggtccctaattccaacctactccgtaccgaagaacgtactaaacttaacaaacgttaaaccttaaccccttttatacgttacgaactaaagtacgaacctacgtcctaaggaaccgtaccgaacgaacccgtacgaccggtacgttacgtttaccttaatttcggttccggacggtacggtaacgaacggacgaaaccctaaccgaaccccggttaaacccttacgtaaccgtaaacccgttaaacgttaccggttaagggttaccgggggtttcgttttacggggtttccggggttaaccggggggtaccccgggtaaccgggggtttaccccgtttaacgggttaccttacccggttcccggttaccccgtcccccgtaaccggtacccccttaccccgggaaacccggtacccgggtaccccctttaaccggtttcccccgggttttaccccgttaccccccgggttccgggttaccccggtacccccgttacccggg

SEQ ID NO: 23094 - DNA, 871 bp, Homo sapiens
  misc_feature: GYAE6OF02IRLOZ.12.40.D07.1.454.CMB.1.raw
tcagatacgacgtacacgaccggtgctcgatttagtgatagagcgtaacaacagagggctcaccatggagtttgggctgagctgggttttcctcgttgctcttttaagaggtgtccagtgtcaggggcacctggtggagtcgtggggggagccggtggtccagcctgggcggtccctgacactcgcctgtgttgcctcgtggtacttttcccttactaattttctacttccgaatcgaccacgttcggggtcccgcctaggcctacccgagggtaccgaagggggtctacggagggtggggtcggactaacgttacgttagccactaagttggagtacgggtaccgtaacaaacgtaaatttaccctaacgaacctaaacgtttcccgggtacgggacgggggtacccgtactttaccgaaccctacgttaccctaccgaaggtaacgtaaccgtaaaacgtttaaaccgaaaccgttaaaacccttaacccgttttaataccttaacggaaacctaaaagttaccgtaaacacgtaccgtaggaaccgaacccgaacggaaccgtacggaccggtacgtacgttaacttaagttacgttacgtacggtaacgggtaacgaagggtaccgaacgtaaccgtaacccgtaaccgttaacgtaccgggtaacctaaagttaacgttacgggttcgggggttactttacgggttaccgggtacgggtaccgggtaaccgggtcccgttacggttaccgtacgttcccggtacccgtacccggtccgtacccgtacccggtaacccgtaccgggtacccctaccgggtttccccgttacccccgtttccccggtacgggtcccctcccgtaccgg

SEQ ID NO: 23095 - DNA, 646 bp, Homo sapiens
  misc_feature: GYAE6OF02FIAID.12.40.D07.1.454.CMB.1.raw
  modified_base (178)..(178): a, c, t, g, unknown or other
  misc_feature (178)..(178): n is a, c, g, or t
  modified_base (232)..(232): a, c, t, g, unknown or other
  misc_feature (232)..(232): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (411)..(411): a, c, t, g, unknown or other
  misc_feature (411)..(411): n is a, c, g, or t
tcagatacgacgtacacgaccggtgctcgatttagtgatagagcgtaacaacaggagggctcaccatggagtttgggctgagctgggttttcctcgttgctcttttaagaggtgtccagtgtcaggggcacctggtggagtctgggggagccgtggtccagcctgggcggtcctgacnctcgcctgtgttgcctctggatttcccttcaatttcattccatgcactggtccncaggctccaggctaaggggctcggagtgggtggcacgttatgccacatgatggctacaacaattctacgactaaagttccgagacggggtcattcacctatctcaaggacacaattacaagaacctacctttanctagaccaaagtacgacancctgacgaccaggtaccacgacgctntactattacgtgcgtacgtagagacgacacgaaccgaactacgtacgacctaataacttaggtcggggtactttaggttccgtacggggtacccgacggggtacccgtcgggttaccgaacgttccgtaccgttccccgacggtccccttaacccgaacccggtaacccgggaccctaccggtttcccgggttacccctttcccccgggtcgggtaccccgaccccggttaccgg

SEQ ID NO: 23096 - DNA, 823 bp, Homo sapiens
  misc_feature: GYAE6OF02GJLOQ.12.40.D07.1.454.CMB.1.raw
  modified_base (216)..(216): a, c, t, g, unknown or other
  misc_feature (216)..(216): n is a, c, g, or t
  modified_base (244)..(244): a, c, t, g, unknown or other
  misc_feature (244)..(244): n is a, c, g, or t
  modified_base (506)..(506): a, c, t, g, unknown or other
  misc_feature (506)..(506): n is a, c, g, or t
tcagatacgacgtacacgaccggtgctcgatttagtgatagagcgtaacaacagagggctcaccatggagtttgggctgagctgggttttcctcgttgcttcttttaagaggtgtccagtgtcaggggcacctgggtggagtcgtgggggagccgtggtccagccgttgggccggtccctgacactcgcctgtgttgcctctggtactttcccttnaattttcattccatgcacgtcgggtccncaggtcctaccgaggacgaaggggcttacggaggtcggggtacgtactaacgtttagtcgacacgtaagtcggtaagttcgggacctaataaaacgtaaatttccgaacgtaacgtaaagtttcccggtaggacggggtacctacgttaccactatccacaggaacgactaaacgttaacaaacgtaactacttactttagacgtaagaactaaatacggacacgtacctaggactaacccgaaggaaccaacgtaccggtnttacgtacgtttaattacgtcggaaccgaggtaacggacggaaacctaaccgaaacccgtaaaccggaacccttaacgaccgtaaaccgtaacttaaaccggttagggttaccggggtttacctttcgggttaccgggtacccggggggacccgtaaacccgggggttccgttacggttaaacccggttcccgtttaccggtaccccccggttaaccccggtaaccgggttccccttaaacccggaaacccggacccgggttacccgttaccggttcccgttaccccccgtttaccccgggcgtaccccgtccccgg

SEQ ID NO: 23097 - DNA, 932 bp, Homo sapiens
  misc_feature: GYAE6OF02H3OQW.12.40.D07.1.454.CMB.1.raw
  modified_base (150)..(150): a, c, t, g, unknown or other
  misc_feature (150)..(150): n is a, c, g, or t
  modified_base (182)..(182): a, c, t, g, unknown or other
  misc_feature (182)..(182): n is a, c, g, or t
tcagatacgacgtacacgaccggtgctcgatttagtgatagagcgtaacacagagggctcaccatggagtttgggctgagctgggtttttcctcgttgcttcttttaagaggtgtccagtgtcaggggcacctggtggagtctggggganccggtggtccagccgtgggccggtccctgacnctccgcctgtgttcgcctcgtaggtacttttccccttctaattttccttaactttccaatcgcctacgtcgggtcccgtcccagggtcctcccgaagggacgtaaacgggggcctacggaggggtcgggttacggacctaacggttttaattcggacccgaactaagttaggagtacggggtccgttaaccaaaaaacgttaaaaacgtttcccttaaccgggaacccttttaaaaaacggttttccccgggttaaaggggaccggggggacccctttaaacggtttaccccaaaacccgtactttccccggttaacccgaaagggtaaacgaaaccccttaaaaggtttaaaaccaaaaacggtaaaaccccctttacccccttttttaaagggaccttaaggaccctaaaaaaagtttacggaaacccttaaacgggcccttaaagggaaaacccgaacccctaaacgggggtaaaacccaccgtaaccggttaccgttcgggttaactttaagttaacgtttacggacgggaccggtaaagaaccggaagtaaccaacgtacctaaaccgttaccgtacgaacccgtaattaacggtaacgttacgggggtactttacggttccggtaccggggtaccgaacgggtccgtacggacctacgtcggtccctacccggtcgtaccctaccgaaccgtaaccggccctacgttaccggtccccgtccccggtaggtccccgaccgtccgg

SEQ ID NO: 23098 - DNA, 867 bp, Homo sapiens
  misc_feature: GYAE6OF02FSEF3.12.40.D07.1.454.CMB.1.raw
  modified_base (143)..(143): a, c, t, g, unknown or other
  misc_feature (143)..(143): n is a, c, g, or t
  modified_base (271)..(271): a, c, t, g, unknown or other
  misc_feature (271)..(271): n is a, c, g, or t
tcagatacgacgtacacgaccggtgctcgatttagtgatagagcgtaacaacaggggactcaccatggagtttgggctgagctgggtttttcctcgttgctcttttaagtaggtgtccacgtgtcgagggcgacctcggtggngtcgtgggggtagggccggtcggtccgacgccgtcgggcgggtcccgtcgacacctccgccgtcgtgttcgtccgtctggtactttcccttctaatttcttacttccatgcaccgtcgggtcccgccncggtctcccgaggaccggaacggggcgtcggtagggtggggtcggacctacttttagttcgaccactagtagagtggccgtaacaaacgtaaattccgtaacacgtaaacggttccggtaggggaccgggggacctactttaccgaaccctacgttacctacccgtaaaggaacggaaacttaaactttaaacgaaaaccgaaaccctttaccccgttttatacgtacgaaacctaaaaggtaacgaacctacgccgttacgaaacgaaccgacggaacgacccgacgggtcttacgttacgttatttacggttacggccggaacggtacggtaacggaacgtaaccgaaaccgtaaacccggtaaccctaaccggtaaccggaaccttaaaccgtaacgtacgggttacgggttcgtttacggtccgggttacggggaccgggtacccgggaccgttcggtacgtacgtcccgttacccgtacccaccggtacccgtaaccgaaccccggtaacccgggtacccgttacccggtacccgggtttccccgttccccccgggttaaccgggtccccgtacccggttcccgtacccgg

SEQ ID NO: 23099 - DNA, 575 bp, Homo sapiens
  misc_feature: GYAE6OF01CVUF5.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttctgatacaaccaacagacattccttgacacccgcccgctttcaggttacctccttggggcaaagctgccctgaccctttcgggcgcgcagcctgaggatgaggcagagtacctgtgttcccctcgtccctacgttcccggttttttgtcgtttcgggcggtacgggaccaggaccgttggacccggttccgtccggttccacggcccaaggcctcgcccccctcggtccacgtcctcggttccccacccttccctccaccgacgagtacctgagtcccgggg

SEQ ID NO: 23100 - DNA, 532 bp, Homo sapiens
  misc_feature: GYAE6OF01B3CLA.19.81.H04.1.454.CMB.1.raw
  modified_base (441)..(441): a, c, t, g, unknown or other
  misc_feature (441)..(441): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatcctattggtatcagcagaagcctggccaagcccccaagacactgatttctgatacaaccaacagacattccttgacacccgccgcttttcaggttacctccttgggggcaaagctgccctgaccctttcggcgcgcagcctgaggatgaggcagagtacctgtgttccctcgtccactccggttttttgtgtttcgnggagggacagactgaccgtcctcggtcagcccaaggctgccccctcggtcactctgttcccgccctcccttccacgagagtactgagcggg

SEQ ID NO: 23101 - DNA, 632 bp, Homo sapiens
  misc_feature: GYAE6OF01CK151.19.81.H04.1.454.CMB.1.raw
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttctgatacaaccaacagacattcctgacacccgcccgcttttcacgttacctccttggggcaaagctagccctgaccctttcgggcgcgcagcctgaggatgaggcaggagtaccgtgtacgttccctcgtccctacgttcccggttttttgtcgtttcggcggtacggggacctacggaccgttcgacccgttccgtccgggttccaccggccccgaaacgggtccctacggtcccccccgtcgggttacccgacccgttccttcccggttccccctaccccgttccccttacccgtacccggacgtaccgttaaccgtggtaaccgggtcccggggg

SEQ ID NO: 23102 - DNA, 608 bp, Homo sapiens
  misc_feature: GYAE6OF01C641N.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatcctattgtatcagcagaagcctggccaagccccaagacactgatttctgatacaaccaacagacattccttgacacccgcccgtcttttcacgttacctccgttggggcaaagctgcctcgacctttcggcgcgcagcctgagatgaggcagagtacctgtcgttccctcgtcctacgtttccggtttttgtcggtttcggcggtacgggaccgtagacctcggtacccgttccgtccggtcctacggccccgaacggtccgtccggtccccccgtccggtccgtacccgttcccgttccggttccccctacccccttccccttacccgtaccggtacgtacgttaccgtgacggtacccgggg

SEQ ID NO: 23103 - DNA, 557 bp, Homo sapiens
  misc_feature: GYAE6OF01DF2E4.19.81.H04.1.454.CMB.1.raw
  modified_base (549)..(549): a, c, t, g, unknown or other
  misc_feature (549)..(549): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatcctattggtatcagcagaagcctggccaagcccccaagacactgatttctgatacaaccaacagacattccttgacacccgcccgcttttcagttacctccttgggggcaaagctgccctgaccctttcgggcgcgcagcctgaggatgaggcagagtacctgtcgttccctcgtcctacttccggttttttgtcgtttcggcggtacgggaccagactgaccgtccgtcggtcagcccgaaggcctcgcccccgtcggtcctactccttcggttccccaccctccctcccacgacgagtctgnggtccggg

SEQ ID NO: 23104 - DNA, 606 bp, Homo sapiens
  misc_feature: GYAE6OF01BCI8Z.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggaccgtgtcacctctgatcaatatccctattggtatcagcagagcctggccagcccccaagacactgatttctgatacaaccaacagacattccttgacaccccacccgtcttttcaggttaccctccgttgggggcaaacggctcgccctgaccctttcgggcgcgcagcctgacggatgagcagacgtacctgtcgttccctcgtccctacgttccggtttttttgtcggtttcggtcggagggtaccgaggtaccgttcggacccgttccgtccggtcctacggccccgaaggtcctccggccccccgttcggtcccgtaccttcgtaccggttcccccgtcccctccctcccgaccgacgtacgtacctggcggtcccggg

SEQ ID NO: 23105 - DNA, 746 bp, Homo sapiens
  misc_feature: GYAE6OF01DPWNY.19.81.H04.1.454.CMB.1.raw
tcagtactctcgtgcacgaccggtgctcgatttagtagtgtagattcgcgggacggtggcaccagggtcccttaccaactatcacgtcaccatggacctcggactcctctcgtttacttgtttcctcctcacgttgcgtcgcccgaggggttcctaattcccgaggtttcgtgggtcgacttcgaggacgcccgtcactcgacctcgtggcccaggaggacgagtcactctcgacctgtaggctaccaacgcgtgggacgtgtcgaccgttacgttcgatacaagtactcctagttggtatcagtcagaagcctcggcaagccccaagacacgtgacttctcgacgtacaaccgaacaggactacgttcttggacctaacccgcccgtaccttttacgacggtttaccgtccgttacggggacaaacgctcgcctagtacccgtttccgggcgtccgacgacggtcccgtgaggacgtacggacggccgacggaacgtaccgtcgttaccgttcccgtacgttccctaccgttttaccgggttttttcgttcgggtttccgggcgggtacgggtaccgtaggtaccgtacgtacccgtaccgtaccggtaccgtaccggacccggttaacgtccgttcccgccccggtcggtaccggtaccgttacggttaccggttccccgtcccttaccccgttcccgtaccggttaccgttaccggttaaccgtcggtaccgggtaccggggg

SEQ ID NO: 23106 - DNA, 550 bp, Homo sapiens
  misc_feature: GYAE6OF01D80D1.19.81.H04.1.454.CMB.1.raw
  modified_base (502)..(502): a, c, t, g, unknown or other
  misc_feature (502)..(502): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttctgatacaaccaacagacattcctgacacccgcccgcttttcacgttacctcgttggggcaaagctgccctgacccttcggcgcgcagcctgagatgagcagagtactgtcgtccctcgtcctacttccggttttttgtcggtttcggcggtagggaccagactcggacccgttccgtcggtcacgcccaaggctcgcccctcggtccncttcctcgttccccgcccctccgtcccgacgacgagtactggcgcggg

SEQ ID NO: 23107 - DNA, 543 bp, Homo sapiens
  misc_feature: GYAE6OF01EIA0C.19.81.H04.1.454.CMB.1.raw
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
  modified_base (537)..(537): a, c, t, g, unknown or other
  misc_feature (537)..(537): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatcctattggtatcagcagaagcctggccaagcccccaagacactgatttctgatacaaccaacagacattccttgacacccgcccgcttttcaggttacctccgttgggggcaaagctgccctgaccctttcgggcgcgcagcctgaggatgaggcagagtacctgtgttcccctcgtcctacgttccggtttttttgtcgttcggcggagggaccagactgaccgtccgtcggtcngcccaggcncgcccctcgtcnctctcgttcccgccctccctccacgacgagtactgngtcggg

SEQ ID NO: 23108 - DNA, 725 bp, Homo sapiens
  misc_feature: GYAE6OF01D63X9.19.81.H04.1.454.CMB.1.raw
tcagtactctcgtgcacgaccggtgctcgatttagtagtgtagattcgcgggcgtggcaccaggggtcccttccaatatcagcaccatggcctggactcctctctttctgttcctcctcacttgctgcccagggtccaattcccaggttgtggtgactcaggacgccctcactgactgtcggcccaggagggacagtcactctcacctgtcggctccaacgctggacgtgtcacctctgatcaatactcctattggtatcagcagaacgctcggaccaacgaccccaacgacactgtatttctagactaacaaccaacacactacttccttacggacctaccccgtccgtccttttcgtacggtttacccgtccggttcgggggactaacgtcgtcgtcccgtcggtacccgtttccgggccgccgacgcgccgtggaaggtacgtcggaggacgagtaccgtaccgtcgttccgttaccccgttcgtcccttaccggtttttccggtttttcggttcggttcggcggggtaaccggaccgtaacggtcccgtacggtaccccgttccggttaccggtaccgacgaccccgtaacggtcccgtccccggtcccccgttcgggtcccttacccgttcccgttcccgttaccccccgtaccccgtttacccctacccccggtaacggtacccgtaaccggtaccggttccgggacggggtccccggg

SEQ ID NO: 23109 - DNA, 592 bp, Homo sapiens
  misc_feature: GYAE6OF01BBL6X.19.81.H04.1.454.CMB.1.raw
  modified_base (396)..(396): a, c, t, g, unknown or other
  misc_feature (396)..(396): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatactcctattgtatcagcagaagcctggccaagcccccaagacactgatttctgatacaaccaacagacattccttgacaccccgccgtcttttcacggttacctccgttggggcaaagctcgccctcgaccctttcgggcgcgcagcctgagntgagcagagtacgtgtcgttcctcgtcctacgtttccggtttttgtcgttcggtcggacgggtacgacgtacgtcgtaccgtccgtcggtcgacgcccgaaggccgtccgccccgtcggtccgtaccgttcccgttccggttcccccgccccttccccgtacccgtaccgtacgtacgtaccgtggcggtccgggg

SEQ ID NO: 23110 - DNA, 556 bp, Homo sapiens
  misc_feature: GYAE6OF01BVVQ4.19.81.H04.1.454.CMB.1.raw
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (384)..(384): a, c, t, g, unknown or other
  misc_feature (384)..(384): n is a, c, g, or t
  modified_base (437)..(437): a, c, t, g, unknown or other
  misc_feature (437)..(437): n is a, c, g, or t
  modified_base (507)..(507): a, c, t, g, unknown or other
  misc_feature (507)..(507): n is a, c, g, or t
  modified_base (521)..(521): a, c, t, g, unknown or other
  misc_feature (521)..(521): n is a, c, g, or t
  modified_base (547)..(547): a, c, t, g, unknown or other
  misc_feature (547)..(547): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggactgcacctctgatcaatatcctattgtatcagcagaagcctggccaagccccaagccatgatttcnganacaacacagacattcctgacaccgccgcttttcacggttacctccgttggggcaaaggctcgcctcgacccgtttcggccgcgacagtcccngagatgaaggcagacgtactgtcgttcctcgtcctcgtttccggtttttttgnggtttcggacggacggacacgtactcgacccgtcgttccggtcaacgccaaggctccgcccctacggccnctcttcgtaccccnccctccctcccgacgacgtacttacngacggccgg

SEQ ID NO: 23111 - DNA, 733 bp, Homo sapiens
  misc_feature: GYAE6OF01CQSMY.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccaggtccaattcccaggttgtggtgactcaggagccctcactgactgtggccccaggagggacagtcactctcacctgtggctccaacgctggacgtgtcacctctgatcaatatcctattggtatcagcagaagcctggccaagcccccaagacactgatttctgatacaaccaacagacacttccttgaccacccgcccgtcttttccacggtttacctccgttagggggacaaacggtctcgccccttcggtaccccgttttccgggccgtccggccaacggcccgtagacgggtatcggaacgggtcgaacggtacgttaaccgtggttaccgtttcccgttacccgttcccttaaccgtttcccgggttttttacgttcgggtttccgggtcgggtaacgggaccgtaacggtaccgttcggtaacccgttcccgttaccgggtccgtaccggacccgaaacgggtcctcccggtaccccccgttccgggttacccgtaccgtttacccgttcccggtttaccccccgtcccccgttaccccgttaccccgaacccggttaacggtaaccggttaccgtacgggtaccggtacccggggg

SEQ ID NO: 23112 - DNA, 561 bp, Homo sapiens
  misc_feature: GYAE6OF01AOWMT.19.81.H04.1.454.CMB.1.raw
  modified_base (550)..(550): a, c, t, g, unknown or other
  misc_feature (550)..(550): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttctgatacaaccaacagacattccttgacacccgcccgcttttcacggttacctccttgggggcaagctgccctgacccttcggcgcgcagcctgaggataaggcagagtacctgtcgttccctcgtccctacgttccggttttttgtcgtttcggcggtagggaccaggactcgacccggtccgtccggtcacgcccaggcctcgccccctcggtccaccgtcgtcgttcccgccctccctccacgacgacgtaccnggagcgggtcg

SEQ ID NO: 23113 - DNA, 622 bp, Homo sapiens
  misc_feature: GYAE6OF01D8UOZ.19.81.H04.1.454.CMB.1.raw
  modified_base (297)..(297): a, c, t, g, unknown or other
  misc_feature (297)..(297): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccagggttgtggtgactcaggagccctcactgactgtggccccaggagggacagtcactctcacctgtggctccaacgctggacgtgtcacctctgatcaatatccctattggtatcagcagaagcctggccaacgcccccaagacactgatttcngatacaacacagacattccttgacacccgccgtcttttcaggttaccctccgttgggggacaaagctcgtccctgacccctttcgggcgcgctacgctgaggatgaggcagagtacctgcgttaccctcgtcctacgtttccggtttttgtggttcggtcgggacgggacctacggactcgacccggttcctccgggtcacgacccgaacggtaccgtcgacccccgttccgggtccgaaccttcgtttacccgttcccctacccccgttaccctaccccgtacccgaacggtaccggttaaccgttcggacgggtaccccgggg

SEQ ID NO: 23114 - DNA, 672 bp, Homo sapiens
  misc_feature: GYAE6OF01DATGZ.19.81.H04.1.454.CMB.1.raw
  modified_base (298)..(298): a, c, t, g, unknown or other
  misc_feature (298)..(298): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggcctccaacgctggacgtgtccacctctgatcaatactcctattggtatcagcagaagctcgaccaacgccccaagacactgtatttcngactaaccaaccaacagactacttcctacgaccacccgcctctttcgtacgttacctccgttaggggacaaacgtctcgcctcgtacccgtttcgggccgcgcacgcctaggacggatggacggcaaggtacgttaccgtgttaccgttccctccgttccttaccgttttcccggttttttggtcggtttaccgggtcgggtacgggtacgtacgtaccgttcggtacccgttccgtccggtacgaccgtacccgaacggcccttacccggcccccgttccggtaccgtcccgttacccgttcccggttccccccgtccccgttaccccgtacccgtaccggaacgttacggtaaccgtcgggacggtcccggg

SEQ ID NO: 23115 - DNA, 679 bp, Homo sapiens
  misc_feature: GYAE6OF01D8YEU.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattgtatcagcagaagcctggccaacgacccccaagacactgtatttctgatacaaccaacagacattcctacgaccaccccgcccgtcttttcgacggttaccctccgttcgggggacaaacgctacgccctcgtacccgtttcggccgcgcacgtccgtgacggagtggacggcgacggtacgtaccgtaggttccgttaccccttccggttacccgttaccgttttccggtttttttcggtcggtttccgggtacgggacgggtaccgtacggtaccgtccggacccgttccgtccggtcgaccgacccgtaacggtccgtccggtacccccgtccggtacccgtccgttcccgttcccggttcccccgtcccccgttcccgtaccccgtaccggtaccggtacgtaccgtcggaccgggtcccgggg

SEQ ID NO: 23116 - DNA, 735 bp, Homo sapiens
  misc_feature: GYAE6OF01DGINL.19.81.H04.1.454.CMB.1.raw
tcagtactctcgtgcacgaccggtgctcgatttagtagtgtagattcgcggggctggcaccaggggtcccttccaatatcagcaccatggcctggactcctctcttttctgttcctcctcacttgctgcccagggtccaattcccaggttgtggtgactcaggagccctcactgactgtcggccccaggagggacagtcactctcacctgtggctccaacgctggacgtgtcacctctgatcaatactccttattggtactcagcagaacgcctggaccaacgccccaagacactgtactttcagactaacaaccaacacgactagttccttacgaccaccccgtccgtccttttacgaccggtttaccttccggttacgggggacaacgtcgtcgcccgttcgtacccgtttcgggccgcggacgcggtaccgtggagtacgtacggacggacgagggtacgttaccgttcggttaccgtttcccgtccgtttacccgttaccgtttttccgggttttttacgttcgggttaccgggtcggtaccgggaccgtacggtacgtccggtaccgttcccgtaccgggtctaccggacccgtaacgggttcccgtcccgtacccccggttcggtaccccgttacccgttcccggttaccctttcccccccgtaacccgttcccccgttacccgtaacccggacggttaaacccgggtccgtagggcggttacccgggg

SEQ ID NO: 23117 - DNA, 541 bp, Homo sapiens
  misc_feature: GYAE6OF01CYG0N.19.81.H04.1.454.CMB.1.raw
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtgctccaagctggacgtgtcacctctgatcaatatcctatgtatcagcagaagcctggaccaacgcccccaagacactgatttctagactacaaccaacagactattccttacgaccacccgccgtcttttcgacgttacctccgttggggacaacgctcgccctgtacccgtttcgggcgcgcacgcctgagatgagcagagttcgtgtcgtcctcgtcctacgtttccggttttgtcggttcggcggagggacagtactcgacgtccgtcgtacacgcgacgctcgcccctgtcnctctcgtcccnccctcnctacgactagacngngtcgg

SEQ ID NO: 23118 - DNA, 715 bp, Homo sapiens
  misc_feature: GYAE6OF01BXBPB.19.81.H04.1.454.CMB.1.raw
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtcggccccaggagggacagtcactctcacctgtggctccaacgctggacgtgtcacctctgatcaatactcctattggtatcagcagaagcctggccaacgcccccaagacactgtactttctgaactacaaaccaacagactacttccttagacccaccccgtcccgtcctttttacacggtttaccctccggttacgggggacaaacggtcctcgtccctacgtacccgtttccggggacgtccggacgtacgtcccgtaggacggtagtcggtacggacgtaaggtacgttaaccgttggttaccgtttcccgttccgttcccttccgttttcccgggtttttttggtcggtttccgggtcgggacgggtaacccgtaggtaccgttcggtacccggttcccgttcgggtacctacggaccccgtaacgggtccgttccggtcccccgttaccggtcccgtaccgttcccgttaccgttccccctacccttcccctacccgtaccgacgtacgtacggtcggtacgggtcccggg

SEQ ID NO: 23119 - DNA, 665 bp, Homo sapiens
  misc_feature: GYAE6OF01D9SW5.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaaagacactgatttctgataacaaccaacagacacttccttcgaccaccccgcccgtcttttccgaggttaccctccgtttcgggggacaaacgtctcgtccctgtaccccgtttcgggccgcggcacgcccgtggaggagtggacggcgagagtacctcgttcgttccctccgtccttacgtttccggttttttgttcggttcgggtcggtacgggtaccaggtaccgtcggtaccgtcccgttccgggtccacggacccgaacggtccgttacccgtccccccggtaccggttcccgtacccgtttcccgtcccgtttcccccctaccccttcccctaccccgtaccgaacggttaccgtaaccgttggacccgggtccgggg

SEQ ID NO: 23120 - DNA, 790 bp, Homo sapiens
  misc_feature: GYAE6OF01D53L9.19.81.H04.1.454.CMB.1.raw
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgactcaatatcctattggtatcagcagaagcctggccaagcccccaagacactcgatttctgatacaaccaacagactattaccttgaccacccgtcccgtcttttccacggtttaccctccgtttacgggggactaaacggccgttcggccctcggtaccccgttttccggggccggtaccggaccgtaacggccgttacgggaacgggtacgttacggaacgggtaccgtaaacgggtaacgttaacccgttaggtttccggttttcccccttaccggtttaccccgttaccgtttttacccgggttttttttttacgggttcgggttttccggggtaccggggtaaccggggtaacccgtaacggttaccgtacggtaccccgggttccgttaccgggttaccgtaccggtaccccgtaacgggtccccttccggtcccccccggttaccggtcccgtaacccgttccgtttcccggtttacccccgtccccgttccccgtaccccgtaccggaacgtaccggtttaaccgtcggtaaccgggtcccgggg

SEQ ID NO: 23121 - DNA, 523 bp, Homo sapiens
  misc_feature: GYAE6OF01BMVTN.19.81.H04.1.454.CMB.1.raw
  modified_base (341)..(341): a, c, t, g, unknown or other
  misc_feature (341)..(341): n is a, c, g, or t
  modified_base (364)..(364): a, c, t, g, unknown or other
  misc_feature (364)..(364): n is a, c, g, or t
  modified_base (460)..(460): a, c, t, g, unknown or other
  misc_feature (460)..(460): n is a, c, g, or t
  modified_base (505)..(523): a, c, t, g, unknown or other
  misc_feature (505)..(523): n is a, c, g, or t
tcagtactctcgtgcacgaccggtgctcgatttagtagtgtagattcgcgggtgtctctgtggtcaaggtgagtctgtcctggaatttctgtgacaacattgtcacagaaattccaggacagactcaccttgaccacagagacatccgcgaatacagcctacatggacctgggcagcctgacgtctgaagacacggctacatattattgtgtgagagattggaatcgggagactaactggagtcgtgacgtttcttttcgaccccgtggggccaggggacctcggtcattgtcctcctcagccctaccaccgaacgggcccagtccggtcccttcccccgnggcccgccctgcctccgaggacnccaccgtccgagcgccacgacggcccggcccgtgggctcggccgtagggtaccaacggtaccttacccgttaccgaaacggtaggtaacgttacgngggacgggccgggtcgtacgggaccggaaggcccgagtagtacgnnnnnnnnnnnnnnnnnnn

SEQ ID NO: 23122 - DNA, 698 bp, Homo sapiens
  misc_feature: GYAE6OF01CEMWP.19.81.H04.1.454.CMB.1.raw
tcagtactctcgtgcacgaccggtgctcgatttagtagtgtagattcgcgggctggcaccagggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatactcctattggtatcagcagaagcctggccaagcccccaagacactgatttctgatacaaccaacagacattccttgacacccgccgtcttttcacggttcctccgttggggacaaagctacgccctgtacccgtttcgggacgcgcacgtctagaggtataggaggacacggtaacgtaccgtagttcgtttccccgttcgttacccgttacgtttcccggttttttttggtcggttttccggggtaccgggtaacgggtaccgtaacggtaccgttcggaacccggttcccgtccgggttacctaccggtaccccgaaacggtccgttcccggtcccccgttaccgggtacccgtaaccgttcccgtttacccggtttcccccgtcccccgttaccccgtaccccgtaacccggtaacgttacccggttacggtccggggtcccgggtacccggg

SEQ ID NO: 23123 - DNA, 597 bp, Homo sapiens
  misc_feature: GYAE6OF01BDE0R.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtccacctctgatcaatactccctattggtatcagcagaagcctggccaacgcccccaagaccactgatttcagatacaaccaacagacacttcctgaccacccgcccgtcttttcacggtttacctccgttgggggactaaacgctcgccctcgacccgtttcgggcgtcgcacgcctgacggatgagcagagtacctgtcgtccctcgtcctacgtttccggttttttgtcggtttcggcgggacggtacgaggtactcgtacccgtccgtcggtccgacgcccgaacggtccgtccgccccgtcggtcctccgtctccggttcccctccccgtccctccctaccgacgacgtacgtggtcggtccggg

SEQ ID NO: 23124 - DNA, 599 bp, Homo sapiens
  misc_feature: GYAE6OF01BWVX1.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatcctattgtatcagcagaagcctggccaacgcccccaagacactgatttctgataacaaccaacagactattccttgaccacccgccgtcttttcacggttaccctcgtggggcaaagctacgccctgacccgtttcgggcgcgcacgcctgagatgagcagagtactgtcgttaccctcgtcctacgttccggttttttgtcgttcggtcggtagggtaccgagtacgtcgtacccgtccgtccggttaccgacggtacccgaacggtccgtccgtacccccgtcggtcctaccgttcgttcccgttccccgtccccttcccgtcctaccgacgacgtacgtcggacgtccgggg

SEQ ID NO: 23125 - DNA, 644 bp, Homo sapiens
  misc_feature: GYAE6OF01AUF6K.19.81.H04.1.454.CMB.1.raw
  modified_base (296)..(296): a, c, t, g, unknown or other
  misc_feature (296)..(296): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaacgcccccaagacactgatttcngatacaaccaacagacattccttgaccacccgcccgtcttttcacggttaccctccgttcgggggacaaacgctacgcccgtcgtaccccgtttcgggccgtccgacacgccgtggaggatggaggcgaaggacgttaccgtagttcgttcccctcgtcctaccgtttccgggtttttttgtcggtttcggtcgggtacgggtaccgagtaccgtcgacccgttccgttcggccgtacgccccgaaggccctcgtacccccgtcgggtaccctccgttccgtccgttcccccgccccttccccgttacccgaccggtaacgtacggtaaccgtgggaccggtccgggg

SEQ ID NO: 23126 - DNA, 795 bp, Homo sapiens
  misc_feature: GYAE6OF01CB4JK.19.81.H04.1.454.CMB.1.raw
tcagtactctcgtgcacgaccggtgctcgatttagtagtgtagattcgcggggctggcaccaggggtcccttccaatatcagcaccatggcctggactcctctttttctgttcctcctcacttgctgcccagggtccaattcccaggttgtggtgactcaggagccctcactgactgtggccccaggagggacagtcactctcacctgtggctccaacgctggacgtgtcacctctgatcaatatcctattggatcagcagaacgcctggaccaacgcccccaagaccactgtatttactgaactaccaaccaacacgaacctacttccttacgaccctaccccgtcccgttacttttccaacggtttacccttaccggtttacgggggaacctaaaacggtccgttaccggtccccgttaccggtaaccccgttttccgggggcccgtccggaccgtacggacccgttacgggaacgggtacgtacgggacgggaccgtaaggtaaccggttacccgttcggttaccgtttccccgttaccggttacccgttaccgtttttccgggttttttttcggtacgggtttccggggtacgggtacgggtaacccgtacggtaaccgtaccgggtacccgttacccggtaccggtccgacggtaccccgtaagggtccccgtccggttacccccgtccggttaccctacccgttcccgttacccgttccccccgtaccccgttccccgtaaccccgtaccgtaaccggtaccgttaccgcggtacggcccgggtaccgg

SEQ ID NO: 23127 - DNA, 711 bp, Homo sapiens
  misc_feature: GYAE6OF01AY08T.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggacgccctcactgactgtcggcccaggagggacagtcactctcacctgtggctccaacgctggacgtgtcacctctgatacaatactccctattggtaatcagcagaagcctggaccaacgccccaaagaccactgtatttcagtaactacaaaccacaagactaacttcccgttagaccctaccccgcccgttcttttaccgacggtttacccttccggttacggggactaaacgtctcgtcccgtcgtacccgtttcgggcgccgcacgccgtggagcgtaggacggacgtaggacgttaccgttcgttcggtttaccccgtccgttacccgttacggttttcccggtttttttgtccgggtttaccgggtcgggtacgggtacgtacgtacctccgggtaacccgttccgtacccggtacgaccggtacccgtaacgggtccgtcccggtcccccgtacgggttccctaaccgtttccgttcccgttccccctaccccttcccggtacccaaccggttacggaacgttaccgtggtcccggtacgggg

SEQ ID NO: 23128 - DNA, 765 bp, Homo sapiens
  misc_feature: GYAE6OF01C8YT5.19.81.H04.1.454.CMB.1.raw
  modified_base (235)..(235): a, c, t, g, unknown or other
  misc_feature (235)..(235): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggaggacagtcactctcacctgtcggctccaacgctggacgtgtcacctcngatcaatactcctattggtatcagcagaacgcctggccaacgcccccaagaccactagtactttctagaactaaccaaaccaacaagaactacttacccgttacgaccgtaaccccgtccgtacttttaccgacggttttacccgttccggttacgggggacaaacgggtcctcggtacccgttcggtacccgtttccgggccgtccggcaacggtccgtaggtacggagtacggacggcgtaggtaacgtaccgttcggttaccgtttcccgtaccggttccttaccgttttccgggttttttggtccggttcgggtacggtaacggggtacccacggtaccgttccggacccggttccgtacccggttacgaaccggtaccccgtaacgggtcccttcccggtacccccccggttaggtaccccgtacccggtttccccttacccggttcccccccgttaccccttacccgttaaccccgaccggttaacgtacccggttaaccggtacggtcccggggtacccgggg

SEQ ID NO: 23129 - DNA, 564 bp, Homo sapiens
  misc_feature: GYAE6OF01EAUNG.19.81.H04.1.454.CMB.1.raw
  modified_base (294)..(294): a, c, t, g, unknown or other
  misc_feature (294)..(294): n is a, c, g, or t
  modified_base (524)..(524): a, c, t, g, unknown or other
  misc_feature (524)..(524): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatactcctattgtatcagcagaagcctggccaagcccccaagacactgatttcngactacaaccaacagacattcctagaccacccgccgtcttttcgacggttacctcgttcggggacaaacgctcgccctcgtacccgtttcgggccgcgcacgcctagaggagtgaggcagacgtactgtcttcctcgtcctacgttcgtttttgtgttcggcggtcggacagactcgtacgtcgtcgtcacgccgaggctccgtcccgtcggtcctacgtctccgtcccnccctcccgtaccctacgtaacgtacgtcgcggcggtaccg

SEQ ID NO: 23130 - DNA, 811 bp, Homo sapiens
  misc_feature: GYAE6OF01DMVQR.19.81.H04.1.454.CMB.1.raw
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtcggccccgaggagggacagtcactctcacctggtcggcctaccgaacgcgtcgggtacgtcgtacctacccttctacgtactaacctaattaccttaccccttagttaggtaatccgaagccgaaggaacgtacccgtcggaccaaaccgaccccccgaaagacacctagtactttccgtagaactaaacaaccaaacacgtactactttccgtacaaccgccccgtacccgttctttcgtaaccggtttacccttcgggttacggggaactaagtccttacgtccccgtacgttaccccgggttcgggccgccgtaccgcgtacccggtggacggtacggtacggacgggacgtaaggtaccggtaccgttacggttccgtttccccgttcccgttacccgtttacccggtttttccgggtttttcggttttccgggtttccgggtaccggggtaccgggtaccggtaacgtacggtaccggtacccggttcccggtccgtaccgtaccggtaccggaccggtcccggtacccggtcccgtacccgtaccgtaccgtccgttcccgttccccgtacccctaccccgacccgtttttaccgaacggtaccgtacggtcggtcgggtacccggg

SEQ ID NO: 23131 - DNA, 630 bp, Homo sapiens
  misc_feature: GYAE6OF01B0KZ0.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatactccctattggtatcagcagaagcctggccaagcccccaagacactgatttctgatacaaccaacagacattcctgaccacccgcccgtcttttcacgttacctccgttaggggacaaagctcgccctgtacccgttcggcgcgcacgctgaggatgaggcagacgtacctgtcgttccctccgtccgttaccgtttccggttttttcgtggtttcgggtacgggacgggtaccgtaggtacgtccgtaccggtccgtcggtccgacgtcccgaagggcccgtccgtcccccgtcggtaccgtccgttacccgttcccggttcccccgtccccttccccgtaccccgtaacggtaccgtaacggtaccgtcgggcggtacccggggg

SEQ ID NO: 23132 - DNA, 785 bp, Homo sapiens
  misc_feature: GYAE6OF01CLQAL.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtcggcccaggagggacagtcactctcacctgtggcctccaacgcgtggacgtgtccacctctgatacaatactcctattggtatcagacgagaacgcctcggaccaacgacccccaaagaccactcgtatttctagaactaacaacccaacaacgaactacttcctacgaaccctaccccgtcccggtacttttaccgtacggtttacccttaccggttacgggggacaaacgtacgtcgtacccgttcgtaccccggtttcggggccgccggtaccgacgtccgtcgggaacggtacgtcggacgggacgtaacggtaacggttaccgttacggttacgtttccccgttaccggttacccctttaccggttttttcccgggtttttttcggtttccgggttttccggggtacggggtaacgggtaccgtaacggtaccgttacccgggtacccggttcccggttacggtaccgaccggtacccggaacgggtcccgtaccccggtccccccgttaccggtcccttaccggttcccgtttcccgttacccccgtaccccttcccgtacccgtacggtaccgttacgtaaccgtgggacgggtcccgggg

SEQ ID NO: 23133 - DNA, 613 bp, Homo sapiens
  misc_feature: GYAE6OF01BF1QZ.19.81.H04.1.454.CMB.1.raw
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattgtatcagcagaagcctggccaagcccccaagacactgatttctgatacaaccaacagactattccttgacacccgcccgtcttttcacggttaccctccgttggggcaaagctcgccctgaccctttcgggcncgcagcctgagatgaggtnaggtagtacgtgtcgttccctcgtccctacgtttccggttttttgtcgtttcgggcggtacgggaccgagtacgtcggtacccgtccgttccggtcgacgtcccgaaggtccgtccgcccccgtcggtccgtaccgttccttccggttccccctaccccttcccgtacccgtaaccggacgtaccgttaccgtcggtacggtcccgggg

SEQ ID NO: 23134 - DNA, 722 bp, Homo sapiens
  misc_feature: GYAE6OF01C9SD2.19.81.H04.1.454.CMB.1.raw
  modified_base (710)..(710): a, c, t, g, unknown or other
  misc_feature (710)..(710): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccgaggttgtggtgactcaggacgccctcactgactgtcggccccaggaggacagtcactctcacctgtcggctccaacgcgtggacgtgtccacctctgtaatactaaatacttcccttaagttggtacttcacgcaagaacgccgtaggacccaacgcccccaaagacacctgtactttcagaactaacaaccgaacacgtaactacttaccgttacgaacccaccccgtcccgttcgttttaccgtaccggtttacccgttaccgttgggggactaaaccggtcctacggtcccctcggtaccccggtttcgggaccgtccggacgtcgcccgtggaacggtacgtcggaacggacgtaacggtacgttaccgttcgttaccgtttcccgccgttacccgtttaccgtttttccggtttttcgtacggttcgggacggtcggtaccgtaggtaccgtcccggtaccgttccgtacgtcgaccgccgtacgtcccgtcccgccccgttgccctaccgtccgttcccgttccccgtcccctccgtacccgacgtaaccgtagtacgnggcggtaccggg

SEQ ID NO: 23135 - DNA, 904 bp, Homo sapiens
  misc_feature: GYAE6OF01EC1A5.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggacgccctcactgactgtcggccccaggagggacagtcactctcacctgtcggctccaacgctggacgtgtcacctctgatacaatactcctattgtatcagacaagaacgcctacggaccaaccgacccccgaagaccacttacgtacttttacgtacgtaactaaccaaaaccgaaaccgaacgtaacctacgttttaccctacgtacccgacccccgtcccgtttccttttaccgtaacggttttaccccgttaccggttacgggggtaacctaaacgtccgttaccgtccccgttaccggttaccccggtttccgggaccgtccggtaccgtaccggtccggttacggacggtacgtacggacgggtacgaacggttacgttaccgttcggtttcccggtttaccccctaccgtttcccgtttacccggtttttttccgggtttttttacggccgggtttttaccgggaccggggtaccgggttaaccgtaaccgggttaccgttaccgggtaccccgtttcccgggttaccgggtaccccgtaccggtacccccggtaccggggtacccttccccccgggttccccggttacccgggttaccccgttccccggtttaccccggtttaccccggttttccccccccgttcccccccgttcccccgtttaaacccccgggaaacccggttaccggttaacccggtttacccggtcggggttaacccggggtacccccgggg

SEQ ID NO: 23136 - DNA, 857 bp, Homo sapiens
  misc_feature: GYAE6OF01BZCHO.19.81.H04.1.454.CMB.1.raw
tcagtactctcgtgcacgaccggtgctcgatttagtagtgtagattcgcggggatggcaccaggggtcccttccaatatcagcaccatggcctggactcctctctttctgttcctcctcacttgctgcccagggtccaattcccaggttgtggtgactcgaggacgccctcactgactggtcggccccagggagggacagtcactctcacctgtgcctaccaacgcgtaggtacgtcgtcctacctcgtagtactactaattaccttaccgttagttggttaactcgacgtacaagaacgccgtacggaccaaaccgacccccaaagacctacttacgtacgttttcacgtactaaaccaacccaacgacgaactacttccgttaccgacccgtaccccgtccttccgttttaccgtaccggtttacccgtccgggttaacgggggactaaaccggtcgttacccgtcccgttacccggttacccgggttccgggccgtccggacgtaccggttaccgtagggaacggtacggtacggagggtaaccgtacgggtaacccgttaccgttccggttacccgttcccccggttaccgttacccgtttaccggttttcccgggtttttaggtttccgggttaccggggttaccgggtaccgggtaaccggtaaccggttaccggtaccggttacccggtcccgggttaccgtccgtacccgtaccggtaccggtaccgttccccggtccccgttaccccggtaccgtccccggttccgttaccccggttcccccgtccccggttacccccttaccgcccggttaaacggtccggtaacgggtccggtaccgggtaccggg

SEQ ID NO: 23137 - DNA, 771 bp, Homo sapiens
  misc_feature: GYAE6OF01EZ708.19.81.H04.1.454.CMB.1.raw
tcagtactctcgtgcacgaccggtgctcgatttagtagtgtagattcgcggggcgtggcaccaggggtcccttccaatatcagcaccatggcctggactcctctctttctgttcctcctcacttgctgcccaggtccaattcccaggttgtggtgactcaggagccctcactgactgtcggcccagggaggacagtcactctcacctgtgctccgaacgctggacgtgtcacctctgatcaatatcctattgtatcacgcacgaagcctggccaacgcccccaagacactgtatttctagactacaaccaacacgtaccattccttagaccaccccgtccccgtacttttccgaacggtttacccttccggtttcggggggacctaaacggtccgtaccgtacccgttccgtaacccccgttttccggggcgtccgtaccacggtccccgttagggacggtaacgtacggaacgggaccgaacggtaacgttacccgtacgggttaccgttcccccgttaccggttacccttaacccggttttcccgggtttttttacgggttcggtttcccggggtaccgggttaaccgggggtacccctaacgggtaccgttccccggtaaccggtttcccggtccggttaaccgtacggtacccgtaaccggtccggtccccgtcccccggtacccggttccgacccgtttcccgtaccttcccccgtaacccttcccgtacccaccgggtactaacgttccgcggtcggtacccggg

SEQ ID NO: 23138 - DNA, 831 bp, Homo sapiens
  misc_feature: GYAE6OF01DW05O.19.81.H04.1.454.CMB.1.raw
  modified_base (184)..(184): a, c, t, g, unknown or other
  misc_feature (184)..(184): n is a, c, g, or t
  modified_base (300)..(300): a, c, t, g, unknown or other
  misc_feature (300)..(300): n is a, c, g, or t
tcagtactctcgtgcacgaccggtgctcgatttagtagtgtagattcgcggggctggcaccgaggggtcccttcaatatcagcaccatggcctggactcctctctttctgttcctcctcacttgctcgacccagggtacctaactttccccgagggtttggtgggtcacgtacgacgggtaccncccctacacgtacgtacgtcggtcggaccccgaaggggacgggaacacgtaccaccttctaccgtaccgtggtcggacctaccgacgtcgtacggtacgtcgtacctacctcgtanactactaactaccgttaccgttagtcgtactacgacgaacacgaacggccgtaccgaaccgaaccgacccaataaccagttcgttattacgaactacctaaaccaaacgacaaccgtactaccgttaccgtaccgacccgtaaccccgttccgttaccgttttaaccgtaccggtttacccgtggggtaaaccggtaacgtaacctcggtacccggtcccgttaccggttacccggttcggccgaccggtcggtacctcggtacggacgggtacgagtacgggactacggtaacgttaccgtccgttacccggttccgtaccgttttccgtttacggtttttacggttcggttccgggtcgggtacggtaccggtccgtaaccggtcggtcccgtaccgtccggttacggcccgtaacgcccgtaacgtccccgtacccggtccgtaccgtcccttaccggtccccttccccgtccccgcccgttaaccccgaccggtacggaccgtacgtccggcgggtcggtacccggg

SEQ ID NO: 23139 - DNA, 798 bp, Homo sapiens
  misc_feature: GYAE6OF01AOM8M.19.81.H04.1.454.CMB.1.raw
tcagtactctcgtgcacgaccggtgctcgatttagtagtgtagattcgcgggctggcaccaggggtcccttccaatatcagcaccatcggcctggactcctctctttctgttcctcctcacttgctcgcccagggtccaacgttcccgaggttgtaggtcgactcaggacgccctacactgacctggtcggacccgaggggaggacagtccactcctactccgtgtcggcctacccgaacgctcggacgtgtaccacctactgtaactactaacttaccgttacccgtagttacggtatcgaacgacgtaggaacgccgtaccggaccctaacccggacccctaagacctactagtctttcataccgtaaccaacacagtactctaccgtcgacctcccgtccttcttacgtacgtccgttcggtacgggtacacgtcctccgtacccgtcgtaccccgttcggccgtcgacgtccgtacgtacgaggtacgtacggtacggtacggtaacgtacggtaccgttcggtccctttccgttccgttccgtttaccggttttccggtttcggttacgggttccgggaacgggtaccggtaccgtaccgggttaccgtaccggtccggttacccggtaccggtacccgacccgtaccgggtaccgtcccggtacccgtccccgggttaccttacccggttcccggttaaccccttcccgggtaccccctttacccggttacccctaccgtaaaccgggttcccgaaaaccggtttcccggtaccgggtacggttaccggggg

SEQ ID NO: 23140 - DNA, 536 bp, Homo sapiens
  misc_feature: GYAE6OF02I8PUH.19.81.H04.1.454.CMB.1.raw
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (494)..(494): a, c, t, g, unknown or other
  misc_feature (494)..(494): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttctgatacaaccaacagacattccttgacacccgcccgcttttcaggttacctccttgggggcaagctgccctgaccctttcgggcgcgcagcctgaggatgaggcagagtacctgtcgttccctcgtcctacttccggttttttgtgttcggcggngggaccngctgaccgtctcgtcagcccagctcgcccctcgtccnctctcgttcccaccctcctccacgacgacgtactgagccggg

SEQ ID NO: 23141 - DNA, 548 bp, Homo sapiens
  misc_feature: GYAE6OF02H04X8.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagccccccaagacactgatttctgatacaaccaacagacattccttgacacccgcccgcttttcaggttacctccttgggggcaaagctgccctgaccctttcggcgcgcagcctgaggatgagcagagtacctgtgttccctgtccactttccggttttttgtcgtttcggcggagggaccagactgaccgtcctcggtcacgcccaaggctcgccccctcggtccactcctcgttccccaccctccctccaccgacgacgtactcgagccggg

SEQ ID NO: 23142 - DNA, 541 bp, Homo sapiens
  misc_feature: GYAE6OF02HOXS6.19.81.H04.1.454.CMB.1.raw
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattgtatcagcagaagcctggccaagcccccaagacactgatttctgatacaaccaacagacattccttgacacccgcccgcttttcaggttacctccttgggggcaaagctgccctgaccctttcgggcgcgcagcctgaggatgaggcagagtacctgtgttccctcgtccacttccggttttttgtgttcggcggtagggaccagactgaccgtccgtcggtcagcccaaggctgcccctcggtcactcctgtcccgccctccgtccacgacgacgtactgagtccggg

SEQ ID NO: 23143 - DNA, 648 bp, Homo sapiens
  misc_feature: GYAE6OF02G9DWU.19.81.H04.1.454.CMB.1.raw
  modified_base (366)..(366): a, c, t, g, unknown or other
  misc_feature (366)..(366): n is a, c, g, or t
tcagtactctcgtgcacgaccggtgctcgatttagtagtgtagattcgcggggctgggcaccaggggtcccttccaatatcgagtccaccgattggccttggactcctctctttctgttcctcctacacttgctgcccagggtccaagttccctagggttgtgggtggactcgtacggtaggtccctctacttaggactcgtggccccagggagggacagtcactcgtcgacctgtggggctcctaacggcctggaccgggtcgtcaccgtctgatcaatactccctattggtatctagcctagaagcctggaccaagtcccccaagacactggacttctgatacaacgaacgagacgattccgtnacacccgtaccgtctttcacggttacctcgttgggggcaaacgtctgccctgtacccgtttcggggccgcgtcacgctcgacggatgagctagagtacctggtcgttccctcgtaccacgttccggtttttacgtcggttcgggccggagggtacccaggtacctcggaccgttccgtccgttcgtacggccctaaggcctcgcccccgtaggtcccgacgtaccttacgttacccacccttccgtacccacggtacgtacgtaccgtaggacggtaccggg

SEQ ID NO: 23144 - DNA, 611 bp, Homo sapiens
  misc_feature: GYAE6OF02JZCPM.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgattctgatacaaccaacagacattccttgaccacccgcccgcttttcacggttaccctccgttagggggcaaagctacgccctgaccctttcggccgcgcacgcctgagatgaggcagagtacctgtcgttccctcgtcctactttcccggttttttgtcggttcgggcggtacgggacctaggtaccgttcgacccgttccgttcggttaccgacgcccgtaagggtcctacggtcccccttccggttccgtaacccttccgttcgttcccctacccgttcccgtaccctaccgacggtactaccgtcgacggtacccggg

SEQ ID NO: 23145 - DNA, 552 bp, Homo sapiens
  misc_feature: GYAE6OF02GO5TL.19.81.H04.1.454.CMB.1.raw
  modified_base (381)..(381): a, c, t, g, unknown or other
  misc_feature (381)..(381): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttctgatacaaccaacagacattccttgacacccgcccgcttttcaggttacctccttgggggcaaagctgccctgaccctttcgggcncgcagcctgaggatgaggcagagtacctgtgttccctcgtcctacttccggtttttttgtgtttcggcggtagggaccagactcgaccgtccgtcggtcagcccaaggcctcgcccctggtccacgtcctcgttcccgccctccgtccacgacgacgtacgtgagtccggg

SEQ ID NO: 23146 - DNA, 671 bp, Homo sapiens
  misc_feature: GYAE6OF02JGQGG.19.81.H04.1.454.CMB.1.raw
  modified_base (394)..(394): a, c, t, g, unknown or other
  misc_feature (394)..(394): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtcggccccaggagggacagtcactctcacctgtggctccaacgctggacgtgtccacctctgatacaattactccctattggtatcagcagaacgccgtcagggccccaaagccccccaagacactgattctgaactacaacaacagacatcctcgacaccgtccgacttttccacgttaccgtcctaggggccaagctgaccctgacccttcggcncgccagccgtgaggactgaggctacgagtacctcggtcgttccctacgttcccgtttacgttccgggttttttcggtcggtttaccgggtccggtacgggtaccgtacggtaccgttacggtacccggttccgtaccgggtaccgaacggtcccgtaacggtcccgttaccggtacccccgttaccgggttcccgtaacccgttcccgtacccggtttccccgtccccgttacccgtacccgtaaccggtaaccggtacggtaccggtcggtaccgg

SEQ ID NO: 23147 - DNA, 549 bp, Homo sapiens
  misc_feature: GYAE6OF02IXQ92.19.81.H04.1.454.CMB.1.raw
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (503)..(503): a, c, t, g, unknown or other
  misc_feature (503)..(503): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctatggtatcagcagaagcctggccaagcccccaagacactgatttctgatacaaccaacagacattccttgacacccgcccgcttttcaggttacctccttgggggcaaagctgccctgacccctttcgggcgccgcacgcctgaggatgaggcagagtacctgtgttccctcgtccacgttccgttttttgngttcggcggngggaccngtactcgaccgtcctcggtccacgcccaagctcgcccctcggtccnctcctcgttcccaccctcctccgaccgagacgtactggagtccggg

SEQ ID NO: 23148 - DNA, 611 bp, Homo sapiens
  misc_feature: GYAE6OF02HTG22.19.81.H04.1.454.CMB.1.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
tcagtactctcgtgcacgaccggtgctcgatttagtagtgtagattcgcggggcgtggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaaatatccctattggtatcagcagaagctggccaagcccccaagacactgatttctgatacaaccaanagacattcctgacaccgccnctttcagttacctcttaggggcaaagctgcctgtaccctttgggcgcgcacgccgtagacggatggaggcaggataccgtgtactccctcgccacgtttccggtttttgtcgtttcgggcgggtacgggacctaggtaacctgtacccgtccgtccggtctaacggcccctaaagggcctaccgtaccccccggttcggttacccgaactttccggtaccgttcccccgaaccccttcccgtaccctaccggacgtaacggtactccggtacggtaccgggg

SEQ ID NO: 23149 - DNA, 580 bp, Homo sapiens
  misc_feature: GYAE6OF02FORPU.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagaccactgatttctgatacaaccaacagactattccttgaccaccccgcccgtcttttcacggttacctccgttgggggcaaagctcgccctcgaccctttcgggcgcgcacgcctggaggatgaggcgagagtaccgtgtcgttccctcgtcctacgtttccggttttttgtcgttcgggtcggtacgggaccgtacgtacgtcgccgtccgtcggtcacgcccaaggcctcgcccctcggtccgtctccgtcgttccccgtccctccctcaccgtagtacgtacgtgacggccggg

SEQ ID NO: 23150 - DNA, 681 bp, Homo sapiens
  misc_feature: GYAE6OF02HNCDY.19.81.H04.1.454.CMB.1.raw
  modified_base (295)..(295): a, c, t, g, unknown or other
  misc_feature (295)..(295): n is a, c, g, or t
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttcngatacaaccaacagacattcctgaccacccgcccgcttttcaggttacctccgttgggggacaaagctcgccctgtaccctttcgggcncgcagcctgagntgacggcagacgtactagtcgttccctcgtccctacgtttccggttttttgtcggtttcgggtcgggacgggtaccgtacggaccgttcggtacccggttcccgttaccgggttaccgtaaccggtaccccgtaaacgggtcccgttcccggtacccccccgttcgggtaccccgtaacccgtttcccgttcccggtttccccccggttcccccgtttacccccgttaccccgtaacccggtaccggttaaccggttacccgttacgggacccggtacccggggg

SEQ ID NO: 23151 - DNA, 630 bp, Homo sapiens
  misc_feature: GYAE6OF02G14YU.19.81.H04.1.454.CMB.1.raw
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatcctattggtatcagcagaagcctggccaagcccccaagacactgatttctgatacaaccaacagacattccttgacacccgcccgcttttcacggttacctccttgggggcaaacgctgccctgaccctttcgggcgcgcacgtcctgaggactgaggcagagtactgtgttccctcgtcctaccgttccggtttttttgtcggtttcgggtcggtacggggtacccaggtaccttggacccgttccgttccgggtccgacgtcccgaacggtcctccggtaccccccgtccggtaccctacccgttaccttcccggttccccctacccccgttccccgttaccctaccggtaacggtacccggttacgtcggacggtcccgggg

SEQ ID NO: 23152 - DNA, 555 bp, Homo sapiens
  misc_feature: GYAE6OF02HSQUD.19.81.H04.1.454.CMB.1.raw
  modified_base (508)..(508): a, c, t, g, unknown or other
  misc_feature (508)..(508): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagccccccaagacactgatttctgatacaaccaacagacattcctgaccacccgccgcttttcaggttacctccgttggggcaagctgccctgacccttcggcgcgcagcctgaggatgaggcagagtacctgtcgttccctcgtcctacgtttccggttttttgtcgttcggcggtacgggaccaggactcggacccgtcctcggtcacgccaaggcctcggcccctcggtccncttcctcgttccccaccctcctccacgacgacgtactcggagccggg

SEQ ID NO: 23153 - DNA, 591 bp, Homo sapiens
  misc_feature: GYAE6OF02F71R7.19.81.H04.1.454.CMB.1.raw
  modified_base (442)..(442): a, c, t, g, unknown or other
  misc_feature (442)..(442): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatactccctattggtatcagcagaagcctggccaagcccccaaagacactgatttctgatacaaccaacagacattccttgaccacccgcccgtcttttccaggtttaccctccgttgggggacaaacgctcgccctgtaccccgtttcgggccgcggcacgccctggaggactggaggcaggtagtacctgttcgttcccncgttcctactttcggtttttgtgttcggcgggaggactacgacttcgaccgtccgtcgtcgacgcccgagctccgccccgtggcctcgtccgttccgtccccgtccctcccgttccgaccggtaccgtaggtaccgttcgacgtccggg

SEQ ID NO: 23154 - DNA, 543 bp, Homo sapiens
  misc_feature: GYAE6OF02I6A3J.19.81.H04.1.454.CMB.1.raw
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (497)..(497): a, c, t, g, unknown or other
  misc_feature (497)..(497): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgattctgatacaaccaacagacattcctgacacccgccgtctttcaggttacctccgttggggcaagctgcctgtacccttcggcgcgcncgcctgagangagcagagtcngttcgttccctcgtcctacgtttccggttttttgtcgttcggcggacgggccaggacctgtaccgtccgtcggtcacgccgagctcgccctcgtccnctcctcgtcccacccttccacctcgacgtacgtcgtgacggtccgg

SEQ ID NO: 23155 - DNA, 614 bp, Homo sapiens
  misc_feature: GYAE6OF02FWRA5.19.81.H04.1.454.CMB.1.raw
  modified_base (577)..(577): a, c, t, g, unknown or other
  misc_feature (577)..(577): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtccacctctgatcaatactccctattgtatcagcagaagcctgccaagcccccaagacactgatttctgatacaacaacagacattccttagaccacccgcccgtcttttcgacgtttacctcgttgggggacaaaggctgccctggtaccctttcgggccgcgcacgccctgacggatggaggcagagtacctgtcgttccctcgttcctacgtttccggtttttttgtcggtttcggcgggtacgggacctaggaccgttcggtacccgttcgttccggttccacggccctaagggcctccggtccccgtcggtcctaaccgtcctccggttccccgtcccgttcccncccgtacgtaccgtacggtaccttcggaggtcccggg

SEQ ID NO: 23156 - DNA, 614 bp, Homo sapiens
  misc_feature: GYAE6OF02GYXSF.19.81.H04.1.454.CMB.1.raw
  modified_base (393)..(393): a, c, t, g, unknown or other
  misc_feature (393)..(393): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatactccctattggtatcagcagaagcctggccaagccccccaagacactgatttctgatacaaccaacagacattcctgacacccgcccgcttttcacgttacctccgttggggacaaagctcgccctcgtacccgtttcgggccgcgacncgcctggaggatggaggcaggacgtacgtgtcgttcccgtcgtcctacgtttccggttttttcgtcggtttcggtcgggtacgggaccgtagtaccgtcggtacccgtccgtcggtccgtacggcccgtaacggccgtaccgcccccgtcggtaccctccgttccttccgttccccctaccctccctacccgacgaccgtacgtacgtcggaggtcccggg

SEQ ID NO: 23157 - DNA, 555 bp, Homo sapiens
  misc_feature: GYAE6OF02FOV24.19.81.H04.1.454.CMB.1.raw
  modified_base (499)..(499): a, c, t, g, unknown or other
  misc_feature (499)..(499): n is a, c, g, or t
  modified_base (524)..(524): a, c, t, g, unknown or other
  misc_feature (524)..(524): n is a, c, g, or t
  modified_base (549)..(549): a, c, t, g, unknown or other
  misc_feature (549)..(549): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttctgatacaaccaacagacattccttgacacccgcccgtcttttcacggttacctccgttggggcaaagctgccctgaccctttcgggcgcgcacgcctgaggatggaggcagagtacctgtcgttccctcgtcctaccgttccggttttttgtcgtttcgggcggagggtaccagtacctgaccgtccgtcgtcgcgcccgagcncgcccctcggtcactctcgttcccnccctcctccacgacgacgtacgtgngtccgg

SEQ ID NO: 23158 - DNA, 592 bp, Homo sapiens
  misc_feature: GYAE6OF02FVDG0.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatactccctattggtatcagcagaagcctggtcaagcccccaagaccactgatttctgatacaaccaacagacattccttgaccaccccgcccgtccttttcacggtttaccctccgttcgggggcaaacgctcgccctgaccctttcgggcgcgcacgcctggaggatcgaggcaggagtacctgttcgttccctcgtccttactttcggttttttgtgttcggtcggacgggacacgtacgtcgaccgtccgtcgtcgacgccgaacgcctcgccccgtcggtcctaccgtcttccgttccccctacccgttcccgtaccgacgtaccgtacgtacgtcggacgtccggg

SEQ ID NO: 23159 - DNA, 631 bp, Homo sapiens
  misc_feature: GYAE6OF02H0OKB.19.81.H04.1.454.CMB.1.raw
  modified_base (322)..(322): a, c, t, g, unknown or other
  misc_feature (322)..(322): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccagggagggacagtcactctcacctgtggctccaacgctggacgtgtcacctctgatacaatatccctattcggtatcagacagaacgtcctggaccaacgacccccaagacactgtactttctgactacaaccaacganactacttcctgaccaccgccgtctttacgacgttacctccgttaggggacaagtctcgccctcgtacccgtttccgggcgtccggcacggccgtggacggagtcggaggtacgacgacgttacgtgtccggttcctccgtccttaccggttttcgtttttcgtacgggttcggcgggtacggacccgtgtaccgtcgtacccgtcgtacggtcacggccctaaggtccctcgccccgttaccggtctaccgttccgttccgtaccctaccccgttcctacgacgtacgcggtactcggaggtacccggg

SEQ ID NO: 23160 - DNA, 672 bp, Homo sapiens
  misc_feature: GYAE6OF02H1OKW.19.81.H04.1.454.CMB.1.raw
tcagtactctcgtgcacgaccggtgctcgatttagtagtgtagattcgcgggcgtggcaccaggggtcccttccaatatcagcaccatggcctggactcctctctttctgttcctcctcacttgctgcccagggtccaattcccaggttgtggtgactcaggagccctcactgactgtcggcccaggagggacagtcactctcacctgtggctaccaacgctggacgtgtcactctgatcaatactcctattgtatcagcagagcctggaccaacgcccccaagaccactagatttctgatacaaccgaacagacctattaccttagaccacccgtcccgtcttttcgagtttaccctcgttggggacaaagctacgccctgtacccgtttcgggcgaccgtcacgccgtaggacggacgtggtacggcaggtacgtacctgttacgttcccgtacgttcccttacgtttaccggtttttttgtcggtttccgggcgggtacgggtaacgtacggtacgtaccggtaccgttccgttccggtcctaccggtacccgtacggacctccggtcccccgttcggtaccgtaacgttcccgttaccggttccccgtccccgttcccgttcccgtaccggtacggtaccggttaaccgtcggtaacggttcccgggg

SEQ ID NO: 23161 - DNA, 851 bp, Homo sapiens
  misc_feature: GYAE6OF02I9HRQ.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtcggccccaggagggacagtcactctcacctgtggctccaacgctggacgtgtccacctctgatcaatactccctattggtatcagcagaagccgtggaccaacgaccccccaagaccactagtactttctagtactaaccaaaccaaccaagaactactttcccttacggaaccctaccccggtcccccgttacctttttaccgtaaccggttttaccccgtcccgggtttacggggggaacctaaacggtccgtacggtccccgttaccggttaccccgtttccgggggcccgccggccgtacggcccgtaggacggtagtcggacggacgtaggtacggttaccgttcggttccgtttccccgttacccggtttacccttacccggtttttcccgggtttttttaggtttccgggtttaccggggtcggggtaaccgggtacccggtaacgggttaacccggttaccgggtaacccggttccccggttaccgggttaccgtaacccggtaccccggtaaaccgggtccccggttacccggtcccccccggttaccgggttccccgtaacccgtttcccgttccccggttaccccccggtcccccctttaccccgttaccccgtaccggttaacccggtacggttaccgtccgggtaacccgggtcccggggg

SEQ ID NO: 23162 - DNA, 822 bp, Homo sapiens
  misc_feature: GYAE6OF02HEJ7E.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtagactcgaggagccctcactgactgtcggcccagggaggacagtccactctcactgtcggcctaccaacgctggacgtcgtccacctactagaactacaatactcctattcggtatacagtacagaacgcctggaccaagcccccaaggaccactagtactttcagtaactaacaaccaacaagacctattacctacgacctacccgtcccgtcttttaccgacggtttaaccctccggttcgggggaaccaaacggtccgtcgtcccgttacggttaccccggtttaccggggacccgtacccggaccgtacgggcccgttacggaacgggtaacgtagggaacgggtaccgtaaggtacggttaaccgtacggttacccggtttacccgtaccggttaccctttacccggtttttacccgggtttttttggttccggttttaccggggacggtaaccggggtaccgtaacggtaccggtaccgggttacccgttacccggttccgggttaccgtaaccggtacccggtaaaccgggtcccgttaccccgggtccccggttaccggtcccggtaaacccggtttccttaccccgggtttcccccgttaccccgtcccgttacccgtaccggaacggttaccgtacggtacgggtaccgggtcccgggg

SEQ ID NO: 23163 - DNA, 735 bp, Homo sapiens
  misc_feature: GYAE6OF02ILUK5.19.81.H04.1.454.CMB.1.raw
  modified_base (510)..(510): a, c, t, g, unknown or other
  misc_feature (510)..(510): n is a, c, g, or t
tcagtactctcgtgcacgaccggtgctcgatttagtagtgtagattcgcggggctggcaccaggggtcccttccaatatcagcaccatggcctggactcctctctttctcgttcctcctctacttcgctgcccacgggtccaacttcccgaggttgtggtgactcgaggacgccctcactgactggtcggcccgagggagggacagtcactctcaccgtggtgcctaccgaacgcgtcggacgttcgtcacctcgtgactacaatactcccttagttacggtactcagccgaagaacgcgtcggaccaacgacccccaaggaccaacgtcgtactttctacgtaactaaccaaaccaacgacgtacctactttcccttacgaaccctaccccggtcccgttctttaccgtacggtttacccgtaccgggttacgggggtacaaacggtccgtaccggtacccgtcggtaccccgtttcgggaccgccggtcgacgtccgtacggacggtntacggagtacggaagtacgtaccgtgtccgttaccctcgtaccttaccgttttcggttttcgtcggttcgggtacggaggtaccgagtacgtccggtaccgttccgtacgtcaccggtaccgaacggtctaccccgccgttacccgtcgtaacccctcggttacctaacccctcccgtacccgttccaacgggaccgttccggtaccttacgggcgtaccggggg

SEQ ID NO: 23164 - DNA, 737 bp, Homo sapiens
  misc_feature: GYAE6OF02JMEDV.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccagggagggacagtcactctcacctgtggctccaacgctggacgtgtccacctctgatcaatactcctattggtatcagcagaacgcctaggccaacgcccccaaagacacttggactttcagtactacctaaccaacaacgactacttccttagaccaccccgtcccgtcttttacgacgtttaccctccggttacgggggtacaaacggtcctcgtaccctcggtaccccgtttcggggccgacggccacggtccctaggacggtactagggacggtcgaggacgttaccgtggttccgttcccgtccgtccgttaccgtttttccgggttttttacgttccgggtttcgggtcgggtaccgggtacgtaacggtaccgttaccggtaccgttcccgtccgggttaccaaccgggtcccgtaaacgggtccgttcccggtacccccgttcggggttaccctcccggtttaccttcccgggtttaccccctaccccgttacccgtaccccgtaacggtaccgtacccggttacgttacggacgggtacccgggg

SEQ ID NO: 23165 - DNA, 735 bp, Homo sapiens
  misc_feature: GYAE6OF02FN9MM.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatactcctattggtatcagcagaagcctaggaccaacgcccccaagaccactagatttcctagactacaaaccaacaagaactacttccgttacgaccaccccgtcccgtaccttttacacggtttacccttaccggttacggggggacctaaacggtctaccggtaccccgtttacggtaaccccgttttccggggccgtccgtaccgacgtcccgtcggtaggtacgtaggacggacgaggtacgtaccgtacggttcgttaccccgtcgttccttaccgttttccggtttttttacggtcggtttaccgggtccgggtagggaccctaggtacgtaccggtacccgtccgttacggttaccgtacgtacccgacggtccgttcccgtacccccgtaccggtaccgtaccccttaccggttcccgttacccctacccccgttaccgttacccgaccgtaaccggtaccgtaccgtacggtccggtaacccggg

SEQ ID NO: 23166 - DNA, 750 bp, Homo sapiens
  misc_feature: GYAE6OF02HK1SW.19.81.H04.1.454.CMB.1.raw
  modified_base (458)..(458): a, c, t, g, unknown or other
  misc_feature (458)..(458): n is a, c, g, or t
tcagtactctcgtgcacgaccggtgctcgatttagtagtgtagattcgcgggcgtggcgaccaggggtcccgttccaactatcagcaccatggcctggactcctctcttctgttcctcctcactgctgcccagggtccaattcccaggttgtggtgacttcaggagccctcactgactgtggccccagggaggactaggtcactctcacctgtggctaccgaacgctgggaccgtgtaccaccgtctagactcaatacttccctagttcggtatacgtacgacgagaacgtcctcgggaccaacgaccccccgaaagaccactacgtatttacgtgaactaacaaccgaacagactacgttccttcgaaccacccgcccgtcttttaccgacgtttaccccttcggttacgggggctaaacggtcgtaccgcccgtacggttccccgttacggggccnccggtacgacggtcccgttaggacggtagtacggagggacacggtaccggtaccttcggttacgttcccgttcttacccggttaccggttttccggttttttacgtcgggtttaccggggtcgggtaccgggaccgtaacggtcgtacccgtaccggttaccgtccgtacgtcggtacccacggttcacccggtcccgttcgacccgttcgtccctttacggacccccttcccccggttaccttaccccggacgtaacccggtaacgttccgtaccggaccgttcccggggg

SEQ ID NO: 23167 - DNA, 746 bp, Homo sapiens
  misc_feature: GYAE6OF02HFAFG.19.81.H04.1.454.CMB.1.raw
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggtttgtggtgactcaggagccctcactgactgtcggcccaggagggacagtcactctcacctgtgctccaacgcgtggacgtgtccacctgtagactcaatactccttagttggtactcagcaagacgcctcggaccaacgacccccaagacctactgtatttcngtaactaaccaaccaanacgactacttccttagacccacccgtcccgtcttttcgacgtttaccgtcgttacggggacaacgcgtcncccgtcgtcccgttcggcncacgcgcgtagacgatacgacgacgtagtacgtaccgttcgttaccgtcccgttaccgtccgtttaccgtttttccgggttttttcggtcgggtttaccgggtacggggtaccggtacgtacggttaccgtaccggttaacccggttccggtacccgttaccgtaccgggtaccccggtaaccggtcccgttaccccggtcccccgttacggttaccccgttaccgtttccccgttacccccggttacccccgtaacccccgttacccccggaacgttaacccgggttacgttacccgggtaacccgggtagggtacccccggggtacgg

SEQ ID NO: 23168 - DNA, 664 bp, Homo sapiens
  misc_feature: GYAE6OF02G1SJP.19.81.H04.1.454.CMB.1.raw
tcagtactctcgtgcacgaccggtgctcgatttagtagtgtagattcgcgggcgtggcaccaggggtcccttccaatatcagcaccatggcctggactcctctctttctgttcctcctcacttgctgcccagggtccaattcccaggttgtgggtgactcaggagccctcactgactgtcggccccagggagggacagtcactctcaccgtgtggctccaacgcgtggacgtgtccacctctgactactaatactcccgtattaggtactcagtcaagaaacgcctaggaccaacgacccccaaagaccactagtactttctgactaaccaaacaacagactattccgttacgaccaccccgtccgttcttttacctacggttaccgtccggttcggggactaacgtctcgcccgtcgacccgtttcgggcgcgtacacgtccgtaggacgtacgtggacgacgacggtacgtaccgttacggttcgttccctccggtccgttaccgttttccggttttttcgtcggttcggtcgggtacggtacgacgtaccgtacgtaccgtccgtcgtacgacgtaccgtaacggcctccgacccgtcgccgtactccgttccgtcccgtccctccgtacccgtacgtaccgaccgtacggtgacggtcgg

SEQ ID NO: 23169 - DNA, 854 bp, Homo sapiens
  misc_feature: GYAE6OF02HN5H0.19.81.H04.1.454.CMB.1.raw
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
tcagtactctcgtgcacgaccggtgctcgatttagtagtgtagattcgcgggctggcaccaggggtcccttccaatatcagcaccatggccctggactcctctctttctgttcctcctcacttgctgcccagggtccaattcccaggttgtggtgactcaggagccctcactgactgtggccccagggaggacagtcactctcacctgtgctccaacgctggacgtgtccacctctgactcaattactccctattggtatcagcagaacgcctggccaaacgcccccaagacacgtnactttcngtactaaccaaaccaacacgaactactttccttagaacctaccccgccccgtactttttccgacggtttacccttccggttaggggggacctaaacgtccgtacgtacccgtaccggttaccccgtttcggggacccgccggtaccgaccggtcccgttagggacgggtacgttacgggacggggtaccaacgggtaaccggttaccgtttacgggttacccgtttccccggttacccgttacccgttaacccggtttttttcccggggttttttttacggttacgggtttaccgggggtccggggtaaccggggtaacccgtacggttaacccggttccgggtaaccccggttcccggttccgggttaacccgtaccgggaaccccgttaagggtccccgttacccgggtccccccggttaccgggttacccggtaacccgtttcccggttccccggtttcccccccggtaccccttccccggttaaccccgtaaccgggtaacccggttaccggttaacccggtcgggtaacccgggtaccccggggg

SEQ ID NO: 23170 - DNA, 740 bp, Homo sapiens
  misc_feature: GYAE6OF02I7L32.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggacgccctcactgactgtcggcccaggagggacagtcactctcacctgtgctccaacgctggacgtgtcacctctgatcaatactccctattggtatcagcagaacgctcggaccaacgacccccaagacactacgtactttcagaactaaccaaaccaaacgaacgtaacctaacgtttaccttacggaacctaccccgtcccgttaccgttttaccgaaccggtttacccgttacccggttacgggggaacctaaacggtccgttcggtaccccgttacggtaccccggttttccggggcccggtaccgccgtacggtacccgtacggtacgggtaacgtcgggaacggtacgaacggtacgttaccgtcggttcgttacccgttaccgttcccgttaccgtttttccggttttttcgttcgtttcgtcggtacgggtaccggtacgtacgtacgtccgtaccggttccgtcgtccgacgtccgaacgtccgtaccgtccccgtcgtccgtaccgttccgtcccgttaccccgtacccttcccgtaccgtaccgtacggtaccgtacgtcggtaccgg

SEQ ID NO: 23171 - DNA, 658 bp, Homo sapiens
  misc_feature: GYAE6OF02FW0OL.19.81.H04.1.454.CMB.1.raw
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatactccctattgtatcgagcagaagcctggtccaaacgcccccaagaccactgatttctgataccaaccaacagactacttccttgaccacccgcccgtcttttcacggtttacctccttgggggtacaaacgcctacgtccctcgtaccccgtttacgggccgtcggccacgtccgtgacggatcggaggacgacgtacgtacctcgttacgttccctcgttacctccgttttcggtttttttcggtcggtttccgggtcggtacgggaccgtagacgttcgaccgttccgtacggtcgtaaccgcccgaacggtcctcccgtccccgtacgtccgtcctacctttaccgttcccgttcccccgtacccgttcccgtacctaaccggttaccgtacggttacctacggtcccggg

SEQ ID NO: 23172 - DNA, 839 bp, Homo sapiens
  misc_feature: GYAE6OF02GMFKU.19.81.H04.1.454.CMB.1.raw
  modified_base (772)..(772): a, c, t, g, unknown or other
  misc_feature (772)..(772): n is a, c, g, or t
tcagtactctcgtgcacgaccggtgctcgatttagtagtgtagattcgcggggctggcaccagaggtcccttccaatatcagcaccatggcctggactcctctctttctgttcctcctcacttgctgcccagggtccaattcccaggttgtggtgactcaggagcccctcactgactgtcggccccaggagggacagtcacctcctctacgtggtcgcctaccgaacgtcgtcgggtacgttcgtacctaccgtcgtagtactactaacttaccttacccttaggttggtactacgacgacaaggtaccgccgtaccggaacccacccgaacccccgtaaacgaacccgtacgtacgttaccgtttcgtagtaaccaaaaccctaaaaccaaccggtaacgtaccttacctttaccgtaccgtaaccccgtcccccgttacccgtttacttttacccggtacccggtttacccgttccggggttaccggggaacgtaaccgtccggtacccggttaccccgttaccggttaccccggttccggggccgtacccggaccgacccggtacggtcgggaaacggttacgtacggggacgacgttaacggtaccgtcgttaccggttcccgttacccgtccgttcccgttttaccggtttttttcggtttagggtccggtccgggtacgggtacgacgtaccgtcgtacccgtaccggttcgtaccggtcaaacggtacccgacgttcccgtaccccggtcccctaccggttaccnctttaccccgtacccgtaccctaacccgtcaaccggtaggtaacggtaccgtcggtaggtaccgggg

SEQ ID NO: 23173 - DNA, 885 bp, Homo sapiens
  misc_feature: GYAE6OF02GO1I5.19.81.H04.1.454.CMB.1.raw
  modified_base (302)..(302): a, c, t, g, unknown or other
  misc_feature (302)..(302): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtcggccccaggagggacagtcactctcacctgtggctccaacgctggacgtgtccacctctgatacaatactccttagttgtactcacgcagaagccgtggacccaaccgacccccgaaagaccncgttagtactttccgagactaaccaaccaacagacctattccttacgaccctaccccgccttcgttttaccacggtttacctttccgggttaggggactaacgccgttcgcccgttacgtaccccggtttaccgggtcgaccgccgtacgtcccgtaggtagggtacgtacgggtaacggtaccggtacggtaaccgggttaccgtttaccgggtttacccggttttcccccgtttacccggtttcccgttttaacccggtttttttccggggtttttttttcggttacgggtttcccggggttaaccgggtaaccggggtaacccgtaacgggttacccggttacccggggtttaccccgttacccgggtttcccgggtttaaccgtaacccgggttaccccgggttaaaccggtacccgggtttacccccgggttacccccccgtttaaccgggttcccccttaacccgggttttacccccgtttccccgggttacccccccgtttccccccttacccgttacccggttaaccggtaccggttacccggttaaccgggttccggaccgggttacccggggg

SEQ ID NO: 23174 - DNA, 688 bp, Homo sapiens
  misc_feature: GYAE6OF02GJCCD.19.81.H04.1.454.CMB.1.raw
  modified_base (489)..(489): a, c, t, g, unknown or other
  misc_feature (489)..(489): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggacgccctcactgactgtcggccccaggagggacagtcactctcacctgtcggcctaccgaacgcgtggacgtgtccacctctgatcaaatactcccttagttggtacttcgacgtcaaggaacgccctacgggacccaaccgaccccccaaaggaccactacgtatttctagtactaaccaacccgtaacaacgactaactttccgttacgacctaccccgtcccgtcctttacgtacggtttacccgtccgttcgggggactaacgctcgccgtacggtacccgtttacgggcgtccgacgtacggctaggacggtagtcggacggngacggtacgtaccgttcgtccgttcccgtaccgtccgttaccgttttcgggttttttcgtgggttcggtacggtacgggtacgacgtacgttccgtaccgttccgtcgtaccgacgacccgaacgcctccgtacccgtccgtcgtacctccgtccgttccctccctcccgtaccgcgacgtacgtactcggcggtacgg

SEQ ID NO: 23175 - DNA, 661 bp, Homo sapiens
  misc_feature: GYAE6OF02HSX9H.19.81.H04.1.454.CMB.1.raw
  modified_base (202)..(202): a, c, t, g, unknown or other
  misc_feature (202)..(202): n is a, c, g, or t
  modified_base (253)..(253): a, c, t, g, unknown or other
  misc_feature (253)..(253): n is a, c, g, or t
  modified_base (295)..(295): a, c, t, g, unknown or other
  misc_feature (295)..(295): n is a, c, g, or t
  modified_base (326)..(326): a, c, t, g, unknown or other
  misc_feature (326)..(326): n is a, c, g, or t
  modified_base (523)..(523): a, c, t, g, unknown or other
  misc_feature (523)..(523): n is a, c, g, or t
tcagtactctcgtgcacgaccggtgctcgatttagtagtgtagattcgcgggcgtggcaccaggggtcccttccaatatcagcaccatggcctggactcctctctttctgttctcctcacttgctgccagggtcaattccaggttggtggtgactcaggagtccctcacgtgacttcggcggccccagggagggaccagtcnctcctcgaacctggtcggcctaccgaacgcctgggaccgtggtcaccttgnactacgtaattctcccttagttggtatactagcgaagagtcnggaccaacgcccaagacactgtacttcggtntataccaacctaacagaactacgttactacgtaaccgacgtcccgtcgttttacgtacggttaacccgttcggttacggggcaaacggttccgcggtacccgttacggtacccgttccggggtccggttacgccggacgaccgttggaggtacgtcgaggacgagtacgcgtagtcgtctcgtctcgttcgttttgngttcgcgtacgcgtagactcgaccttcgcgtcgtccggctacgccgtaccgcccgttaccggtcctaccgttccttacggtccccgttaccccgtccggtcctaaccggacggttacgttacgtcggactcccggggg

SEQ ID NO: 23176 - DNA, 910 bp, Homo sapiens
  misc_feature: GYAE6OF02GB5C8.19.81.H04.1.454.CMB.1.raw
tcagtactctcgtgcacgaccggtgctcgatttagtagtgtagattcgcgggctgggcaccaggggtcccttccaatagtcagcaccatggcctggactcctctctttctgttcctcctcacttgctgcccagggtccaattcccaggttgtggtgacttcgaggacgccctcactgactgtcggccccgagggtagggacaggtacgacctcgtccgaccgttcggtcggccttaccgaaccggtcgttacgggaccgttcgtccgtaaccgttcgtacggtactacgtaaacttaccgttacccgttaaacgtttcggtaaccttcgtaaaccggacggtaaacggtaaccgtccccggtacggggtaaccccaaaccccggacccccgaaaggtaaccccttacggttagttaaccgtttttacggaccggtaaacgttaacccgaaaacccgaacgtaaccggtaacctaacgtttacccgtttaccggacccctaaaccccgggttccccgtttaaccgttttaccggtaacccgggtttacccttcggggttaacgggggacctaaaggtcccgtacggtcccgttacggttaccccggttcgggcccgtaccgaccgtaccggtaccgttacgggacggtacggtacgggtaacgtaccggtaaacggtaccggttaccgtaccgggttcgttaccccgttcggttacccgttacggttttccggttttttacgggaggttccgggtaccgggtacgggtaccgtacgtaccgggttcgtaccggttccggttaccggtacggtacgtacccggtaacgggtccctaccggtcccgtacgtaccgtcggtccttccggttaccctcccgtaccgtcgacgtagtcgtacgtcggtcgtaccgg

SEQ ID NO: 23177 - DNA, 816 bp, Homo sapiens
  misc_feature: GYAE6OF02FEZ77.19.81.H04.1.454.CMB.1.raw
  modified_base (160)..(160): a, c, t, g, unknown or other
  misc_feature (160)..(160): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccaggtccaattcccaggtgtgtgactcagganccctcactgactgtcgccccaggagggacagtcactctcacctgtcgctccaacgctggaccgtgtcacctctgatcaatactcctattggtatcancagaancctcggccaactcccccgaagaccactgtactttctagaacttacaaaccaacgaacgaactacttccttagacccaacccgtcccgtaccttttacgtacggttacccgttaccgtttcgggggacctaaacggtccttacggtaccccgttcggtaaccccgttttccggggcccgtaccggtccgtaacggtcccgtaacggtaacgggtacgtaacgggacggtaccggaaccggttaacggttaacccgttacggtttaccggttccccgttacccggtttacccgtttacccgttttaccgggttttttttttcgttaccgggttttccggggtaacccggggttacgggaacccggtaacgtacccggttaccggttaacccgttcccgttaccgggttaccgacccgttaacccgaaccggtcccgttacccggtacccccgtccggtaccgtaccctttaccggttccccggtttcccccgtcccttaccccgtacccgtaacccggaacgttaccggttaacccgtcgggtacggtacccggg

SEQ ID NO: 23178 - DNA, 852 bp, Homo sapiens
  misc_feature: GYAE6OF02JKPY0.19.81.H04.1.454.CMB.1.raw
  modified_base (269)..(269): a, c, t, g, unknown or other
  misc_feature (269)..(269): n is a, c, g, or t
tcagtactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtcggccccaggagggacagtcactctcacctgtggctaccaacgctaggcgtgtcacctctgatcgaatactccctagttggtaactctacncgagtaagccgtcggtacccgaacgacccccctaaggaacctacgttgtaacttttcgtagaacttaaccaaacccaaacgtaacgaacctaactttaccgttaccgaacctacccccgtacccgttacgttttaccgtaacggtttacccgttccggttacgggggtacctaaaacggtccgtcgtccccgtaccggttacccggtttacggggccgtaccgccgtacgtcccggttaggacggtacgtacgggaccggacggtaacgtaacggttaaccgttcgggttaccgttaccccgttaccggttacccgttaaccggttttccggtttttttcgggttaggttcccggggtacgggtaaccggggtaccgtaacggtaaccgttccggtaacccggttcccgtttacgggtccgtaaccggtcccggtaaaccggtacccgtcccggttacccccgtccggtacccgtacccgtttacccggttcccggtttacccccggtcccgtttcccccgttaacccgggtaccggttaaccggtaaccgtttaccgggttaccggtacgggtaccccgggg

SEQ ID NO: 23179 - DNA, 830 bp, Homo sapiens
  misc_feature: GYAE6OF02H1Q77.19.81.H04.1.454.CMB.1.raw
tcagtactctcgtgcacgaccggtgctcgatttagtagtgtagattcgcggggctggcaccaggggtcccttcaatatcagcaccatggcctggactcctctctttctgttcctcctcacttgctgcccagggtccaattcccaggttgtggtgactcaggacgccctcactgactcggtcgcccagggaggcagtcactctacactgtgactcaacgctggacctgacctctctatatactaactactaccttagttaggtatacgacgacgaacggaacgtcgtacggacccaaacccggaaccccaaacggtaacctactacttaagttcttaacggactaaaccaacaaacgactaactaactttccgtacgaacccgtaccctccttaccgtttaccgtaacgttcccgttacgggttccggggaaacctaaacggtccgttacgtacccgttaacggttacccccgtttggggaccgtaacccgggcgacggtacccgtaggaacggtaagtccgggagggaactaacggttacgtacgttaccggttccgtttccgttaaacccggtttaccctttacggttttttcgggttttacggtacgggtttacccggggacggtaaccgggtaaacgtacggttaaccttcccgggtaacgtttccgggtaacctccggtacccgtaaaccgggtctaacccggttaccccgtcccgggttaccttaacccggtaaccctcccggtttaacccgttcccctaaaccccgttcccggttacgaacccgggaccggttaacggtttacccgtgggacccgttacggggg

SEQ ID NO: 23180 - DNA, 761 bp, Homo sapiens
  misc_feature: GYAE6OF02INCLT.19.81.H04.1.454.CMB.1.raw
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtcggccccaggagggacagtcactctcacctgtcggctccaacgctggacgtcgtcacctctgatacaatactccctattggtatcagcaagaacgcctggaccaacgaccccccaaagaccactgtactttctagtaactaaccaaacccaaacacgtactaactttccgttacgaacctacccccgtccccgttacttttaccgtaacggtttaccccttccggttacggggggtaacctaaacggtccgtacggtaccccttaccggttaccccggttttccggggaccgtccggtccgtaacggtcccgttaggaacgggtacgtacggacgggtcgaacggtacgttaccgttcggttccggttcccttcgtcccttacgtttttccggtttttggtacggtttcgggacggtacgggtacctacggtaccgtcggacccgttccgtaccggtccaccggtacccgaacgtcccgttcccggtccccgttaccggtcctacccgttcccttcccgttacccccgtacccgttcccgtacccgtaacgtaccgtaacgttacggtcggtaccgggtccggg

SEQ ID NO: 23181 - DNA, 920 bp, Homo sapiens
  misc_feature: GYAE6OF02IP2VF.19.81.H04.1.454.CMB.1.raw
tcagtactctcgtgcacgaccggtgctcgatttagtagtgtagattcgcggggctggcaccaggggtcccttccaatatcagcaccatggcctggactcctctctttctgttcctcctcacttgctgcccagggtcaacttcccaggttgtggtgactcaggacgcctcactgactgtcggcccagggacgggactacgtccactcctcaccgttggcggcctaccgaacgtcgtacgggtaacgttcgtcctacccgttactacggtaaacttactaaatttaccttacccgttaacggtttaggttaaccgttaaccgtaaggaccgtaaacgggtaaacggtccccggttaccgggacccccgtaaacccgggaccccccaaaacggtaccctaaccgttacgggttaaccttttacggacggttaaactaaacccaaaacccaaaccgtaacgtaaccttaacgttttcccgttaaccggtaccccgtaaccccggtccccgtttacgttttaccggtaaaccggtttaccccgtttacggggtacgggggtaacctaaacgtcccgttaccggacccgtttaccgggttaccccgtttcggggaccgtacccggacctcgggtacccgtaggacgggtaggtaacgggacggaccgtaacggtacggttaccgttcggttacccggtttccccgtaccgttaacccgtttccgggttttttaccggtttttacgggttccgggttacggggccgggtaagggtacccgtaggttaccgtaccggtccgttaccggtcgtaaccgaccggtacgtaccgtccgttacccgcccgttccggacctcccgtccggttacccttccccgtacccgtcccgtacgtaaccgtcgtaacgtaccgttcgggaaccgtcggg

SEQ ID NO: 23182 - DNA, 890 bp, Homo sapiens
  misc_feature: GYAE6OF02G341T.19.81.H04.1.454.CMB.1.raw
  modified_base (165)..(165): a, c, t, g, unknown or other
  misc_feature (165)..(165): n is a, c, g, or t
  modified_base (221)..(221): a, c, t, g, unknown or other
  misc_feature (221)..(221): n is a, c, g, or t
tcagtactctcgtgcacgaccggtgctcgatttagtagtgtagattcgcgggctggcaccaggggtcccttcaatatcagcaccatggcctggactcctctctttctgttcctcctcacttgctgcccagggtccaattcccaggttgttggtgactcgaggacnccctcactgactgtcggcccagggacggacacgtcactctcacgtgtgcctcacgngtggacgtgcctacctgtagactactaatactacctattcggtactcgacgtacgaggtaaacgccgttacgggaccccaaaccggaccccctaaaagtacctaaccggttagtaacttttccgtagaacttaaccgaaaccggaacaacggtacctaactttcccgttaacgaacccgtaccccgggtaccccttacgttttacggtaacccggttttacccttccggggttacggggggaacctaaaacggtccgttacggtacccccgtttacgggttaccccgtttcccgggggacgtacccgggttaccgacggttaccgtacggtaaggacgttacgggaacggacgtaccgaacggttaccgttacggttccgtttcccgtaccgttaccgtttaccggtttttccgggttttttacgtccggggtttacgggccgggtaaccggttaccgtacgggtaaaccttccgggtaacccgttccggttaccgggaccgtaacccgggtaccctaacgggtcccgttacccggtacccccgtttacgggtaccttcccgggttacccttacccggttaccccccttaccccgttttacccgaccccgggttaacggtaaccggttaacccggtttaccggtaaccgggtaccgggttaccccgggg

SEQ ID NO: 23183 - DNA, 721 bp, Homo sapiens
  misc_feature: GYAE6OF02I6L88.19.81.H04.1.454.CMB.1.raw
  modified_base (275)..(275): a, c, t, g, unknown or other
  misc_feature (275)..(275): n is a, c, g, or t
  modified_base (689)..(689): a, c, t, g, unknown or other
  misc_feature (689)..(689): n is a, c, g, or t
tcagtactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtcggcccaggagggactagtcactctacacctgtcggcctcccgaacgccgtggacgttgtcctacctcgtcgataccattacgttcctagttggtaancgtagccgaagacgcctcggaccaccgacccccaagtaccaaccgtgtactttcgtagtactaaccaacccaacaacgtaaccgtctttaccgttaccgaacccgaccccggttccttccgttttacgaccggtttaccgtaccgggtggggacctaaccgtcgtaccgtccctcggttaccccgtttggccgtaccggtcacgtccgtacggatcgtacggcgggacctaggtaccttcgttacgtcggttaccctcgttccgttacgtttttcccggttttggtccggttaacgggccggttacggacgttacgacgttccggtaaccgtccggtaccgttacgacgaccctaaggtcccgttccgcccggtcttaccgtccttccgtcccgtacccctccgttaccgtccnccggttaagaccgttacgcggtacggtaccgg

SEQ ID NO: 23184 - DNA, 240 bp, Homo sapiens
  misc_feature: GYAE6OF01C0295.24.35.D02.1.454.CMB.1.raw
  modified_base (236)..(240): a, c, t, g, unknown or other
  misc_feature (236)..(240): n is a, c, g, or t
tcagactactatgtcacgaccggtgctcgatttagcacacgatagttgggtttggggaagaggaagactgacggtcctcccaggagttcaggtgctgggcaccttggcacggggaggtgtgtcacaagatttggctctgggcaccgtggcatggggaggtgtgtcacaagatttgggctgcctggtcaaggactacttccacatagtagtctgagcgggctggcaaggcgcatagnnnnn

SEQ ID NO: 23185 - DNA, 219 bp, Homo sapiens
  misc_feature: GYAE6OF01A7I9M.24.35.D02.1.454.CMB.1.raw
  modified_base (218)..(219): a, c, t, g, unknown or other
  misc_feature (218)..(219): n is a, c, g, or t
tcagactactatgtcacgaccggtgctcgatttagcacacgatagttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnn

SEQ ID NO: 23186 - DNA, 534 bp, Homo sapiens
  misc_feature: GYAE6OF01B9LA9.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (310)..(310): a, c, t, g, unknown or other
  misc_feature (310)..(310): n is a, c, g, or t
  modified_base (371)..(371): a, c, t, g, unknown or other
  misc_feature (371)..(371): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggctcccaggctcctcatctatgatgtctccaacngggtcactggctcccgcaggttcagtgcaggtggtctgggacagacttcactctcaccgtnagcagcctagagcctgaagtatttgcggtttactactgtcagcagtcgttccgcctcggccgcttaacgtttcgggcgggggtaccagggtggaggtaggagacgaacgtgtggcgtgcacatcgtgtcttcacttccttcccgctactcgtcgaactgtacg

SEQ ID NO: 23187 - DNA, 207 bp, Homo sapiens
  misc_feature: GYAE6OF01ADIS0.24.35.D02.1.454.CMB.1.raw
  modified_base (203)..(207): a, c, t, g, unknown or other
  misc_feature (203)..(207): n is a, c, g, or t
tcagactactatgtcacgaccggtgctcgatttagcacacgatagttgggtttggggaggtgtgtcacaagatttgggctctgggcaccgtgggcgacggggaggtgtgtcacaagatttgggctctgggcacagcggcctgggctgcctggtcaaggactacttccacatagtagtctgagcgggctggcaaggcgcatagnnnnn

SEQ ID NO: 23188 - DNA, 528 bp, Homo sapiens
  misc_feature: GYAE6OF01DLA6V.24.35.D02.1.454.CMB.1.raw
  modified_base (205)..(205): a, c, t, g, unknown or other
  misc_feature (205)..(205): n is a, c, g, or t
  modified_base (445)..(445): a, c, t, g, unknown or other
  misc_feature (445)..(445): n is a, c, g, or t
  modified_base (514)..(514): a, c, t, g, unknown or other
  misc_feature (514)..(514): n is a, c, g, or t
tcagactactatgtcacgaccggtgctcgatttagcacacgatagttgggtttgggggaggaactgctcagttaggacccagacggaaccatggaagccccagccgcagcttctcttcctcctgcctactctggctcccagataccactggagaagtagtcatgacgcagtctccagccaccctgtctgtgtctccaggggaaanagccaccctcgtcctgcagggccagtgagaatgttggcagcaacttggcctggtaccagcagaaacctggccaggctcccaggctacctccgtctatcgctgtcctccaccacgggcccctggtcgtccctagccctaggttcgttggcgggttcgggtctggggacaggtatttcgactctcaccatcaggcggcctctagtctagaagatttgcactttattctgtcaacactatgtnactgctccgtactactttgcagggaccaacgtgatatacaaacgactgacggatgcacatctgttactnactcgtcccgtacc

SEQ ID NO: 23189 - DNA, 543 bp, Homo sapiens
  misc_feature: GYAE6OF01AT5UN.24.35.D02.1.454.CMB.1.raw
  modified_base (313)..(313): a, c, t, g, unknown or other
  misc_feature (313)..(313): n is a, c, g, or t
  modified_base (493)..(493): a, c, t, g, unknown or other
  misc_feature (493)..(493): n is a, c, g, or t
  modified_base (538)..(538): a, c, t, g, unknown or other
  misc_feature (538)..(538): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggcctcctcatctatgatgtcctccaacgngggtcacgtggccgtccccgcaggttcagtggcagtggtctgggacagacttcactctcaccgtcagcagcctagacgcctgaagtatttgcggtttactacgtgtcagcagtccgttccgccgtggccgtcttaacgttcgggcgggggaccaggggtggaggaggagacgaacgtggnggctgcgaccagtctgtcttcactccttcccgcctactctgaacngtacg

SEQ ID NO: 23190 - DNA, 540 bp, Homo sapiens
  misc_feature: GYAE6OF01EHVUL.24.35.D02.1.454.CMB.1.raw
  modified_base (200)..(200): a, c, t, g, unknown or other
  misc_feature (200)..(200): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
tcagactactatgtcacgaccggtgctcgatttagcacacgatagttgggtttggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgattgtctccaacgaggggtcacgtggccgtccccgcaggttcagtggcagtgggtctgggacagacttcactctcaccgtcagcagcctagacgcctagaagtattttgcggtttactactgtcagcagtccgttccgcctcggccgtcttaaccgtttcgggcgggggacccgaggggtcggagaggagacgaacgtgtggctgcacatctgtcttcactcctcccgcactntgacngtacg

SEQ ID NO: 23191 - DNA, 208 bp, Homo sapiens
  misc_feature: GYAE6OF01EDZ1U.24.35.D02.1.454.CMB.1.raw
  modified_base (204)..(208): a, c, t, g, unknown or other
  misc_feature (204)..(208): n is a, c, g, or t
tcagactactatgtcacgaccggtgctcgatttagcacacgatagttgggtttgggggaggtgtgtcacaagatttgggctctgggcaccgtgggcacggggaggtgtgtcacaagatttgggctctgggcacagcggccctgggctgcctggtcaaggactacttccacatagtagtctgagcgggctggcaaggcgcatagnnnnn

SEQ ID NO: 23192 - DNA, 545 bp, Homo sapiens
  misc_feature: GYAE6OF01ETCN3.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggcgtccccgcaggttcagtggcagtgggtctgggacagacttcactctcaccgtcagcagcctagacgcctgaagtattttgcggtttactactgtcagcagtcgttccgcctggccgtcgtaacgtttcgggcgggggaccgaggggtcggaggagggagacgaacgtggtggcgtgcgaccagtcgtgtcttcacttccttcccgccactctcgtaactgtacg

SEQ ID NO: 23193 - DNA, 130 bp, Homo sapiens
  misc_feature: GYAE6OF01D0VXI.24.35.D02.1.454.CMB.1.raw
  modified_base (130)..(130): a, c, t, g, unknown or other
  misc_feature (130)..(130): n is a, c, g, or t
tcagactactatgtcacgaccggtgctcgatttagcacacgatagttgggtttgggcacagcggccctgggctgcctggtcaaggactacttccacatagtagtctgagcgggctggcaaggcgcatagn

SEQ ID NO: 23194 - DNA, 280 bp, Homo sapiens
  misc_feature: GYAE6OF01E093E.24.35.D02.1.454.CMB.1.raw
  modified_base (259)..(280): a, c, t, g, unknown or other
  misc_feature (259)..(280): n is a, c, g, or t
tcagactactatgtcacgaccggtgctcgatttagcacacgatagttgggtttggggaagaggaagactgacggtcctcccaggagttcaggtgctgggcaccttgggcacggggaggtgtgtcacaagatttggctctgggcaccgtggcatggggaggtgtgtcacaagatttgggctctgggcacagcggcctgggctgcctggtcaaggactacttccacatagtagtctgagccgggctggcaaggcgcatagnnnnnnnnnnnnnnnnnnnnnn

SEQ ID NO: 23195 - DNA, 528 bp, Homo sapiens
  misc_feature: GYAE6OF01AWPNB.24.35.D02.1.454.CMB.1.raw
  modified_base (522)..(522): a, c, t, g, unknown or other
  misc_feature (522)..(522): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagatttcactctcaccatcagcggcctccagtctgagtatttgctactttattctgtcaactactatggtgactggtcctccgtactactttcggcctagggacctaacgtggagtatacaaacgactgtggctgcacatcttgtcttcacttccttcccgcctntctacg

SEQ ID NO: 23196 - DNA, 535 bp, Homo sapiens
  misc_feature: GYAE6OF01CJFOB.24.35.D02.1.454.CMB.1.raw
  modified_base (261)..(261): a, c, t, g, unknown or other
  misc_feature (261)..(261): n is a, c, g, or t
  modified_base (308)..(308): a, c, t, g, unknown or other
  misc_feature (308)..(308): n is a, c, g, or t
  modified_base (369)..(369): a, c, t, g, unknown or other
  misc_feature (369)..(369): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccaggggagagagccaccctctcctgcagggccagccggagtgttagtaagtacttaggctggtaccaanagaaacctggccaggctccaggctcctcatctatgatgtctccaacngggtcactggctcccgcaggttcagtgcagtgggtctgggacagacttcactctcaccgtnagcagcctagagtcctgaagtattttgcggtttactacttgtcagcagtcgttccgcctggccgtctaacgtttcgggcgggggaccgaggggtggaggaggagacgaacgtggtggcgtgcaccagtctgttcttcacttccttcccgctactctgaactagtag

SEQ ID NO: 23197 - DNA, 616 bp, Homo sapiens
  misc_feature: GYAE6OF01BJLIB.24.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (392)..(392): a, c, t, g, unknown or other
  misc_feature (392)..(392): n is a, c, g, or t
tcagactactatgtcacgaccggtgctcgatttagcacacgatagttgggtttgggggaggaactagctcagttaggacccagagggaaccatggaagcccagctcagcttctcttcctcctgctactctggctcccagagaccaccggagaaattgtgttgacacagtctccaggcaccctgtctttgtctccagggganagagccacctctcctgcagggccagccggagtgttagtaagtacttaggctggtaccaanagaaacctggccaggctccaggctcctcatctatgatgtcctaccaacagggtcactgggcctccccgactaggttccaggtggacaggtgggctgggacaggacttcactctcaccgtcagcagcctagncctagaagtatttgacggtttactactgtcagcagtccgttccgccgtaggccgtacttaacggtttccgggacggggggtaaccaggggttcgggaagtacgggacgtaacggaacgtggtacgggcgtacgaccgtaaccgtacttcgttacggttccttacctacgtttccccgttaccccggtacccttacgttacctacggtaaaccgtagttaaacgg

SEQ ID NO: 23198 - DNA, 519 bp, Homo sapiens
  misc_feature: GYAE6OF01BBNCI.24.35.D02.1.454.CMB.1.raw
  modified_base (261)..(261): a, c, t, g, unknown or other
  misc_feature (261)..(261): n is a, c, g, or t
  modified_base (515)..(515): a, c, t, g, unknown or other
  misc_feature (515)..(515): n is a, c, g, or t
tcagactactatgtcacgaccggtgctcgatttagcacacgatagttgggtttggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaanagaaacctggccaggctcccaggctcctcatctatgatgtctccaacagggtcactggcgtcccgcaggttcagtggcagtgggtctgggacagacttcactctcaccgtcagcagcctagagcctgaagtattttgcggtttactactgtcagcagcgttccgctggccgctaacgtttcgggcggggaccaggggtggagaggagacgaacgtgtggctgcacagtctgtcttcatctcccgcatctgactntacg

SEQ ID NO: 23199 - DNA, 523 bp, Homo sapiens
  misc_feature: GYAE6OF01CDKWP.24.35.D02.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (491)..(491): a, c, t, g, unknown or other
  misc_feature (491)..(491): n is a, c, g, or t
  modified_base (520)..(520): a, c, t, g, unknown or other
  misc_feature (520)..(520): n is a, c, g, or t
tcagactactatgtcacgaccggtgctcgatttagcacacgatagttgggtttggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggctcccaggctcctcatctatgatgtctccaacagggtcactggcgtcccgcaggttcagtggcagtgggtctgggacagacttcactctcaccgtcagcagcctagagcctgaagtatttgtcggtttactactgtcagcagcgttccgcctggccgcttaacgtttcgggcggggaccgaggggtggagaggagacgaacgtgtggctgcaccngtctgtcttcatcttcccgcactctgacntag

SEQ ID NO: 23200 - DNA, 502 bp, Homo sapiens
  misc_feature: GYAE6OF01BHPXD.24.35.D02.1.454.CMB.1.raw
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (297)..(298): a, c, t, g, unknown or other
  misc_feature (297)..(298): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
tcagactactatgtcacgaccggtgctcgatttagcacacgatagttgggtttggggggaagaggaagactgacggtcctcccaggagttcaggtgctgggcaccttgggccacggggaggtgtgtcacgaagactttggctctggcaccgtggcagtggggaggtgtgtcacaagactttgggctctgggcacagcgcctgggctgcctggtcaaggactacttccacatagtagtctgagcgggctaggcaaggcgctagtaggntanctgctcngcagacncaggctcnccgtnnatntngntcactagagtcgctgcgtcagngtcgtntgngngntagtcgtgngacgacactcncnctcncnctcncgcgcncgcgcncgcnctcgtcgtctactactactatctcgcgtactacgtacgtacgcgtacgtacgacgtacgtcgtcgtacgtacgtcgtcgagacgtcgacgtagtcgtcgtcgtagctcgtgtcg

SEQ ID NO: 23201 - DNA, 524 bp, Homo sapiens
  misc_feature: GYAE6OF01AWYLV.24.35.D02.1.454.CMB.1.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
  modified_base (428)..(428): a, c, t, g, unknown or other
  misc_feature (428)..(428): n is a, c, g, or t
  modified_base (501)..(501): a, c, t, g, unknown or other
  misc_feature (501)..(501): n is a, c, g, or t
  modified_base (522)..(522): a, c, t, g, unknown or other
  misc_feature (522)..(522): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccagccaccctgtctgtgtctccaggggaaangccaccctctcctgcagggccagtgagaatgtggcagcaacttagcctggtaccagcagaaacctggccaggctcccaggctcctcctctatgctgtcctccaccagggcccctggtcgtcccagccaggttcgtggcggtgggtctgggacngatttcactctcaccatcagcgcctcagtctgagtatttgctactttatttctgtactaactacttatggtntactggtcctccgtactctttcggccaggggtaccaaagtcggatacgtacaaacgtactgtggctcgcactntctgtctcactcttcccgctntc

SEQ ID NO: 23202 - DNA, 555 bp, Homo sapiens
  misc_feature: GYAE6OF01AI3RU.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggccgtccccgcaggttcagtggcaggtgggctgggacagacttcactctcacgtcagcagctagagcctgaagtatttgactactttattcttagtactaactactagtggtgtacgtcggtcctccgtactacgttttcggaccgtacgggaacctaaacgtggaacgtagtacgaaacgtactgtacggctgctacatctacgttcttactacttccttcccgctgtcgtaacg

SEQ ID NO: 23203 - DNA, 706 bp, Homo sapiens
  misc_feature: GYAE6OF01CJPGZ.24.35.D02.1.454.CMB.1.raw
  modified_base (275)..(275): a, c, t, g, unknown or other
  misc_feature (275)..(275): n is a, c, g, or t
  modified_base (327)..(327): a, c, t, g, unknown or other
  misc_feature (327)..(327): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtctttgtctccgaggggagagacgccaccctctcctgccacggggccaggccgggagttggttaagtaagtacttaggcttggtaaccaanagaaacctggccaggcctccgaggcctcctcatctatgatcgtctaccaagngggtcacgtcggcccgtccccgcgtaggttccaggtcggacgaggtcgggtctgggaacaggtaccttcgacttcgtaccgaccgtcacgtcaacggtcctaaggacgtcccgtaggtaacgttagttttcggtacggttttaactacgttcgtacgacgtcgtacgtccggtttcccgccgtcgggtcccgttaccgttaaccggtttccgggggaccggggggtaaccgtagggggtacgggtagggacgggacggtaacggtaacggtgggtcgggccgtcggaccgtaaccgtacgttccggttacgtttccctttacgtaccttcccgtttaccccgacttaaccgttccgtaacgtaaacgtagtttaacggg

SEQ ID NO: 23204 - DNA, 246 bp, Homo sapiens
  misc_feature: GYAE6OF01BYYHX.24.35.D02.1.454.CMB.1.raw
  modified_base (208)..(208): a, c, t, g, unknown or other
  misc_feature (208)..(208): n is a, c, g, or t
  modified_base (242)..(246): a, c, t, g, unknown or other
  misc_feature (242)..(246): n is a, c, g, or t
tcagactactatgtcacgaccggtgctcgatttagcacacgatagttgggtttgggggaagaggaagactgacggtcctcccaggagttcaggtgctgggcaccttgggcacggggaggtgtgtcacaagatttgggctctgggcaccgtgggcagtgggggaggtgtgtcacaagatttgggctgcctggtcaaggactacttccanatagtagtctgagcgggctggcaaggcgcatagnnnnn

SEQ ID NO: 23205 - DNA, 269 bp, Homo sapiens
  misc_feature: GYAE6OF01E1FOZ.24.35.D02.1.454.CMB.1.raw
  modified_base (238)..(238): a, c, t, g, unknown or other
  misc_feature (238)..(238): n is a, c, g, or t
  modified_base (244)..(269): a, c, t, g, unknown or other
  misc_feature (244)..(269): n is a, c, g, or t
tcagactactatgtcacgaccggtgctcgatttagcacacgatagttgggtttgggggaagggaggaagactgacggtcctcccaggagttcaggtgctgggcaccttgggcacggggaggtgtgtcacaagatttgggctctgggcaccgtgggcatgggggaggtgtgtcacaagatttgggctgcctggtcaaggactacttccacatacgtagtctgagcgggctggcaaggcncatagnnnnnnnnnnnnnnnnnnnnnnnnnn

SEQ ID NO: 23206 - DNA, 570 bp, Homo sapiens
  misc_feature: GYAE6OF01CUCOC.24.35.D02.1.454.CMB.1.raw
  modified_base (311)..(311): a, c, t, g, unknown or other
  misc_feature (311)..(311): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggcctcccaggctcctcatctatgatgtctccaacngggtcacgtggccgtcccgcaggttcagtggcaggtgggtctggacagacttcactctcaccgtcagcagcctagacgctagaagtagtttgtcgtttactactgtcagcagtcgttccgccgtcggccgtcttaccgtttccgggcgggggaccgtaggggtggaggagggagacgtaacgtggtcggcgtgccaccgagttccgtgttcttccacgttcccgttcccgtcctacttcctacgtaacgtagttaacgg

SEQ ID NO: 23207 - DNA, 220 bp, Homo sapiens
  misc_feature: GYAE6OF01D1IU6.24.35.D02.1.454.CMB.1.raw
  modified_base (219)..(220): a, c, t, g, unknown or other
  misc_feature (219)..(220): n is a, c, g, or t
tcagactactatgtcacgaccggtgctcgatttagcacacgatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnn

SEQ ID NO: 23208 - DNA, 583 bp, Homo sapiens
  misc_feature: GYAE6OF01EQ7U1.24.35.D02.1.454.CMB.1.raw
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgccagggccaggccggagttgttaagtaagtacttaggctggtaccaacagaaacctggccaggctcccaggctcctcatctatgatgtctccaacagggtcacgtggccgtccccgcgtaggttcaggtggcagtgggtcnggacagacttcactcncaccgtcagcagcctagcgtcctgaagtattttgcggttttactcgtgtcagcagtcgttccgccgttcggcccgtacgttaacgtttcgggccggggggaccgaggggtcggaggagggacgaacggtaacgtggtggcctggaccaccgtagttcgtgttccttcacttccttccccgtacctacttctacgaactagttaacg

SEQ ID NO: 23209 - DNA, 542 bp, Homo sapiens
  misc_feature: GYAE6OF01ELAYB.24.35.D02.1.454.CMB.1.raw
  modified_base (385)..(385): a, c, t, g, unknown or other
  misc_feature (385)..(385): n is a, c, g, or t
  modified_base (531)..(531): a, c, t, g, unknown or other
  misc_feature (531)..(531): n is a, c, g, or t
  modified_base (536)..(536): a, c, t, g, unknown or other
  misc_feature (536)..(536): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacaggggtcactggcgtccccgccaggttcagtggcagtgggtctgggacaggacttcactctcaccgtcgaaaaacngcctagagcctgaagtattttgcggttttactacttgtcagcagcgttccgcctggccgctaacgtttcgggcggggggaccaggggtgggagagggagacgaacgtgtggctggcaccagtctgtcttcatccttcccgcactcngaacngtaacg

SEQ ID NO: 23210 - DNA, 522 bp, Homo sapiens
  misc_feature: GYAE6OF01BPX94.24.35.D02.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccagccggagtgttagtaagtacttaggctggtaccaanagaaacctggccaggctcccaggctcctcatctatgatgtctccaacagggtcactggcctcccgcaggttcagtggcagtgggtctgggacagacttcactctcacgtcagcagcctagacgcctagagtattttgacggtttactacgtgtcagcagtcgttccgcctggccgtcgttaacgttcgggcgggggacagggtggagaggagacgaagtgtggctgcacatctgtctcactctccgcatctnacngtag

SEQ ID NO: 23211 - DNA, 622 bp, Homo sapiens
  misc_feature: GYAE6OF01AQK6I.24.35.D02.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
tcagactactatgtcacgaccggtgctcgatttagcacacgatagttgggtttgggggaggaactgctcagttaggacccagagggaaccatggaagccccagctcagcttctcttcctcctgcctactctggctcccagagaccaccggagaaattgtgttgacacgagtctccaggcaccctgtctttgctccagggganagacgccacccgtctcctgcagggccagccggagtgttagtaagtacttaggctggtaccaanagaaacctggccaggctcccaggctcctcatctatgatcgtcctccaacagggtcactggcctcccgcaggttcagtcggcaggtgggtctgggacagtacttcactctcaccgtcagcacgcctagacgtccctagaacgtattttcggacggttttacgtacgttcgtcagctagtccgttccgcctcgggtccgtcgttaacgtttccgggacggggggtaccgaggggtcggagtacgggacgacggtaacgtggtacggtcgtggtaccgaccgtagttccgttacgttccgttccgtacgttcccgttaccccgtaccctacttacccgtacggtaaacctacgttaacgg

SEQ ID NO: 23212 - DNA, 543 bp, Homo sapiens
  misc_feature: GYAE6OF01CBD64.24.35.D02.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacngggtcacgtggccgtccccgcaggttcagtggcaggtgggtctgggacagacttcactctcaccgtcagcagcctagacgcctgaagtattttgcgtttactactgtcagcagtcgttccgccgtcggcccgtcttaacgtttcgggcgggggaccaggggtggaggaggagacgaacgtggtggctgcacagtcgtgtcttcacttccttcccgctactctcgaactgtacg

SEQ ID NO: 23213 - DNA, 513 bp, Homo sapiens
  misc_feature: GYAE6OF01BTJZF.24.35.D02.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (326)..(326): a, c, t, g, unknown or other
  misc_feature (326)..(326): n is a, c, g, or t
tcagactactatgtcacgaccggtgctcgatttagcacacgatagttgggtttggggaggaactgctcagttaggacccagagggaaccatggaagccccagctcagcttctcttcctcctgctactctggctcccagataccactggagaaatagtgatgacgcagtctccagccaccctgtctgtgtctccaggggaaanagccaccctntcctgcagggccagtcagagtataagaagcaactacttagcctggtatcaacagaaacctggccaggcctcccaggcctcctcatctatggtatatccagcagggccactggtntcccagccaggttcagtggcaggtgggtctgggacagagttcactctcacctatcagcagtctgcagtctagaagtattttgctagtttattactgtccagcagcacagtgacgtggcctctcgtcgtttcggccggagggaccgaaggtggagagtacaaacgaacgtggtcggatcgcgacgtac

SEQ ID NO: 23214 - DNA, 533 bp, Homo sapiens
  misc_feature: GYAE6OF01A4M4H.24.35.D02.1.454.CMB.1.raw
  modified_base (201)..(201): a, c, t, g, unknown or other
  misc_feature (201)..(201): n is a, c, g, or t
  modified_base (377)..(377): a, c, t, g, unknown or other
  misc_feature (377)..(377): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagtgacaatgttaggaagttgttagcctggtatcaacacaaacatggccaggcctccccggctcctcatctatgatgcatccaatcgggccactggacatcccagacaggttcagtgcaggtgggtctgggacagacttcactctcaccgtnagcagcctagacgctgaagtatttgtcgtttactactgtcagtcacgtcgttccgccttcggcccgtcttaacgtttccgggacgggggtaccgaggggtggagaggaggacgaacgtggtggctggacacgatcgtgtcttcatcttcccgctcg

SEQ ID NO: 23215 - DNA, 590 bp, Homo sapiens
  misc_feature: GYAE6OF01AIA89.24.35.D02.1.454.CMB.1.raw
  modified_base (200)..(200): a, c, t, g, unknown or other
  misc_feature (200)..(200): n is a, c, g, or t
  modified_base (309)..(309): a, c, t, g, unknown or other
  misc_feature (309)..(309): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccagggganagagcccacctctcctgcagggccagccggagtgttagtaagtacttaggctggtaccaacagaaacctggccaggctcccaggctcctcatctatgatgtctccaacngggtcacgtggcctccccgcaggttcaggtcggcaggtcgggtctgggacagacttcactctcaccgtcagcagcctagacgtcctagaagtattttgacggtttactacgtgtcagtcagtccgttccgcgtcggcccgtacgttacgtttcggggccggggtacaggggtggaggacggagacggtacgtggtcggcgtcgcgaccgtacgttcgtcggttccttccgtacgttcccgttccccggtacctacttaccgtacgtaaaccgtgttaacgg

SEQ ID NO: 23216 - DNA, 248 bp, Homo sapiens
  misc_feature: GYAE6OF01BNZ4T.24.35.D02.1.454.CMB.1.raw
  modified_base (243)..(248): a, c, t, g, unknown or other
  misc_feature (243)..(248): n is a, c, g, or t
tcagactactatgtcacgaccggtgctcgatttagcacacgatagttgggtttgggggaagaggaagactgacggtcctcccaggagttcaggtgctgggcaccttgggcacgggggaggtgtgtcacaagatttgggctctgggcaccgtgggcagtgggggaggtgtgtcacaagatttgggctgcctggtcaaggactacttccacatagtagtctgagcgggctggcaaggcgcatagnnnnnn

SEQ ID NO: 23217 - DNA, 679 bp, Homo sapiens
  misc_feature: GYAE6OF01EAF62.24.35.D02.1.454.CMB.1.raw
  modified_base (201)..(201): a, c, t, g, unknown or other
  misc_feature (201)..(201): n is a, c, g, or t
  modified_base (314)..(314): a, c, t, g, unknown or other
  misc_feature (314)..(314): n is a, c, g, or t
  modified_base (387)..(387): a, c, t, g, unknown or other
  misc_feature (387)..(387): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgagttgacacagtctccaggcaccctgtctttgctccgagggganagagcccaccctctcctgcgagggccaggccggagtgttaagaagtacttaggctggtaccaacagaacctggccaggctcccaggctcctcatctatgatcgtctccaacgngggtcacgtcggccgtccccgctaggttcaggtggctaggtgggtctgggacagtacttcactctcgaccgtnacgcacgtcctagacgtcctagaacgttagttttacggtacggttttaactacgttcgtacgacgtcgtacggtccgtttcccgccggttcgggcccgtaccgtttaaccggtttccgggggacggggggtaacccgtaaggggtacgggacgtacgttaccgaacgtaaccggtaacgttcgggtacggtaccgtcggaccgtaacccgtacgttccgttacggttccctttaccgtacgttttccccgttcccccgtaccttacttcccgttaacggtaacgttaaacgg

SEQ ID NO: 23218 - DNA, 531 bp, Homo sapiens
  misc_feature: GYAE6OF01BXUT2.24.35.D02.1.454.CMB.1.raw
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaagctcccaggctcctcatctatgatgtctccaacagggtcactggccgtccccgcaggttcagtggcagtggtctgggacagacttcactctcaccgtcagcagcctagacgcctgaagtattttgcggtttactactgtcagcagtcgttccgccgtggcccgtcttaacgtttcgggcgggggaccgaggggtggaggaggagacgaacgtggtggctgcacagtctgtcttcatcttcccgcatctnacntag

SEQ ID NO: 23219 - DNA, 663 bp, Homo sapiens
  misc_feature: GYAE6OF01CPWY4.24.35.D02.1.454.CMB.1.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (314)..(314): a, c, t, g, unknown or other
  misc_feature (314)..(314): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccgagggganagacgccaccctctcctgcagggccagccggagtgttagtaagtacttaggctggtaaccaanagaaacctggccaggctcccgaggctcctcatctatgatgtctaccaacngggtcacgtcggccgtccccgctaggttccaggtcggctaggtgggtcctagggacaggtacttcgactctcaccggtcagcaggcctaagacgtcctagaagtattttgtacggtttactacttgtcaagtcgacgtccgttccgcccgtcggcccgtacgttaacggtttccggggaccggggggtaaccgagggggttacgggaacgggtaggggaacggaacggtaaccggtgggtacgggcgttcggaccgtaccgtaacgttaccgttcgttaccgtttcctaacgttccccgtttccccggacccttaacttaccgtttaacgaaaccgttaagttaacggg

SEQ ID NO: 23220 - DNA, 522 bp, Homo sapiens
  misc_feature: GYAE6OF01C4PNJ.24.35.D02.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (519)..(519): a, c, t, g, unknown or other
  misc_feature (519)..(519): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggcctcctcatctatgatgtctccaangggtcactggccgtcccgcaggttcagtggcagtggtctgggacagacttcactctcaccgtcagcagcctagagtcctgaagtattttgcggtttactactgtcagcagcgttccgccgtggccgtcttaaccgtttcgggcgggggaccaggggtggagaggagacgaacgtgtggctgcacntcngtctcatctccgcatctgacntag

SEQ ID NO: 23221 - DNA, 653 bp, Homo sapiens
  misc_feature: GYAE6OF01C7292.24.35.D02.1.454.CMB.1.raw
  modified_base (260)..(260): a, c, t, g, unknown or other
  misc_feature (260)..(260): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtcttgtctcgaggggagagagccaccctctcctgcagggccagccggagtgttagtaagtcttaggctaggtaccaanagaaacctggccaggctcccaggctcctcatctatgattcgtctccgaaacgagggtccacgtcgggccgtccccgcaagggtttccaggtggaccaggtgggtcngggaacagacttcactcncacgtnagcagcctaagcgcctagaagtattttggtacgtttactacgttgtcacgtctacggtcgttaccgccgtcggtcccgtacgttaacgtttccgggggacgggggtaaccgtagggggtgggaacggtagggaacggtaccggtaacggtcggtacgggtccttgggaccctaaccgtaacgttccgttcggttaccctttcgtaacttccccgtttacccccgtaccgttacttaccgtacgtaaaccgtaggtttaaacgg

SEQ ID NO: 23222 - DNA, 222 bp, Homo sapiens
  misc_feature: GYAE6OF01DKQEW.24.35.D02.1.454.CMB.1.raw
  modified_base (219)..(222): a, c, t, g, unknown or other
  misc_feature (219)..(222): n is a, c, g, or t
tcagactactatgtcacgaccggtgctcgatttagcacacgatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnn

SEQ ID NO: 23223 - DNA, 249 bp, Homo sapiens
  misc_feature: GYAE6OF01DV9XJ.24.35.D02.1.454.CMB.1.raw
  modified_base (241)..(249): a, c, t, g, unknown or other
  misc_feature (241)..(249): n is a, c, g, or t
tcagactactatgtcacgaccggtgctcgatttagcacacgatagttgggtttgggggaagaggaagactgacggtcctcccaggagttcaggtgctgggcaccttgggcacgggggaggtgtgtcacaagatttgggctctgggcaccggtgggcatgggggagtgtgtcacaagatttgggctgcctggtcaaggctacttccacatagtagtctgagcgggctggcaaggcgcatagnnnnnnnnn

SEQ ID NO: 23224 - DNA, 581 bp, Homo sapiens
  misc_feature: GYAE6OF01BHO0Q.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccagccggagtgttagtaagtacttaggctggtaccaacagaaacctggccaggctcccaggctcctcatctatgatgtctccaacagggtcacgtggccgtccccgctaggttcaggtggcaggtgggtctgggacagacttcactctcaccgtcagcagcctagactcctagaagtagttttgtcggtttactacttgtcagcagtccgttccgccgtggcccgtcgttaacgttcgggcgggggaccgtaggggtggaggagggacggacgtaacgtggtcggtcgtcgcaccgtagttcgttgttccttcacttcccgttacccgtcctacttcctcgtaacgtagttaacgg

SEQ ID NO: 23225 - DNA, 1013 bp, Homo sapiens
  misc_feature: GYAE6OF01CIARY.24.35.D02.1.454.CMB.1.raw
tcagactactatgtcacgaccggtgctcgatttagcacacgatagttgggtttgggggaggaactgctcagttaggacccagagggaaccatggaacgccccagctcagcttctcttcctcctgctactctggcctccagagacccaccggaagaaattgagttgacacagtctccaggccaccctgttctttgtctccgaggggagagacgcccaccctctcctgcgagggccagtgaagaattggttggacagacctaacgtttacgccgttagggtaaccaggaccaaacggtaaaacccgtgggacccgaacgggtcccttacccggaacggtccccttaccccttccccttacttaacgttccggtccgtttcggttaccccttaccccgaaccccggtacccgggggtccccccgtttggggtcccgttacccccgaacgggtaccccggttaacgggggtttttcccgggtttcgggggtccggggtttcggggggttcccgttacgggggggaaacccttaacggggtttaacttttttacccgaaccgtttcccgttacccgaaacccttacgttacccggaaccgggtccccgggtcccctttacccggtaacggtttaccgttaacgggtaaaccggtttacgttttttacggtacccttttaaccgttttttttaaacgtttttccgtttaacggttaaccccttaaaccgttaaccgtttaacggtttacgggttaccgttaccggtttacccgggtacccccgttttaaccccggttaaccgttttaacccggttttttaccggggaccccgggtaaaacggggggtaaccccgttaaaaccgggttacggggtaaccggtaaccgttaaacccggtaaaaccggttaacgttacggggttacgggtacccgttcggtacccgtaaaccgtacgtttaccgttacgtttacctttacccttaccgtttccccgtttacccccgtccttaacgttacccg

SEQ ID NO: 23226 - DNA, 536 bp, Homo sapiens
  misc_feature: GYAE6OF01BIBQL.24.35.D02.1.454.CMB.1.raw
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
  modified_base (487)..(487): a, c, t, g, unknown or other
  misc_feature (487)..(487): n is a, c, g, or t
  modified_base (496)..(496): a, c, t, g, unknown or other
  misc_feature (496)..(496): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacngggtcacgtggccgtccccgcaggttcagtcggcaggtgggtctggacngacttcactctcacgtcagcagcctagacncctgaagtntttgcggtttactactgtcagcagtcgttccgcctcggccgtcttaacgttcgggcgggggaccgagggtggaggaggagacgagtggngcgtgcacngtctgtcttcacttccttcccgctactctacgactgtacg

SEQ ID NO: 23227 - DNA, 545 bp, Homo sapiens
  misc_feature: GYAE6OF01CF3FZ.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
  modified_base (494)..(494): a, c, t, g, unknown or other
  misc_feature (494)..(494): n is a, c, g, or t
  modified_base (516)..(516): a, c, t, g, unknown or other
  misc_feature (516)..(516): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagacgccaccctctcctgcagggccagccggagtgttagaagtcttaggctggtaaccaanagaaacctggccaggctccaggctcctcatctatgatgtctccaacngggtcacgtggccgtcccgcaggttcagtggcaggtggctgggacagacttcactctcaccgtcagcagccctagacgcctgaagtattttgcggttttactacgttgtcagcacgtccgttccgcctggcccgtcttaacgtttccgggcgggggaccaggggtggaggaggagacgaacgtgnggctgccacagtcgtgttcttnacttccttcccgccatctagaactgtacg

SEQ ID NO: 23228 - DNA, 546 bp, Homo sapiens
  misc_feature: GYAE6OF01EBL1V.24.35.D02.1.454.CMB.1.raw
  modified_base (319)..(319): a, c, t, g, unknown or other
  misc_feature (319)..(319): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (516)..(516): a, c, t, g, unknown or other
  misc_feature (516)..(516): n is a, c, g, or t
  modified_base (536)..(536): a, c, t, g, unknown or other
  misc_feature (536)..(536): n is a, c, g, or t
  modified_base (539)..(539): a, c, t, g, unknown or other
  misc_feature (539)..(539): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcacccttgtcttttgtctccgaggggagagacgccaccctctcctgcagggccaggccggagtgttagtaagtacttaggctggtaaccaagagaaacctggccaggcctcccgaggcctcctcatctatgatgtctccaagngggtcacgtcggccgtccccgctaggttcaggtggcaggtgggtctgggacagtatttcactctcaccatcgacgcggtcctcgagtctgtaagtnttttgcttacttttnttctgtacaactattagtggtgactcgtcctccgtatcgtttggaccgagggtaccaagtgagtatacaagactggtgactgcacntctgtctactcttcctcccnctntctaacg

SEQ ID NO: 23229 - DNA, 248 bp, Homo sapiens
  misc_feature: GYAE6OF01CCTCW.24.35.D02.1.454.CMB.1.raw
  modified_base (241)..(248): a, c, t, g, unknown or other
  misc_feature (241)..(248): n is a, c, g, or t
tcagactactatgtcacgaccggtgctcgatttagcacacgatagttgggtttgggggaagaggaagactgacggtcctcccaggagttcaggtgctgggcaccttgggcacggggaggtgtgtcacaagatttgggctctgggcaccgtgggcatgggggaggtgtgtcacaagatttgggctgcctggtcaaggactacttccacatagtagtctgagcgggctggcaaggcgcatagnnnnnnnn

SEQ ID NO: 23230 - DNA, 670 bp, Homo sapiens
  misc_feature: GYAE6OF01ESPRB.24.35.D02.1.454.CMB.1.raw
  modified_base (201)..(201): a, c, t, g, unknown or other
  misc_feature (201)..(201): n is a, c, g, or t
  modified_base (320)..(320): a, c, t, g, unknown or other
  misc_feature (320)..(320): n is a, c, g, or t
  modified_base (391)..(391): a, c, t, g, unknown or other
  misc_feature (391)..(391): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccgagggganagagccaccctctcctgcaggaccagccggagtgttagtaagtacgttaggctaggtaccaacgagaaacctggccaggcctcccgaggcctcctcatctatgattcgtctaccaacgngggtccacgtcggcccgtccccgctaggttcagtggcaggtgggtctgggacagacttcactctcaccgtnacgcagcctagacgtcctagtaagttacgttttcggtacggttttaactacgttcgtacgtacgtcctacgtccgttccgtccgtcggtacccgtacgttaaccgggtttccggggaccggggggtaccgtagggggtacggaacgggtagggacgtaacggtaacgtcgggtcggtccgtacggaccgtaaccgtacgttcgttcgttacctttacgaccgtttccccgttaccccgtaccttacgttaccgttaacgtaaaccgtaaggttaaccgg

SEQ ID NO: 23231 - DNA, 671 bp, Homo sapiens
  misc_feature: GYAE6OF01BLJQW.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggcctcccaggcctcctcatctatgatcgtctaccaacagggtcacgtggcctcccgcaggttcagtggcaggtggtctgggacagacttcactctcaccgtcagcagccctagacgtcccgtagaagttacgttttacggtcggttttaactacgttgttacgaagtccgtaacgtccggtttcccgtcccgttcgggtaccccgttaccgttaaccggttttccggggaccgggggggtaacccgtagggggttacgggacgggtaacggggaacggtaacggtaaccgttgggtacgggccgtacggacccgtaaccgtacgttccgttcggttccttttccaccgtttcccttacccccggtcctacgttacctacgtaacgtagttaacgg

SEQ ID NO: 23232 - DNA, 535 bp, Homo sapiens
  misc_feature: GYAE6OF01CTJ17.24.35.D02.1.454.CMB.1.raw
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcacgtggccgtcccgcaggttcagtggcagtgggtctgggacagacttcactctcaccgtnagcagcctagagcctagaagtnttttgcggttttactacttgtcagcagcgttccgcctggccgtcttaacgtttcgggcgggggaccgaggggtggagaggagacgaagtgtggctgcacatcgtgtcttcattccttcccgctatctacgaactgtag

SEQ ID NO: 23233 - DNA, 548 bp, Homo sapiens
  misc_feature: GYAE6OF01E0M22.24.35.D02.1.454.CMB.1.raw
  modified_base (337)..(337): a, c, t, g, unknown or other
  misc_feature (337)..(337): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagcagcagctacttagcctggtaccagcagaaacctggcctggctcccaggctcctcatctatggtgccgtccaccgagggccacgtggcgtcgcggacnggttcagtgcagtggcttgggacagactcactctcatcatcgacagactggacgcccgaagtagtttgcgtagtgtacttactgtcagtcttcgtttcggtcccttcgtccttccttattcgtacttactttcggccgtacgggttccgtaggtcgtaggtacgtacgtacgaaggtcgaacgtgtcggtcgtcgtaccacctgtcgttcg

SEQ ID NO: 23234 - DNA, 546 bp, Homo sapiens
  misc_feature: GYAE6OF01AT0N3.24.35.D02.1.454.CMB.1.raw
  modified_base (376)..(376): a, c, t, g, unknown or other
  misc_feature (376)..(376): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacgagggtcacgtggccgtccccgcaggttcagtggcagtgggtctggacagacttcactctcaccgtnagcagcctagagcctgaagtatttgcggtttactactgtcagcagcgttcgccgtggccgtcgtacgtttcgggcgggggacgagggtggaggaggacgacgaacgtggtaggcgtgcgtacgagtcgtgtcttcacgttccttcccgcctatctacgtaactgttaacg

SEQ ID NO: 23235 - DNA, 537 bp, Homo sapiens
  misc_feature: GYAE6OF01C4AJ8.24.35.D02.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (499)..(499): a, c, t, g, unknown or other
  misc_feature (499)..(499): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggnagagccaccctctcctgcagggccagccggagtgttagtaagtacttaggctggtaccaacagaaacctggccaggcctccaggcctcctnatctatgatgtctccaangggtcactggcctcccgctaggttcagtgcaggtggtctggacagacttcactctcaccgtnagcagcctagcgtcctgaagtntttgcgtttactactgtcagcagtcgttccgctcggccgtacttaaccgtttcgggcgggggacctaggggtcggagacggagacggaacgtgtaggctgcacgtntctgtcttccattccttcccgcactctacgactgtacg

SEQ ID NO: 23236 - DNA, 254 bp, Homo sapiens
  misc_feature: GYAE6OF01A53MG.24.35.D02.1.454.CMB.1.raw
  modified_base (242)..(254): a, c, t, g, unknown or other
  misc_feature (242)..(254): n is a, c, g, or t
tcagactactatgtcacgaccggtgctcgatttagcacacgatagttggggtttgggggaagaggaagactgacggtcctcccaggagttcaggtgctgggcaccttgggcacgggggaggtgtgtcacaagatttgggctctgggcaccgtgggcagtgggggagtgtgtcacaagatttgggctgcctggtcaaggctacttccacatagtagtctgagcgggctggcaaggcgcatagnnnnnnnnnnnnn

SEQ ID NO: 23237 - DNA, 537 bp, Homo sapiens
  misc_feature: GYAE6OF01BNLH0.24.35.D02.1.454.CMB.1.raw
  modified_base (310)..(310): a, c, t, g, unknown or other
  misc_feature (310)..(310): n is a, c, g, or t
  modified_base (483)..(483): a, c, t, g, unknown or other
  misc_feature (483)..(483): n is a, c, g, or t
  modified_base (531)..(531): a, c, t, g, unknown or other
  misc_feature (531)..(531): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacngggtcactggcgtccccgcaggttcagtggcagtgggtctgggacagtacttcgactctcaccgtcagcagcctagagcctgaagtattttgcggtttactactgtcagcagtcgttccgctggccgtctaacgtttcgggcggggacagggtggaggtaggagacgaatggnggctggcaccgagtctgtcttcattccttccccgctactctagaaccntaacgg

SEQ ID NO: 23238 - DNA, 570 bp, Homo sapiens
  misc_feature: GYAE6OF01C3JZF.24.35.D02.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (374)..(374): a, c, t, g, unknown or other
  misc_feature (374)..(374): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggcctccaggctccncatctatgatgtcctccaangggtcactggccgtcccgcaggttcagtgcagtgggtctgggacagtacttcactctcaccgtnagcagcctagacgcctagaagtattttgtcggttttactacgttcgtcgagcacgtcgttcccgccgtggcccgtcgttaacgtttcgggcggggggtaccagggggtgggacggagggagacggaacgtggtacggtcgtggcaccgagtccgttgtcttcacgttccttcccgcctactctacgaacgtgtacg

SEQ ID NO: 23239 - DNA, 495 bp, Homo sapiens
  misc_feature: GYAE6OF01CL94A.24.35.D02.1.454.CMB.1.raw
  modified_base (310)..(310): a, c, t, g, unknown or other
  misc_feature (310)..(310): n is a, c, g, or t
  modified_base (464)..(464): a, c, t, g, unknown or other
  misc_feature (464)..(464): n is a, c, g, or t
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagccatcaccggaggaattgtgttgacacagtctccaggcaccctgtctttgtctccaggggagagagccaccctctcctgcagggccagtcagagtgttagcagcagctacttagctggtaccagcagaaacctggcctggctcccaggctcctcatctatggtgcgtccacngggccactggcgtcgcggacaggttcaggtggcagtggctttgggacagacttcactctcatcatcgacagactggacgcccgaagtattttgctagtgttattactgtcagtctgtttcggtcctctcctctatgtactctttgcgtggtccngtctggagatcagacgactgngctgcnctac

SEQ ID NO: 23240 - DNA, 765 bp, Homo sapiens
  misc_feature: GYAE6OF01DGPKL.24.35.D02.1.454.CMB.1.raw
  modified_base (200)..(200): a, c, t, g, unknown or other
  misc_feature (200)..(200): n is a, c, g, or t
  modified_base (315)..(315): a, c, t, g, unknown or other
  misc_feature (315)..(315): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccacggagaaattgtgttgacacagtctccaggcaccctgtctttgtctccgagggganagacgccaccctctcctgcagggccagccggagtgttagtaagtacttaggctggtaccaagagaaacctggccaggcctccgaggctcctcatctatgatcgtcctaccaacgngggtccacgtcggccgttccccgctacgggtttcaggtcgacgtaggttcgggtctacggggaactaggtaacctttccgaaccttccgtaccgaacccggttcacggtacccacggtacccgtaaggacggtacctaggtaaacgttacgttttttcgggtaccggtttttaacgttaacgtttcggttaccgacggtaccgtacggttcccggtttcccggcccgttcgggaccccggttaccgtttaaccgggttttcccgggggaccgggggggtaacccgtaaggggggttcgggaacgggtaacgggacgggtaaccggtaacggttgggtacgggtaccgttcgggacccgttacccgtagtttccggttacggtttaccttcccgtaccgtttccccgttacccccggaccttacgttacctacggtaaacctagttaacgg

SEQ ID NO: 23241 - DNA, 1027 bp, Homo sapiens
  misc_feature: GYAE6OF01ERFVI.24.35.D02.1.454.CMB.1.raw
tcagactactatgtcacgaccggtgctcgatttagcacacgatagttgggttttggggggaggaactgcctcagtaggacccagagggaccatggaagcccagcgtccagcttctcttcctcgtgcctactctggctcccaggacgacccacgggacgaaattgtgttgacactacgtacttccgaacggctacccctcgtctttcgtcctccgtaggggagacgagtccctaacccttcgtcccgtacgccgaacggggcccaacggacccgggtaagttcggttttaacggtaaaccgggttaccgttaacgggtccgtacggggtaacccccaaaacgtaaccggaaaaacccgttcggggaaccccgttacggggttacccgttcccccgtaacgggggttcccttaccccttaccggaacttaaccgtaaaaccgttaggggtaaccgttcgggtttcccccctttaacccgaaaaccggtaacgggggttttacccggtaaaccggtttaccgggtacccggtttccccccggggtacccgtaaccggggttttacccgtaaccgggttacgggtaccggttaacggggttcggggttaccgggttcggggggtaacccccaacgggttaccccgttttaccggtacccgttacccggttccggtaacccggttaccggtacgggacccgtaacggtcccgtttaaacggggaaccggttacccgttaggttaaaccggttaccttttttacggtaccgggtttttaaaccttaacgttcgtacgaacggtcctaccggttccggttcccgaccgttcgggtcccgtaacgtttaaccgttttccggggacgggggtaacccgttaggggttaccggtaaggtacggtaacggaaccgttaacgttaggtacccggtaccgttacgggaccgtacccgttacggtaccggttaggtaccttacggtacgttacccgttaccccgtaccgttaatcccggttaagaaccgttcgttaaccgg

SEQ ID NO: 23242 - DNA, 615 bp, Homo sapiens
  misc_feature: GYAE6OF01DYQ7D.24.35.D02.1.454.CMB.1.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
  modified_base (386)..(386): a, c, t, g, unknown or other
  misc_feature (386)..(386): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccacctctcctgcagggccagccggagtgttagtaagtacttaggctggtaccaacagaaacctggccaggctcccaggcctcctcatctatgattgtctaccaacgnggggtccacgttggccgtccccgcaggttcaggtgctaggtgggtctgggacagtacttcactctcaccgtnacgcacgcctagacgtcctagaagtgttttacgcggttttaactacgtgtacagtcagtccgttcccgccgtcggccgtacgttaaccgtttcggggcggggggaaccgtaggggtaggaggacgggaagacggtaacgtggtcggcgtcgaccgacgtagttccgtaggttcctttcgtactttcccgttaccccgtcctaacttacctacggtaaccgtgttaacgg

SEQ ID NO: 23243 - DNA, 532 bp, Homo sapiens
  misc_feature: GYAE6OF01DLKIU.24.35.D02.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (438)..(438): a, c, t, g, unknown or other
  misc_feature (438)..(438): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcagggccagccggagtgttagtaagtacttaggctggtaccaanagaaacctggccaggctcccaggctcctcatctatgatgtctaccaagcgggtcacgtgggccgtccccgctaggttcagtggcaggtgggtctgggacagacttcactctcaccgtcagcagcctagacgtcctagtaagtattttgcttagtttattactgtacagccacgtnacacgtcggccctacttcggccctaggaccagctggacactaccagactgtgctgccacattctgtcttcacttcctacccgctactctagaac

SEQ ID NO: 23244 - DNA, 540 bp, Homo sapiens
  misc_feature: GYAE6OF01AJ2RI.24.35.D02.1.454.CMB.1.raw
  modified_base (263)..(263): a, c, t, g, unknown or other
  misc_feature (263)..(263): n is a, c, g, or t
  modified_base (498)..(498): a, c, t, g, unknown or other
  misc_feature (498)..(498): n is a, c, g, or t
  modified_base (537)..(537): a, c, t, g, unknown or other
  misc_feature (537)..(537): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagcccaccctctcctgcagggccagccggagtgttagtaagtacttaggctggtaccaanagaaacctggccaggctcccaggctcctcatctatgatgtctccaacaggtcactggccgtccccgcaggttcaggtggcaggtgggtctgggacagacttcactctcaccgtcagccagcctagacgtcctgaagtattttgacgtttactactgtcagcacgtcgttcccgccgtcggccgtcgttacgtttccgggcgggggaccgaggggtggagaggacgacgaacgtgnggctgcacagtctgtcttcactccttccgctatctcatntag

SEQ ID NO: 23245 - DNA, 221 bp, Homo sapiens
  misc_feature: GYAE6OF01CPVYR.24.35.D02.1.454.CMB.1.raw
  modified_base (203)..(221): a, c, t, g, unknown or other
  misc_feature (203)..(221): n is a, c, g, or t
tcagactactatgtcacgaccggtgctcgatttagcacacgatagttgggtttggggaggtgtgtcacaagatttgggctctgggcaccgtgggcacgggggaggtgtgtcacaagatttgggctctgggcacagcggccctgggctgcctggtcaaggctacttccacatagtagtctgagcgggctggcaaggcgcatagnnnnnnnnnnnnnnnnnnn

SEQ ID NO: 23246 - DNA, 570 bp, Homo sapiens
  misc_feature: GYAE6OF01DJL3M.24.35.D02.1.454.CMB.1.raw
  modified_base (204)..(204): a, c, t, g, unknown or other
  misc_feature (204)..(204): n is a, c, g, or t
  modified_base (390)..(390): a, c, t, g, unknown or other
  misc_feature (390)..(390): n is a, c, g, or t
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttgcctggtaccagcagaaacctggccaggcctcccaggcctcctcctctatgctcgtctccaccgacggcccctggtctccagcctaggttcgtggcggtgggtctgggacagtacttcactctcaccgtcgagcagctaganccgtagaagtatttgtacgtttactacgtgtacagtcacgtccgttccgcgtcggccgtcgttaacgtttcggggcgggggtaccgtaggggtcgggagagggacggaacgaacgttggtcggcgtcggcgactagtcgttcgttccttacgtctttcccgtacccgcctagtcgtaacg

SEQ ID NO: 23247 - DNA, 695 bp, Homo sapiens
  misc_feature: GYAE6OF01DI911.24.35.D02.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
tcagactactatgtcacgaccggtgctcgatttagcacacgatagttgggtttgggggaggaactgctcagttaggacccagagggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagatntagagcaactacttagcctggtacacaacagaaacctggccaggcctcccaggcctcctcatctagtcgtatcgtcctaccgaacggccggttctacgtccggaccgtcccccgagtacggttcgaggttcgggctaggggtcggtcgtagggtaccacgtaccttcgacctcgttaccgaccggtcgacgtaccgacgtccgtaaggacgtaccgttaggtaacgttaacgtttttacggtaccggttttactacgttacgttactacgtcgtacggtacccgtttccgcccgttccggtaccgttaccgtttaaccgggttccggggacggggggtaaccctaaggggttcggaacggtaacggtacggaaaccggtaacgttgggtcgggtacgtacggacccgtaaccgtagttccgttcggttaccttaccgtaccttccccgttccccggtacc

SEQ ID NO: 23248 - DNA, 879 bp, Homo sapiens
  misc_feature: GYAE6OF01BB2BA.24.35.D02.1.454.CMB.1.raw
tcagactactatgtcacgaccggtgctcgattttagcacacgatagtttgggtttgggggaggaactgctcagttaggacccagagggaaccagtggaagccccgagcgtcgagccttctcttcctacctgtctacctctggacttcccgagtagaccaccggaagaaattggtgttgacgactagtctccgtagggtcctacccgttgttccttttgttaccgtccgaggggtagagagcccgtaccctctaccgtgcgagggcccgaggccggtagttgttagtaacgtacgttaggcctaggtaccaactacgaaccgtggacctaggtcctacccgaggtaccttcccgttactacttaccgttaacttaggtacgttcgttacccgtacccgtaaccggtacgggggttacccctaaccggttaccgggtaccccggttaccccccgggtaccggttaacgggtttccgtaaggggttcggtaccgtacgggtttacggggtcgttaacgggaaccgttacggtaccgttacgtaccgttccgttaccgtaaccggttacaacgtccgtacggtacccgtaacggtaccggtaccgttaaggtaacgttagtttttcggtaccggttttaacttaccgttcgtacgaggtaccgtacgtaccggtttacccgtacgttaccgggtacccttaccggttttaacggttccgggggtaccgggggtaacgttaaggggtacggaacgggtacgggtacggtaacggacggttcggtacgggacgttaccgtccgtaccgtacgttcgttacgtttcgttctttaccggttcctttacccgtcgttacgttaccttaccgggtacgtacggttacgg

SEQ ID NO: 23249 - DNA, 563 bp, Homo sapiens
  misc_feature: GYAE6OF01DBC43.24.35.D02.1.454.CMB.1.raw
  modified_base (205)..(205): a, c, t, g, unknown or other
  misc_feature (205)..(205): n is a, c, g, or t
  modified_base (295)..(295): a, c, t, g, unknown or other
  misc_feature (295)..(295): n is a, c, g, or t
  modified_base (421)..(421): a, c, t, g, unknown or other
  misc_feature (421)..(421): n is a, c, g, or t
  modified_base (452)..(452): a, c, t, g, unknown or other
  misc_feature (452)..(452): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctgtgtctccgaggggaaagngcccaccctctcctgcagggccagtcagagtataagagcaactactagcctggtatacaacagaaacctggccaggcctccaggctcctnatctatggtatactccagcgacgggccacgtggtcgtcccagccgaggttcaggtggctaggtcggggtctggggacaggtacgttcacgttctccacatcagctagtctgctagtctagaagttnttttgcttagtttatacgtgcctagcagcangtgacgtgccgtcttctacgttcggacggtacgggaccgagggtaggaacgtacgttaacggaaacggtacgtaggtacggtaccgttacgacccaacctcgttcgttacg

SEQ ID NO: 23250 - DNA, 209 bp, Homo sapiens
  misc_feature: GYAE6OF01DC6B6.24.35.D02.1.454.CMB.1.raw
  modified_base (204)..(209): a, c, t, g, unknown or other
  misc_feature (204)..(209): n is a, c, g, or t
tcagactactatgtcacgaccggtgctcgatttagcacacgatagttgggtttggggaggtgtgtcacaagatttgggctctgggcaccgtgggcacgggggaggtgtgtcacaagatttgggctctgggcacagcggccctgggctgcctggtcaaggactacttccacatagtagtctgagcgggctggcaaggcgcatagnnnnnn

SEQ ID NO: 23251 - DNA, 553 bp, Homo sapiens
  misc_feature: GYAE6OF01CH117.24.35.D02.1.454.CMB.1.raw
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
  modified_base (376)..(376): a, c, t, g, unknown or other
  misc_feature (376)..(376): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccaggggagagagccaccctctcctgcagggccagccggagtgttagtaagtacttaggctggtaccaanagaaacctggccaggctcccaggctcctcatctatgatgtctccaacngggtcactggccgtccccgcaggttcagtggcaggtgggtctgggacagtacttcactctcaccgtnagcagcctagacgcctgaagtattttgacggtttactactgtcagcagtcgttccgcctcggccgtctaacgtttcgggcgggggacgaggggtggaggaggagacgaacgtggtggcgtgcaccgagtcgtgttccttcacttcccgttccccgctactcctacgaactagtaacg

SEQ ID NO: 23252 - DNA, 794 bp, Homo sapiens
  misc_feature: GYAE6OF01B73G2.24.35.D02.1.454.CMB.1.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (423)..(423): a, c, t, g, unknown or other
  misc_feature (423)..(423): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagacgccaccctctcctgcagggccaggccggagtgttagtaagtacttaggctggtaccaanagaaactggccaggcctccgaggctcctcatctatgatcgtcctaccaacgagggtccacgtcgggcccgtcccccgacgtaggtttcagggtcggacctagggttcggggtcctaggggaaccaggtaaccttccaacgtccgtaccgaacccggttnacggtcaccggtacccttaaaggaccgtcccgttaggaaacggtttacgtttttacgggtacgggtttttaacctaacgttacggttaccgaaggtccgaacggttcccggtttcccgtacccgttcgggtaccccgtaccgttttaaaccgggtttcccgggggtaccgggggggaacccgtaaggggggttaccgggaaacgggtacggggaacggtaacccggtaaaccggttggggtaccgggccgttacgggacccgtaacccgtaacgtttcccgttaggtttccctttaccgtaaccgttttccccgttaccccccgtacttaaccgttaccgttaaacggtaaacccgttagtttaaaccggg

SEQ ID NO: 23253 - DNA, 571 bp, Homo sapiens
  misc_feature: GYAE6OF01DUPJ4.24.35.D02.1.454.CMB.1.raw
  modified_base (409)..(409): a, c, t, g, unknown or other
  misc_feature (409)..(409): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggcctcccaggcctcctcatctatgatgtctaccaacgagggtcacgtggcctccccgcaggttcaggtggcaggtgggtctgggacaggtacttcacttctcaccgtcagccagccctagacgcctagaagtntttcgcggtttactacgtgtacagcacgtcgttccgcgtcggccgtctacgttcgggcgggggaccgaggggtggaggaggacgacgaacgtggtcggctcgcaccagtccgtgttccttctacttccgttccccgtcctactcgtacgtaactgttaacgg

SEQ ID NO: 23254 - DNA, 627 bp, Homo sapiens
  misc_feature: GYAE6OF01DEQX2.24.35.D02.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (398)..(398): a, c, t, g, unknown or other
  misc_feature (398)..(398): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcacctgtcttgctcgagggganagacgccacctctcctgcagggccaggccggagtgttagtaagtacgttaggctggtaaccaaacgagaaacctggaccaggcctacccaggcctccncatctatgatgtactaccaacgtagggtccacttcggccgtccccgcgtaggttcaggtcggacgtaggtgggtctagggacacgacttcaactctcaccgtnagccaagcctaagacgtcctagaacgtatttggacgtttactactgtacagctacgtcgtaccgtcgtcgcccgtacttaacggttccgggcgggggtacgtaggggtggaacggaggacgacggtaacgtggtcggcgtcgaccgtaacctacgtccgttagttccttaccgaccgtttcccgttaccccggtccctaacgttccgtaactaaaccgtagtttaacgg

SEQ ID NO: 23255 - DNA, 558 bp, Homo sapiens
  misc_feature: GYAE6OF01C7ZEH.24.35.D02.1.454.CMB.1.raw
  modified_base (316)..(316): a, c, t, g, unknown or other
  misc_feature (316)..(316): n is a, c, g, or t
  modified_base (503)..(503): a, c, t, g, unknown or other
  misc_feature (503)..(503): n is a, c, g, or t
tcagactactatgtcacgaccggtgctcgatttagcacacgatagttgggtttgggggaggaactgctcagttaggacccagagggaaccatggaagccccagctcagcttctcttcctcctgctgctctggctcccagagaccaccggagaaattgtgttgacacagtctccaggcaccctgtctttgtctccgagggggagagacgccaccctctcctgcagggccaggccggagtgttagtaagtactaggctggtaaccaacagaaacctggccaggctcccaggctcctcatctatgatgtcctccaacgnggggtcactcggccgtccccgctaggttcagtggctaggtggtctgggacagacttcactctcaccgtcagcagcctagcgcctagtagtattttcgtcggtttactactgtcagcagtcgttccgcgtcggccgtcgtacgttcgggcggggtaccgagggtgggagtaggacgtacgacgttggnggcgtcgcacccgtgtcgtcgttcttcgtattcccgtcccgtctatctgactaag

SEQ ID NO: 23256 - DNA, 773 bp, Homo sapiens
  misc_feature: GYAE6OF01DZ3O5.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcagggccaggccggagtgttaagtaagtacttaggctggtaccaacagaaacctggaccaggcctcccgaggcctcctcatctatgatcgtcctccaacgagggtccacgtcggccgtccccgctaggttccaggtcggactagggttcgggtaccgtggggaacctaggtaacctttccgaaccttccgtaccgaacccggtcaacggcctaacggcccgttaaggaccggtcccgtagggtaaacgttagtttttcgggtaccggtttttaaacctacggttcgttaccgaggtacctacgggtcccgtttacccggacccgttcgggtccccgtacgtttaaccggtttccgggggaccgggggggtaacccgtaaggggggttcgggaacgggtaacggggtaacggtaaccggtaaccggttgggtacgggccgttacggacccgaacccgtacgtttccgttggttaccctttaccggtacccgtttaccccgttacccccgtaccttacgttacccgttaacggtaaaccgttacggttaaacgg

SEQ ID NO: 23257 - DNA, 547 bp, Homo sapiens
  misc_feature: GYAE6OF01A0BOG.24.35.D02.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacngggtcactggccgtcccgcaggttcagtggcagtgggtctgggacngacttcactctcacgtcagcagcctagcgcctgaagtatttgcggtttactactgtcagcacgcgttccgccgtcggccgtcttaacgtttccgggcgggggaccgaggggtggaggagggacgacgaacgtggtacggctgccacgtagtcgtgtcttcacttccttcccgtccatctagaactgtacgg

SEQ ID NO: 23258 - DNA, 579 bp, Homo sapiens
  misc_feature: GYAE6OF01B5YSY.24.35.D02.1.454.CMB.1.raw
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtcctccaacgngggtcacgtggccgtcccgcaggttcagtggcaggtggtctgggacagacttcactctcaccgtnagcagccctagacgcctagaagtattttggcggttttactactgtcagcagtccgttccgccgtcggccgtcgttaacggtttccggggacgggggacctagggggtcggaaggagggagacgaacgtggtggcgtggaccgtacctagtccgtgttccttcgacttccttccccgacctacgtctagtaactagttaacgg

SEQ ID NO: 23259 - DNA, 509 bp, Homo sapiens
  misc_feature: GYAE6OF01EJZYP.24.35.D02.1.454.CMB.1.raw
  modified_base (203)..(203): a, c, t, g, unknown or other
  misc_feature (203)..(203): n is a, c, g, or t
  modified_base (482)..(482): a, c, t, g, unknown or other
  misc_feature (482)..(482): n is a, c, g, or t
  modified_base (498)..(498): a, c, t, g, unknown or other
  misc_feature (498)..(498): n is a, c, g, or t
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccagggcccctggtgtcccagccaggttcgttggcggtgggtctgggacagatttcactctcacatcagcgctccagtctgagatttgctactttatttctgtcaacactatggtgactgcctccgtacacttttggccaggggaccaaacgtggagatacaaacgaactggtgntgcaccatctgtcttnatcttcccgac

SEQ ID NO: 23260 - DNA, 566 bp, Homo sapiens
  misc_feature: GYAE6OF01CHSFE.24.35.D02.1.454.CMB.1.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (314)..(314): a, c, t, g, unknown or other
  misc_feature (314)..(314): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagttgttaagtaagtacttaggctggtaccaanagaaacctggccaggctcccaggctcctcatctatgatgtctaccaacgngggtcacgtggccgtccccgctaggttcagtggctaggtggtctgggacaggagttcactctcaccatcagcagtctgctagtctagaagtatttgacttagtttaattactcgaccagctagacactagtacgacgtcggcctacttcgtaccgtttcgggacgggacggaaccgaagggtggaagactacgaaacgtacgtcggtaggctaggtcaacctattcgtcgttacttcctgttcccgttcccg

SEQ ID NO: 23261 - DNA, 627 bp, Homo sapiens
  misc_feature: GYAE6OF01BCIRZ.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (314)..(314): a, c, t, g, unknown or other
  misc_feature (314)..(314): n is a, c, g, or t
  modified_base (400)..(400): a, c, t, g, unknown or other
  misc_feature (400)..(400): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggcctcccaggctcctcatctatgatcgtctaccaacgngggtccacgtcgggcctccccgcaggttcaggtggcaggtcgggtctgggacaggacttcactctcaccgtcagcagcctaggacnctagaagtatttgtacggtttactacgtgtcagtcagtccgtccgccgtcggcccgtacgttaaccggttcggggacgggggtacccgtaggggtacgggagggtaacgggacggtaacggtaacgtcgggcggtacgttcgaccgtaccgtaacgttcccgttagttcccttcgtaccgttcccgttaccccgaccttacgttaccgtacgtaacgtagttaacgg

SEQ ID NO: 23262 - DNA, 658 bp, Homo sapiens
  misc_feature: GYAE6OF01C34DO.24.35.D02.1.454.CMB.1.raw
  modified_base (393)..(393): a, c, t, g, unknown or other
  misc_feature (393)..(393): n is a, c, g, or t
  modified_base (420)..(420): a, c, t, g, unknown or other
  misc_feature (420)..(420): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggccaccctgtctttgtctccgaggggagagacgcccaccctctcctgcgacgggcccaggccggtagttgttagtaagttacttaggcttggtaaccaaacgagaaaccgtcggaccgacggcctcccgaggtcctcctactatactatcgattcgtcctaccaacgtcgggtcacgtcggcccgtccccgcgtaggttcagtcggctaggtggtcnggacagtacttcacttcaccgaccgtnagccagccgttaagacgtccgtagtaacttcgttttacgtacggttttaacacgttgtacgtacgacgtacggtccggttcccgccgtcgggtacccgtacgtttaaccgggtttccggggaccgggggtacgtaggggtaggacggagggacgaagtaacgtggtcggcgtacgacctacgtagtcgttgttcttccaccttccgtcccgtactatacccgtagtaacgtgttaacg

SEQ ID NO: 23263 - DNA, 810 bp, Homo sapiens
  misc_feature: GYAE6OF01DFM3P.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggccaccctgtctttgtctccgagggganagacgcccaccctctcctgcgagggccaggccggagttgttagtaagtcttaggctaggtaccaagacgaaacctggaccaggcctcccgaggtcctcctcatctatcgatcgtccaccaacgaggtccacgtcggccgtccccgcgtaggttcaggtcggacgtaggtcgggtcgtacgggaactacggtaaccttcgaaccttccgtacgacccggttacacgggtaccacggacccgttaaggaacgtcccgttaaggtaaacgtttagttttttaccggggtaccgtttttaacgttacccgtttcggttaccgaagggtccgtaaccgggtttccccggtttaccccggcccggtttacgggacccccggtttaacggtttaaacccggggttttcccgggggggaaccgggggggttaaccccggaaggggggtttacgggaacggggtaacggggtaacggtaacggtaaccggttggggtaccgggtccgttacgggaccctaaacccgttacgttcccgtttaggttccctttacacccgttttcccttaccccccgtacttaaccgttccgttaacgtaaaaccgtggtttaaacggg

SEQ ID NO: 23264 - DNA, 666 bp, Homo sapiens
  misc_feature: GYAE6OF01CBR7O.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccgaggggagagacgcccaccctctcctgcgagggccagccggagtgttagtaagtacttaggctggtaaccaagacgaaaccgtggccaggcctccgaggcctcctcactctatgattcgtacctaccaaacgtcgggtcacgtcggccgtccccgcgtaggttcaggtcggacgtaggtgggtctgggactagtacttcgactcaccaccgtcacgcacgtcctagacgtccgtagtaacgttgttttcggtaccgttttaactacgtttgtacaacggtcgtaccgtccggtttacccgccgtttcgggcccgttacgtttaaccgggtttccgggggacccgggggaaccgtagggggtacggaacggtaagggacgacggtaacgtggtacggctcgaccgtaccgtagtcgttggttccttcgactttccccgttcccgactacgttaccgtacgtaaactgttaacgg

SEQ ID NO: 23265 - DNA, 528 bp, Homo sapiens
  misc_feature: GYAE6OF01ELGWC.24.35.D02.1.454.CMB.1.raw
  modified_base (202)..(202): a, c, t, g, unknown or other
  misc_feature (202)..(202): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaanagccaccctctcctgcagggccagtgagaatgttggcagcaacttagcctggtaccagcagaaacctggccaggctcccaggctcctcctctatgctgtcctccaccacgggcccctggtcgtcccagccaggttcgtggcggtgggtctgggacagtntttcactctcaccntcagcgcctcagtctgagtatttgctactttattctgtctaactactatggtgtactgcctccgtactacgttttggaccgtacggggacctaaacgtggagatacgaaacgaacgtggtcgntcgcacgntctgtcttnacttcctcccgac

SEQ ID NO: 23266 - DNA, 657 bp, Homo sapiens
  misc_feature: GYAE6OF01DFLVW.24.35.D02.1.454.CMB.1.raw
  modified_base (319)..(319): a, c, t, g, unknown or other
  misc_feature (319)..(319): n is a, c, g, or t
  modified_base (389)..(389): a, c, t, g, unknown or other
  misc_feature (389)..(389): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgcagggccagccggagtgttaagtaagtacttaggctggtaaccaacagaaacctggccaggcctcccgaggcctcctcatctatgatgtcctccaaagngggtcacgtcggccgtcccgctaggttcaggtggcaggtggtctgggacagtacttcactctacaccgtnagcagtctagacgtctagaagtagttttgtcgtttactacgttgtacagcacgtccgttcccgccgtcggtcccgtacgtttaaccggtttcggggacggggggtaccgtagggggttacgggaagggtagggaacgtaacggtaacggttcgggtacgggtccgtacggacccgtaacgtacgttccgttacggtttcctttaccgtaccttccccgttacccccggtacctaacgttcccgtaacgtaacgttaacggttaacggg

SEQ ID NO: 23267 - DNA, 642 bp, Homo sapiens
  misc_feature: GYAE6OF01DVFQN.24.35.D02.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctcgagggganagacgcccaccctctcctgcgagggccaggccggagttgttaagaagttacttaggctggtaaccaacagaaacctggccaggctcccaggcctcctnatctatcgatcgtcaccgaagtacggtccacgtcggccgtccccgctaacggttcgaggttcggacctaggtcgggtcgtgggaactagtaccttcgactctccgaacgtcagcgaagtcctaagcgactagtaagttagttttcgtacgtttactacgtgtacagtcgagtccgttccgccgtaggccctacgttaacggtttccggggcggggtaccgaggggtggaacgggacgaaggtaacccgtaaggtggtggcctacgaccgtacctacgttcgtcgtttaccgttctacggttcccctttacccggcttactaccgtacgaaccttagttaacgg

SEQ ID NO: 23268 - DNA, 729 bp, Homo sapiens
  misc_feature: GYAE6OF01BPKPN.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcagggccagccggagtgttagtaagtacttagcctggtaccagcagaacctggcctggcctccgaggtcctcctcatctagtggtcgccgtccaccgagggccacgtcggccgtcggcggactaggttcaggtgcgtaggtcggtcgtttggggactacggtacttcgaccttcgtacacgtccagttccgaactaggaccgttacgggaaccggtacccggtaaagttacgttttacggacgttaaggttacgtttaactttaacgttcgttacgtacgttccgtttcggttttacccggttccccttccgtttacccttaccgtttaacgttaccgtttaaccgtttaccggttttcgggtaccccggtttacgggtttcccgtacgggtaccgttagggtaacgtacgttaccggaaacggtccggtaaacgttcgggtacgggtcccttacggacccgtaacccgttacgttccttaccgtttaccttaccgtcctttaccccg

SEQ ID NO: 23269 - DNA, 713 bp, Homo sapiens
  misc_feature: GYAE6OF01CHJYI.24.35.D02.1.454.CMB.1.raw
  modified_base (221)..(221): a, c, t, g, unknown or other
  misc_feature (221)..(221): n is a, c, g, or t
tcagactactatgtcacgaccggtgctcgatttagcacacgatagttggggtttgggggaggaactgcctcagttaacggacccagagggaaccactggaagcccagcctcagcttctccttcctcctcgctacgtctggcctcccgaggagtacccaccggtagtaaagttggtgttagacacagtctccgaggccaccctgtcttggtctccgaggggnagacgccacctctccgtggccagggccaggccggagtcgttaggtaacgtacttaggctaggtaccaacacgaaaccgtggaccaggtcctacccgaggtcctccgtcagttacctatgatcgtaccgtccgaacgcgggtccacgtcggccgtccccgcgtacggttcgaggtcggctagggtcggtacgtggaccaagtacgttcgactcgtaccgacgtcacgcagcctagacgtccgtaggaagtagtttcggaccgtttactacgtgtacgagtccgacgccggttccgccgtacgggcccgtacggttaaccgttccggggaccgggggtaaccgaacggggttacggaacgggtacgggtaacggaaccggtaacgtggtacgggtacgtccggaccgttaccgtacgtccgttacggttaccgttccgaccgttcccgttacccgggacccgttacttaccgtacgtaaccgtagttaaccggg

SEQ ID NO: 23270 - DNA, 746 bp, Homo sapiens
  misc_feature: GYAE6OF01BE79Z.24.35.D02.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcagggccagccggagtgttagtaagtacttaggctggtaccaanagaacctggccaggctcccaggcctcctcattctatgatcgtcctaccgaacgtgggtcacgtcggcccgtccccgactaggttcaggtcggctaggtcgggtcgtagggacagtacttcgacttctacgaccgtcagccacgcctagcgtcctagaacgttagttttcggacgttttactacgttcggtactacgtccgtacgtcccggtttcccggaccgtccgggacccttaccggtttaaccgggttttcccggggggaccgggggggtaaccgtaaggggggttcgggaacggggtaacgggggtaaggtaacccgggtaaacggttcggggtaccgggtaccggttacggacccgtaaacccgtacggtttaccgtttccgggtttaaccgtttccctaacccggtttccccgtttaacccccggtacccgttaaacgttcccgtttaaacggaaaacccgtttggtttaaaccggg

SEQ ID NO: 23271 - DNA, 548 bp, Homo sapiens
  misc_feature: GYAE6OF01CZWA9.24.35.D02.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (375)..(375): a, c, t, g, unknown or other
  misc_feature (375)..(375): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctccaggcctcctcatctatgatgtctccaagngggtcactggccgtcccgctaggttcagtggcaggtggtctgggacagacttcactctcaccgtnagcagcctaagcgtcctggaatattttgtcggtttactacgtgtcagctacgtcgttccgccgtcggccgtcgtacgttccgggcgggggaccgaggggtggagaggagacgacgtggtggctgaccacagtcgtgttcttcacttccttcccgctagtctagaactgtaacg

SEQ ID NO: 23272 - DNA, 597 bp, Homo sapiens
  misc_feature: GYAE6OF01CCAMR.24.35.D02.1.454.CMB.1.raw
  modified_base (206)..(206): a, c, t, g, unknown or other
  misc_feature (206)..(206): n is a, c, g, or t
  modified_base (269)..(269): a, c, t, g, unknown or other
  misc_feature (269)..(269): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagatgccaccggagacattgtgttgacacagtctccagcccaccctgtctttgtctccgaggggaaancgccaccctctcctgcagggccagtgacaatgttaggagttgtagcctggtatcaacacaacngtggccaggcctcccggctcctcatctatgatgcatccaagtacgggccacgtggcactcccaagacctagggttcaggtcggcgtagggtcgggtcgtaggggacctaggtacctttcaaccttctaccacctatccagctaggtgtaagcgtctagtaagtattttgacttagttttacttacgtgtacacgtctaccgtcgtaaccaaccgtccggaccccttacgtttcccggcccgttacgggaccacggaccgtggaccacgtacccgaacggtacgtcggtcggccttggaccctacgtacttccgtcttccttctacccg

SEQ ID NO: 23273 - DNA, 717 bp, Homo sapiens
  misc_feature: GYAE6OF01B8MJX.24.35.D02.1.454.CMB.1.raw
  modified_base (262)..(262): a, c, t, g, unknown or other
  misc_feature (262)..(262): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccgaggggagagagccaccctctcctgcagggccagccggagtgttagtaagtacttaggctggtaccaanagaaacctggccaggctcccgaggctcctcatctaatgatcgtcctccaacgtagggtccacgtcggaccgtccccgcaggtttcacggttggctaggtcggggtctggggacaggtacttccgaacttctacaaccggtcaacggcacgtaccgtaggacgtcctagtaacgttagttttacggtaccggttttaactacgttgtaccagtaccgtacgtccggttcccgcccgttcgggccccggttacgtttaacccggtttccggggaccgggggggtacccgtagggggttacgggaacggtacggggaacggtaacgggtaaacgttcgggtaacgggtccgtacgggtaccctaacccgtaagtttcccggttagttccctttaccgtacccgtttcccgtttacccccgaccgttaactccgttaacgaaacttaaggtttaaccgg

SEQ ID NO: 23274 - DNA, 673 bp, Homo sapiens
  misc_feature: GYAE6OF01DRF1A.24.35.D02.1.454.CMB.1.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggnagagccaccctctcctgcagggccaggccggagtgttagtaagtacttaggctggtaccaanagaaacctggccaggctcccaggctcctcatctatgatgtctaccaagngggtcacgtggccgtcccgctaggttcagtggcaggtgggtctgggacagtacttcactctcaccgtcagcagccctaaggacgtcctagaagtagttttcggtacggttttaactacgttgtactagtccgtacgtccgtttcccgcccgtcgggtcccgtaccgtttaaccggtttcccgggggaccgggggggtaacccgtagggggtacgggaagggtacggggtaacggtaaccggtaacggttgggtacgggtccgtcggacccgtaccgtacgttccgttcggtttacctttccgtaactttccccgttaccccgtaccgttaacttccgttaacgtaaaccgtcggttaaacgg

SEQ ID NO: 23275 - DNA, 749 bp, Homo sapiens
  misc_feature: GYAE6OF01BXTJ4.24.35.D02.1.454.CMB.1.raw
  modified_base (199)..(199): a, c, t, g, unknown or other
  misc_feature (199)..(199): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccacggagaattgtgttgacacagtctccaggcaccctgtctttgtctccgagggganagacgccaccctctcctgcacgggccagccggagttgttaagtaagtacgttaggctggtaccaacgagaaccgtggaccaggcctcccgaggcctcctacatctatgatcgtcctacgaacgtaggtccacgtcggcccgtccccgcgtacggttcacggttcggaccgtagggttcgggtcgtacgggactacggtaccttcgaacttccgtacgtaaccgtcgagtccgacgtcccgtaaggtaccgaccgttaggaacgttttacgtttttacgggaccggttttttaacacggttacgttacgaacggtacctacgggttcccgtttcccgacgtccgggtacccttacggtttaaccggttcccggggggacgggggaacccgttagggggtacggaacggggtaccgggtaaggtaacccggttaggtacgggtacggtacccgttacggacccctaccgttagtacccgtttggttaccttcccgtacgtttccccgttaccccggtacttaggttacccagttaaacgtaggtttaaccgg

SEQ ID NO: 23276 - DNA, 529 bp, Homo sapiens
  misc_feature: GYAE6OF01C1DJP.24.35.D02.1.454.CMB.1.raw
  modified_base (201)..(201): a, c, t, g, unknown or other
  misc_feature (201)..(201): n is a, c, g, or t
  modified_base (390)..(390): a, c, t, g, unknown or other
  misc_feature (390)..(390): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccacctctcctgcagggccagccggagtgttagaagtacttagcctggtatcaacagaaacctggaccaggctcccaggctcctcatctatggtatatccagcagggccacgtggtcgtcccagcccaggttcaggtggcaggtggtctggggacaggagtttcactctcaccatccagcagtcngcagtctagaagtattttgcttaagtttattactgccagcagcacagtcgactcggacctcgtctcgtttcgggcggtacgggaccgtaaggtcggagagtacgaaacgagtggtgcgtgctaccattctgtcttctac

SEQ ID NO: 23277 - DNA, 843 bp, Homo sapiens
  misc_feature: GYAE6OF01DMQ3Z.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctccagagaccaccggagaaattgtgttgacacagtctccgaggccaccctgttctttgtcctccgaggggagagacgcccaccctctccgtagccgacggggccacgggccggtagttaggttaaggttaacggtacgttagggcgttacggaacccaaacgaacgaaaccgtcggaccgtacggtccctacccgaggtcccttacctctaacgttctataggtacttcggtacctacccgaaaggtcgggtcctaccggtcgggtccccgtccccggtacgtacgggtttccaagggttcggacggtacggttgggtccgtaagggacctaacggttcccttacaccgttcctccgaaccggttcaacggtcaacggtccctaaggaccgtaccgttaggtaacgtttacgttttacggtacgttttaccgttacgttacgtacgtacggtacgtaccgtcccggttccgtcccgtcggtaccccggttacggtttaaccggggtttccgggggaccggggggtaaccggtaagggggttacggaacggggtaacgggaaccgggtaaccgggtaacggttcgggtacggggtaccgtacggtacccgtaaccgttacgttccggtttcgttacccgtttcgtaccccgtttccccgttacccgtaccgttacgttacccgttaacgtaaccgttaggtttaaccggg

SEQ ID NO: 23278 - DNA, 603 bp, Homo sapiens
  misc_feature: GYAE6OF01B9STD.24.35.D02.1.454.CMB.1.raw
  modified_base (295)..(295): a, c, t, g, unknown or other
  misc_feature (295)..(295): n is a, c, g, or t
  modified_base (404)..(404): a, c, t, g, unknown or other
  misc_feature (404)..(404): n is a, c, g, or t
  modified_base (423)..(423): a, c, t, g, unknown or other
  misc_feature (423)..(423): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagccaccctctcctgcagggccagtcagagtgtagcagcagctacttagcctggtaccagcagaaacctggcctggcctcccaggcctccncatctagtggtgccgtccaccgacgggcccacgtcgggccgtcgcgggaactgggttcgaggtggcagggttggtcgtttgggacagtaccttcactctcatcatcganagactggacgcccgaagtntttgctagttagttacttacgtgttcgagtcttcggtttcggttcccttcttcccttccttagttcgttactttaccgttttccggtaccgttacgggttccgacggtcgtagggtaacgtagtaccggaaggtacccggtaagtcggttacggtacttaggccctaccgtgttacccgg

SEQ ID NO: 23279 - DNA, 866 bp, Homo sapiens
  misc_feature: GYAE6OF01C0RJW.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagacgaccgaccggaagaaattgtgttgacacagtctccagccaccctgtctttgtcctccgaggggagagacgcccaccctctccgtgcgacgggccaggccggtagttagttaaggtaagtacgttaggcttacggtaaccaacgacgtaaaaccgtcggaccgaaggtccctacccgaggtcccttaccctactaactaccttaatcggtactcggttaccctaacccaaacggtacgggttaccacggtccgggacccgttcccccggaccggtaggtttaccgaagggtcggacgtagggtcggggttacgtcggggaactacggtaccttaccgacttcctacccgaccgttacgacgcgtaacgtaccgtaaggacgtcccgtaaagggtaacgtttgtttttacgggtacgttttaaccacgttcgtaccgaaggccgtacggtcccggtttccccggaccgtcgggtccccgttaacggtttaacccgggtttcccgggggggaaccggggggttaacccaggggggtacggtaagggaacgggacgggtaaacccgtaacggggttcgggtaacggtccgttaacggaccccgtaaccgtacgtttcccgttaacgggtttcctttaaccccaacgggttttccccccgtttaccccccggacccgtttaaactttaccccgggtaaccgtaaaaaccggtttccgtttaaaacggggg

SEQ ID NO: 23280 - DNA, 603 bp, Homo sapiens
  misc_feature: GYAE6OF01A7MDJ.24.35.D02.1.454.CMB.1.raw
  modified_base (200)..(200): a, c, t, g, unknown or other
  misc_feature (200)..(200): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccagggganagagccaccctctcctgcagggccagccggagtgtacgtaagtacttagcgtgtacaacagaactacggcgacgcgtcccacggctcctcatctatgatgtctccaacacggtcactggccgtcccgtccaggttcgagtcggcgagtgggtcgtcggacgacgacttcacgtctcgtaccgtcacgcacgacctacgagcctaggtaatagtttttcgcgggttttaactactcgttcaacgctagtccggtttccgcctgggtacccgctttaacggtttccggggcggggggaaccgtagggttgggacggaggacggtacgaacgtggtggctcgccgaacctagttcttgttcttctacgtaccctttccccggacctattacctcgaaatcgttagg

SEQ ID NO: 23281 - DNA, 537 bp, Homo sapiens
  misc_feature: GYAE6OF01BLA6C.24.35.D02.1.454.CMB.1.raw
  modified_base (393)..(393): a, c, t, g, unknown or other
  misc_feature (393)..(393): n is a, c, g, or t
  modified_base (531)..(531): a, c, t, g, unknown or other
  misc_feature (531)..(531): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcacgtggcgtcccgcaggttcagtggcagtggctgggacagacttcactctcaccatcagcggcctccagtctgaagtntttgctactttatttctagtctaacactatggtgtactggtccttccgtactcgtttcggccgtacggggacctaaacgtggacgtactacgaaacgacgtgtgctgcacatctgttcttctacttccttacccgctntctacg

SEQ ID NO: 23282 - DNA, 566 bp, Homo sapiens
  misc_feature: GYAE6OF01ES9Q3.24.35.D02.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccaggccggagtgttagtaagtacttaggctggtaccaacagaaacctggccaggctcccaggctccncatctatgatgtctccaacgagggtcacgtggccgtccccgctaggttcagtggcaggtgggtctgggacagcttcactctcaccgtnagcagcctagcncctagaagtatttgcgtttactactgtcagcagtcgttccgccgtcggccgtcgttaacgttcgggcgggggaccgaggggtcggaggaggagacgtaacgtggtcggctcggacaccgtacgtcgtgttcttcacttccgttccccgtctacttcctagtaaactagttaacgg

SEQ ID NO: 23283 - DNA, 547 bp, Homo sapiens
  misc_feature: GYAE6OF01DXCKY.24.35.D02.1.454.CMB.1.raw
  modified_base (202)..(202): a, c, t, g, unknown or other
  misc_feature (202)..(202): n is a, c, g, or t
  modified_base (536)..(536): a, c, t, g, unknown or other
  misc_feature (536)..(536): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacgcagtctccaggcaccctgtctttgtctccgagggganagacgccaccctctcctgcagggccagtcagagtgttagcagcagctacttagcctggtaccagcaagaaacctggcctggctccgaggctcctcatctagtggtcgcgtccaccgacgggccacgtggcgtcgcggactaggtcaggtggctaggtggtcgtttgggactagtacttcactctcatcatcgacagactggacgcccgtaagtagtttgactagttgttacttacgtgtcagtcttgttcggtcctcttcctctattctacttcgtttcggcgtacggttccaggtcgtggtacgtatcgtagtcgacgtaacgtcggtacgtntcgcacgtacg

SEQ ID NO: 23284 - DNA, 698 bp, Homo sapiens
  misc_feature: GYAE6OF01A8GVC.24.35.D02.1.454.CMB.1.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagcccaccctctcctgcagggccagccggagtgttagaagtacttaggctggtaccaacagaaacctggccaggcctcccaggcctcctnatctatgatgtcctaccaacagggtccacgtcggccgtccccgcgtaggttcaggtcggactaggtcgggtctgggacagtacttcactctcaccgtcagcagcctagacgcctagaagttattttggacgttttactacgtgtacgacgtcgtagtccggttacccgccgttcggcccgtacgtttaaccggtttccgggggaccggggggtaaccgtagggggtacgggaagggtacgggaacggtaaccggtaaccgttgggttaccgggaccgtttacgggacccgtaacccgttaacgtttcccggtttacggttacccttttccgtaaccgtttcccccgtttaacccccggtaccctagtttacccggttaacgtaaaaccgttcgggtttaaacgg

SEQ ID NO: 23285 - DNA, 607 bp, Homo sapiens
  misc_feature: GYAE6OF01BF7AB.24.35.D02.1.454.CMB.1.raw
  modified_base (262)..(262): a, c, t, g, unknown or other
  misc_feature (262)..(262): n is a, c, g, or t
  modified_base (310)..(310): a, c, t, g, unknown or other
  misc_feature (310)..(310): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaanagaaacctggccaggctcccaggctcctcatctatgatgtctccaacngggtcacgtggccgtccccgcaggttcaggtcggctaggtggtcgtggacagacttcactctccacgtcagcagcctagacgtcctgaagtagtttgtacggttactacgtgtcagcgtacgtcgttccgccgtcggccgtacgttaacggtttccggggcgggggtaccgtagggggtcggaagggtacgggaacggaacggtaacggtcggtacgggtcgtcggtaccaccgtacgtccgttggttaccttcgtacgttcccgttacccgtcctacttactacgaactagtacgg

SEQ ID NO: 23286 - DNA, 596 bp, Homo sapiens
  misc_feature: GYAE6OF01DD94Z.24.35.D02.1.454.CMB.1.raw
  modified_base (310)..(310): a, c, t, g, unknown or other
  misc_feature (310)..(310): n is a, c, g, or t
  modified_base (551)..(551): a, c, t, g, unknown or other
  misc_feature (551)..(551): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagccaccctctcctgcagggccagccggagtgttagtaagtacttaggctggtaccaacagaaacctggccaggctcccaggctcctcatctatgatgtctccaanagggtcacgtcggccgtccccgccaggtttcagtggcaggtggtctgggacagacttcactctcaccgtcagcagcctagagccgtagaagtattttcgacggttttaacctacttcgtacaagccaggtccgttcccgcctgggcccgtcttaaccgtttccggggcgggggtaccaggggtaggaggtaggaggacgtaacgtggtcggcgtgccgtacctagttccgtgttccttacnctttcccgttccccggcctacttccgtaacgaccgtagttaacgg

SEQ ID NO: 23287 - DNA, 542 bp, Homo sapiens
  misc_feature: GYAE6OF01BF4I0.24.35.D02.1.454.CMB.1.raw
tcagactactatgtcacgaccggtgctcgatttagcacacgatagttgggtttgggggaggaactgctcagttaggacccagagggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagatgttggcagcaacttagcctggtaccagcagaaacctggccaggctccaggctcctcctctatgctgtcctccaccacgggcccctggtcgtcccagcctaggttcgttgggcggtgggtctgggacagtctttcactctcaccatcagcgcctcagtctgagtatttgcttactttatttctgtactaactacttatggtctacgtcggtcctccgtactacgtttcggaccgtagggacctaacgtggacagtacgaaacgacgtgtcggtctcgcaccatcgttcgtcttacacttcctcccgtacc

SEQ ID NO: 23288 - DNA, 554 bp, Homo sapiens
  misc_feature: GYAE6OF01BGAHM.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgcagggccagccggagtgttagtaagtacttaggctggtaccaacagaaacctggccaggctcccaggctcctcatctatggtgcgtccaccgagggccacgtggcgtcggcggacaggttcaggtggcagtgtctttgggacagacttcactctcaccgtcagcacgcctagacgcctagaagtattttgtcggtttactactgtcagcagtccgttccgccgtcggccgtcttaacgtttcgggcgggggacaggggtggaggaggagacgacgtgtggctcgcacgcgtctgttcttcacgttccttcccgtccagttctcgaactgttacg

SEQ ID NO: 23289 - DNA, 598 bp, Homo sapiens
  misc_feature: GYAE6OF01AV99S.24.35.D02.1.454.CMB.1.raw
  modified_base (591)..(591): a, c, t, g, unknown or other
  misc_feature (591)..(591): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgcagggccagccggagtgttagtaagtacttaggctggtaccaacagaaacctggccaggctcccaggctcctcatctatgatcgtctccgaacagggtcacgtggccgtccccggcaggttcaggtgcaggtgggtctgggacagtacttcactctcaccgtcagcagccctagagtcctagaagttacttttcggtacggttttaacctacgttgtacagtcgtacgtccgtttcccggccgtcgggcccgtacgttaacgtttccgggggccggggtacaggggtggacgagggacgacgacgtggtcggcgtgccacgtatcgttagtccttctacgttccgttcccgacctagttaccacgtaaacngttacgg

SEQ ID NO: 23290 - DNA, 545 bp, Homo sapiens
  misc_feature: GYAE6OF01CMAS1.24.35.D02.1.454.CMB.1.raw
  modified_base (207)..(207): a, c, t, g, unknown or other
  misc_feature (207)..(207): n is a, c, g, or t
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (445)..(445): a, c, t, g, unknown or other
  misc_feature (445)..(445): n is a, c, g, or t
  modified_base (478)..(478): a, c, t, g, unknown or other
  misc_feature (478)..(478): n is a, c, g, or t
  modified_base (535)..(535): a, c, t, g, unknown or other
  misc_feature (535)..(535): n is a, c, g, or t
tcagactactatgtcacgaccggtgctcgatttagcacacgatagtttgggtttgggggaggaactgctcagttaggacccagagggaaccatggaagccccctagctcagcttctcttcctcctgctactctggcctcccagagaccaccgggagaaattgtgttgacacagtctccaggcaccctgtctttgtctccgagggganagagccaccctctccgtgcagggccagccggagtgttagtaagtcttaggctggtaccanagaacctggccaggctcccaggctcctcatctatgatgtcctccaacnggtcactggccgtcccgctaggttcaggtcggcagtggtactgggacaggacttacactctcacgtcagcagcctagacncctagagtnttttcgcgtttacacttgtcagcagtccgttcgcctggccncttaacgttcgggacggggtccaggggtgaggnggacgacggaacgtgtggctgccacgagtctgtactctactccttcccgctattccngactgttacg

SEQ ID NO: 23291 - DNA, 605 bp, Homo sapiens
  misc_feature: GYAE6OF01CN3TK.24.35.D02.1.454.CMB.1.raw
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaanagaaacctggccaggcctccaggctcctcatctatgatgtctccaanaggtcacgtggccgtcccgctaggttcagtggntagtgggtctggacngacttcactctcaccgtnacgcagcctagcgtctagtaagttagttttgtcggttttaactacgtgtacagtcgagtccgttcccgcgtcggtcccgtacgttaccggtttcggggcgggggtaacctagggggtggagggagggtacggaacggaacgttggtacgggcgtcggaccgactacgtcgttgttctttctacgttcccgttccccgtccgtaactccgttaacgaacgttaagttacgg

SEQ ID NO: 23292 - DNA, 953 bp, Homo sapiens
  misc_feature: GYAE6OF01BDHHE.24.35.D02.1.454.CMB.1.raw
tcagactactatgtcacgaccggtgctcgatttagcacacgatagtgggttggggaggtaactgtcgttccagttaggacccaacgagggaaccatcggaacgacccctagctcagtccttcgtctcctcctcggactaccggtcctggcctcctagagaccgaccggagaacgttgtggtgacactagtctccagccacctgtcttgtcctccgagggagacgtagaccgtacccttcgtccgtcgacgtacggtcccaggtcccggtagttcgttaaaggttaacgttaaccgttaacgggtccttccgggtaaccctaaacctaacggttaaacccggtagggacccgaacgggtaccgtaccccggaagggtccttacccgtacctaacgttccgttacgtcggtacgtccgttacctacccgtaaccgttacggggtacccttaaccgtccggggttaccccgttccccccgacccgttaagggttttccctaacggttaccgggtaccgtaacgggttcggggttaccgttaggggaaccgtacgggtacccgtttaccgaaccgtttaccgtacccgtaacccggttacaacgggacctacggaccccgttaaggaccgtacccgtaaggtaacggtttacgttttcgggtaacccggttttaaccttaacccgttggttaccaacggtccgtaacggttcccgttcccggtacccgttcgggtacccgttacgtttaacccggtttccggggaccggggggtaaccctagggggttacgaacggggtaacggtaacgggtaaccggtaacggttacggtacggggtccttaacgggacccgtaaacccgttaacggttccccgtttaggttacccttaccgtaacccgttccccgttacccgtacccttaacttcccggtaacgttaaccgtaagggtttaaccg

SEQ ID NO: 23293 - DNA, 605 bp, Homo sapiens
  misc_feature: GYAE6OF01BQ4LA.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggagaactgctcagttaggacccagagggaaccatggaacgccccagctcagcttctcttcctcctgctactctggctcccagagaccaccggagaaattgtgttgacacagtctccaggcaccctgtctttgctccgagggganagagcccaccctctcctgcagggccagccggagtcgttagtaagttacgttaggctaggtaaccaactacgaaacctggcccaggcctcccaggcctcctacactctatgtatcgtcctaccgaacgtagggtccacgtcggcccgtccccggcctaggttcaggtggctaggtcgggtctgggacagacttcactctcaccgtcacgcagtccctagacgtcctagtaacgtagttttgcggtttactactgtacagctagtcgttccgcctcggccgtcgtaccgtttcgggcggggaacctaggggtaggagaggagacgtacgtggtagctcggaccaccgtacgtcgtcgttctcctacttcccgttcccgtctacttccgtacgtaacgtcgttaacg

SEQ ID NO: 23294 - DNA, 604 bp, Homo sapiens
  misc_feature: GYAE6OF01B1QJW.24.35.D02.1.454.CMB.1.raw
  modified_base (202)..(202): a, c, t, g, unknown or other
  misc_feature (202)..(202): n is a, c, g, or t
  modified_base (295)..(295): a, c, t, g, unknown or other
  misc_feature (295)..(295): n is a, c, g, or t
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagataccactggagaaattgtgttgacacagtctccaggcaccctgtctttgtctccaggggganagagcccaccctctccctgcagggccagccggagtgttagtaagtacttaggctggtaccaacagaaacctggccaggcctcccaggctcctnatctatgatgtcctaccaacgagggtccacgtcggccgtcccccgcgtacggtttcaggtggctaggtcggggtctggggacaggacttcactctacacccgtnagcacgcctaagcgtctgaagtntttgtcggtttactacgtgtcagcagtccgttccgccgtcggccgtacgttaccgtttcggggccgggggtaccgtaggggtacgggaggacgggacggacggtacgtggtcggcgtcggcctaccgtacgttcgtcgttcgttacctcttcccgttcccgactacttccgtagaacgtacg

SEQ ID NO: 23295 - DNA, 649 bp, Homo sapiens
  misc_feature: GYAE6OF01DJY5M.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggcctcccgaggcctcctcctctatgctgtcctcccaccgacgggcccctggtcgtcccacgccgtagggttcgttgggcgggtgggtcgtggggactagtactttcacttctccacctatcgacgccggccctccgaggttcctgtaagttgttttcgcttacttttactttctacgttactaactacttagtggttacgtacgttcggtcccttaccggttaccttacgttttcgggacccgtaacggggaaccctaaacgtacgggaagtacgtaacaaacggtaactgggtacgcgtcgaccgtaccgtacttcgtagtttccttcgacttcccgttcccgaccctacttacctacgaactaagttacgg

SEQ ID NO: 23296 - DNA, 696 bp, Homo sapiens
  misc_feature: GYAE6OF01CKUGE.24.35.D02.1.454.CMB.1.raw
  modified_base (205)..(205): a, c, t, g, unknown or other
  misc_feature (205)..(205): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaagtagtcatgacgcagtcctccagccaccctgtctgtgtctccgaggggaaanacgccaccctctcctgcacgggccaggtgagaatggtggcagcaacttgcctggtaccagcaagaacctggcccaggcctcccgacggcctcctcctctactgctcgtctccaccgacgggccctggtccgtcccaggcctagggttccgtgggccggttgggtccgtggggacgtaggtacgtttcgacctcgtaccaacctacgtccgacggtccgtaccctccgtacgtcgtaggtaaacgttcttttacggtaacctttacgttttaactttccgttacggttacctaaacgtactttaagtcgggttacgtaccgtcggtacccgttaccgttaaccgttaacgttttcgggaccggtacggggtaaaccctaaacggtacggtaacgacgtaaaccggtaaacggacgttcgggacggtccgtagaccgtaccgtacgttcgttacggttcttacgtaccgtttacccttccccgtacctaaccg

SEQ ID NO: 23297 - DNA, 515 bp, Homo sapiens
  misc_feature: GYAE6OF01E2N4X.24.35.D02.1.454.CMB.1.raw
  modified_base (203)..(203): a, c, t, g, unknown or other
  misc_feature (203)..(203): n is a, c, g, or t
  modified_base (369)..(369): a, c, t, g, unknown or other
  misc_feature (369)..(369): n is a, c, g, or t
  modified_base (508)..(508): a, c, t, g, unknown or other
  misc_feature (508)..(508): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgtagcctggtatcaacacaaacatggccaggcctccccggctcctcatctatgatgcatccaagtacgggccactggcactcccagacaggttcagtgcagtggtctgggacagacttcactcncaccatcagcagtgtagagcctagaagtattttgctagtttattactgtcagcaccgtagacctaacgtcgaccctacgtttccggccctggaccagacgtcggacactaccgaacgtactggtcgctgcctacatctntctctac

SEQ ID NO: 23298 - DNA, 594 bp, Homo sapiens
  misc_feature: GYAE6OF01CPC0J.24.35.D02.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagcccaccctctcctgcagggccagccggagtgttagtaagtacttaggctggtaccaanagaaacctggccaggctcccaggctcctcatctatgatgtctccaangggtcactggccgtcccgctaggttcaggtgcgagtgggtctgggacagtacttcactctcacgtcagcagcctagacgcctagagtatttgtcggtttactactgtcagtcagtccgttccgccgtcggcccgtcgtaaccgtttccgggcggggggacccgtagggggtacggagggtagggaggaaccgaacgtggtcggacgtcgacctaccgagttccgtggttccttcgacttcccgttaccccgtccctacttaccgtacgtaactagttaacggg

SEQ ID NO: 23299 - DNA, 793 bp, Homo sapiens
  misc_feature: GYAE6OF01BEWXR.24.35.D02.1.454.CMB.1.raw
  modified_base (359)..(359): a, c, t, g, unknown or other
  misc_feature (359)..(359): n is a, c, g, or t
tcagactactatgtcacgaccggtgctcgatttagcacacgatagttgggtttggggggaggaactgcgtacagttaggacccacgaggggaaccatggaagccccagctcgacgcgttctccttcctccttgctacctctggctcccagagaccaccggagtaaacttggtcgttagtacacgacgtctccaggcacccctgtctttgtcgtccgaggggacgacggagccgaaccctcttccttgccacgggccagccggagtgttaagtaagttaccgttaggctggtaacctaacgagaaacctggccaacggctcccaggcctcccgtcacgtccctaatgtatgtctccaagngggtcacgttcggccgtaccccggccgtaggttccgacgtggctaggtcgggtctggggaccacggtacttccgaactcgtcctacccgtccaacgtcctacggtccccttacgaccgtacccgtagtaacggttacgtttttcgggaccggtttttaacgtaacgttcggtacgtaacggccgtagggttcccgtttacccggacccgtttcgggaccccgttactttaacccgggttttccgggggaccgggggggttaaccctaaggggggttcggaacgggtaccgggggtaacggtaaccggtaacgttcgggttacgggtccgttcgggacccggtaccgtaacgtccgttacgttacccgttccgtacgttccccggtttacccccgcgtacccgttaccgttacgtaaacccgtccggtttaacgg

SEQ ID NO: 23300 - DNA, 694 bp, Homo sapiens
  misc_feature: GYAE6OF01ADLCX.24.35.D02.1.454.CMB.1.raw
  modified_base (318)..(318): a, c, t, g, unknown or other
  misc_feature (318)..(318): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccaccctctcctgcgagggccagccggagtgttagtaagtacttaggctggtaccaacagaaacctggccaggcctccgaggctcctcatctatgatcgtcctccaacgnggtcacgtggccgtccccgctaggttcaggtggcgaggtgggtctgggacagtacttcactctcaccgtcagcagcctagacgctagaagttgttttgacggtttactacgtgtacagtcacggtccgttccgccgtcggcccgtacgttaacggtttccggggggaccgggggtaccgtagggggttcggaacgggtacgggaacggtaaccggtaacggttcggggtacggtaccgttcggaccctaacccgttacggtttcccggtttagggttttacccctttcgtaacccggttttcccccggtttacccccggtaaccctttaacgttacccgttaaacggtaaaacccgtttaggttttaaacccgggg

SEQ ID NO: 23301 - DNA, 718 bp, Homo sapiens
  misc_feature: GYAE6OF01EMWBY.24.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (403)..(403): a, c, t, g, unknown or other
  misc_feature (403)..(403): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccagccggagtgttagtaagcttaggctggtaccaanagaaacctggccaggctcccaggcctcctcatctatgatcgtctaccaacgtcggtactacgtcggtcccgtccccgacgtaggttcaggtcggacagggtcggtcgtagggacagtacttcacgttctccgaccgtcgacncgacgtccgtaaggacgtcctaggaacgtttagttttcggtacggtttttaacctacgttcgtacaggaccgtacggttccggttcccgtccgtccgggacccgtacgtttaaccgggtttccgggggaccggggggtacccgtagggggttcgggaagggtaacgggacggtaaaccggtaacggttgggtacggtccgtacggacccgtaaacccgtacgtttccgttacggttccctttaccgtacccgttttaccccgttcccccgaaccctttactaacccggttacgtaaaaccgtacgtttaaacggg

SEQ ID NO: 23302 - DNA, 681 bp, Homo sapiens
  misc_feature: GYAE6OF01E3OT9.24.35.D02.1.454.CMB.1.raw
  modified_base (200)..(200): a, c, t, g, unknown or other
  misc_feature (200)..(200): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctcgagggganagagcccaccctctcctgcagggccagccggagtgttagtaagtacttaggctaggtaccaacgagaaacctggccaggcctcccgaggcctcctcatctatgatcgtcctaccaacgtagggtccacgtcggcccgtccccgacgtagggtttccaggtcggcgaggtcgggtcgtagggactagtaccttcaactttccaccgtaccgtcacgccaacggtcctaaggacgtcctaggtaacgttacgttttcggtacggttttactaacgttggttaccacggtccgacggtccgtttcccggacccgttcgggcccgttaccgttaacccgggtttccggggaccgggggtaccgtaagggggtcggtaaggtacgggaacgtacggtaacgtgggtcgcgtcgtaccgtacgtacgtccgttgtcttccgtacttccccgttaccgtaccgtataccgtactaaccgtgttaacgg

SEQ ID NO: 23303 - DNA, 856 bp, Homo sapiens
  misc_feature: GYAE6OF01C29BW.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcacccttgtctttgtctccgagggganaggacgcccacccgtcgtcccgtgcgacgggccgacggccggtagttacggttaagtaacgttacgttacgggcttagggtaaccaaacgaacgaaaccgtcggacccgaacgggtcctacccgtaaggtcccttccctacacttccgtatcggtattcgtacctaccgaacggtacgggtcctacggtcgggtacccgtccccgacgtaggttcgaggtcggacgaggttcgggtcgtagggactaacggttacttaccgaccttacccgtaccgaccggttaccgacgccgtaaccggtacccgttaaacggaacgttcccgttaaggtaaacgtttacggttttaccggtaccgggttttaacctacggttacgtacgtaacggtccgttaccgggtccggtttcccggaccgttccgggtacccggtttaaccggtttaacgggttcccggggggaaccggggggtaaccggtaacggggggtacgggtaaacggggtaaccgggtaacgggtaaacccggtaacgttcggggttacgggtacccgttaccgggaaccgtaacccgtaccggtttacgttcggttacccttccgttaaccgtccccgtttaccccgacgttacgtccgtaaacggaacgttgttaaccgg

SEQ ID NO: 23304 - DNA, 621 bp, Homo sapiens
  misc_feature: GYAE6OF01A3ASA.24.35.D02.1.454.CMB.1.raw
  modified_base (315)..(315): a, c, t, g, unknown or other
  misc_feature (315)..(315): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagccacctctcctgcagggccagccggagtgttagtaagtacttaggctggtaccaacagaaacctggccaggctcccgaggcctcctcatctatgatcgtcctccaacgnggggtcacgtggccgtccccgcctagggttcaggtggctaggtcgggtctgggacaggacttcgactctcaccgtcagcagccctagacgcctgaacgtagttttgtacggttttactaacgttgtcagtcgtacgtcgttcccgccgtcggtcccgtacgttaaccggtttccggggacggggggtaccgtagggggtcggtagggaacgggacggacggtaacggtggtaggtcgtcggaccgtaccgtagttcgtgttcttcgtacttcccgttcccgtactactactcgtaacgtagtacgg

SEQ ID NO: 23305 - DNA, 713 bp, Homo sapiens
  misc_feature: GYAE6OF01EYLSP.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgttctttgtctccgagggganagacgcccaccctctcctgcagggccagccggagttgttagtaagtacttaggctaggtaccaacagaacctggccaggcctccgaggtcctcctcattctagtgatcgtctaccgaacgtgggtcacgtcggccgtccccgctaggttcaggtcggcgtagggttcgggtcgtgggaactacggtaccttccacgtcgtaccaccgtcacgcaacgcctaggacgtccgttaggaacgtttagttttcggtacggttttaacctacgttcggtacaggtccgtacggttccggttaccccggcgttcgggacccgttacggtttaaccgggttccgggggggaaccggggggtacctaggggggtacggaaggggtaacggaacgggtaaccggtaacgtgggtccgggtacgtcggtaccaaccgttacgttccgttaggtttccctacgttaccgttcccctttccccggaccttacgttaccgtaaccgtaaacgttagttacggg

SEQ ID NO: 23306 - DNA, 742 bp, Homo sapiens
  misc_feature: GYAE6OF01DCRXM.24.35.D02.1.454.CMB.1.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcagggccagccggagtgttagtaagtacttaggctggtaccaacagaaacctggccaggcctcccgaggcctcctcatctatgatgtctccaagngggtcacgtcggccgtcccgctaggttcaggtggcaggtgggtctgggacagtacttcactctccaccgtcacgcacgtcctagacgtccgtagtaacgttcgttttacggtacggttttaactacgttcgtacgtaacgtcgtacgtcccggtttcccgtccgtcggtccccggttacgtttaacccgggttttcccgggggaccgggggggtaaccgtaggggggtacggggaacgggtaacggggaacggtaacccgggtaaacggttcggggtaccggggtacccgttaccgggacccgtaacccgtaacgtttcccggttcgggttttaccctttacccgtaccgttttcccccgttacccccgggtaacccttaaccggttacccgtttaaaccggtaaaaccgttaggttttaaaccgggg

SEQ ID NO: 23307 - DNA, 643 bp, Homo sapiens
  misc_feature: GYAE6OF01AY0UV.24.35.D02.1.454.CMB.1.raw
  modified_base (265)..(265): a, c, t, g, unknown or other
  misc_feature (265)..(265): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaatttgtgttgacacagtctccaggcaccctgtctttgtctccgaggggagagagcccaccctctcctgcagggccagccggagtgttagtaagtacttaggctggtaccaanagaacctggccaggctcccaggctctcatctatgatgtcctccaacagggtccacgtcggccgtccccgcaggttcagtcggctaggtcgggtctgggacaggtacttcgactctcaccgtcacgcagcctagacgcctagtaagtagtttgtacggtttactacgttcgtacgagtcgacgtccgttcccgcccgtcgggacccgtcgtttaaccggtttccggggaccggggggtaaccgtagggggtacggaggggtaacgggacgaaccggtaacgtgggtacggtccgtacggacaccgtacgttcggttcgttaccttctaccgttcccttaccccggtcctacgttaccttaacgtaaccgtagttaacgg

SEQ ID NO: 23308 - DNA, 736 bp, Homo sapiens
  misc_feature: GYAE6OF01DPGN1.24.35.D02.1.454.CMB.1.raw
  modified_base (199)..(199): a, c, t, g, unknown or other
  misc_feature (199)..(199): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccacggagaaattgtgttgacgcagtctccaggcaccctgtctttgtctcgagggganagacgccaccctctcctgcagggccagtcagagtgttagcagcagctacttagcctggtacagcaacgaacctggacctggacctcccgaggccttcctacattctagtcggtcgccgtacccacgacggcctacgtgggccgtcgacggtacgtacggttcgaggtcggacgtaggtcggtacgtttacgggaactacgtaactttcgacttctacgacttacgacgttaccgacgacgtacgtacgggacgtaacccggtaaagttacgttttacgacgttaacgtttagttaactttacgtacgttacgtacggtttcgttttaccggtttccggtttcccctttacccgttaccctttcccgtttaacgtttaccggtttaacccgttttaccgttttaccggggtacccgtttacgggggtttacccgtaggggtaccggttacggggttaacgtacggttaaccggtaaacggtaccgtaaacggttcggtacgggtaccgtaacggtaccctaaccgttacgtttcccgg

SEQ ID NO: 23309 - DNA, 554 bp, Homo sapiens
  misc_feature: GYAE6OF01BH23S.24.35.D02.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacngggtcacgtggccgtccccgcaggttcagtggcaggtgggtctgggacagcttcactctcaccgtcagcagccctagacgtcctgaagtattttgcgtttactactgtcagcagtccgttccgccgtcggccctacgttacgttccgggcgggggaccaggggtcggaggaggagacgaacgtggtggctgccaccgagtcgtgttcttcacgttccttcccgctactctacgtactagtacgg

SEQ ID NO: 23310 - DNA, 714 bp, Homo sapiens
  misc_feature: GYAE6OF01BJ19X.24.35.D02.1.454.CMB.1.raw
  modified_base (323)..(323): a, c, t, g, unknown or other
  misc_feature (323)..(323): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccaccctctcctgcgagggccagccggagtgttagtaagtacttaggctggtaccaacagaaacctggaccaggcctcccgaggcctcctcatctatgatcgtcctaccgaacgngggtccacgtcggcccgtccccgcgtaggttcaggtcggacgtagggtcgggtcgtagggaactacgtaccttcacttccgtaccgaccgtcgagccaacggtcccgtaaggacgtccgttaggtaacgtttacgtttttcggtaccggttttaactacgttcgtacgacggtaccgtacgggtcccgtttcccggccgttccgggtacccgttaccgtttaaccgggttccggggaccggggggtaaccgtagggggtacgggaagggtacgggtaacggaacggtaacggtcggtacgggcgtacgaccgtaccgtacgttccgttacgttccttccgtaccgttcccgttaccccgacttacttaccgtacgtaaaccgtgttaacgg

SEQ ID NO: 23311 - DNA, 557 bp, Homo sapiens
  misc_feature: GYAE6OF01CA5KA.24.35.D02.1.454.CMB.1.raw
  modified_base (199)..(199): a, c, t, g, unknown or other
  misc_feature (199)..(199): n is a, c, g, or t
  modified_base (308)..(308): a, c, t, g, unknown or other
  misc_feature (308)..(308): n is a, c, g, or t
  modified_base (375)..(375): a, c, t, g, unknown or other
  misc_feature (375)..(375): n is a, c, g, or t
  modified_base (500)..(500): a, c, t, g, unknown or other
  misc_feature (500)..(500): n is a, c, g, or t
  modified_base (543)..(543): a, c, t, g, unknown or other
  misc_feature (543)..(543): n is a, c, g, or t
  modified_base (551)..(551): a, c, t, g, unknown or other
  misc_feature (551)..(551): n is a, c, g, or t
tcagactactatgtcacgaccggtgctcgatttagcacacgatagttgggtttggggaggaactgctcagttaggacccagagggaaccatggaagccccagctcagcttctcttcctcctgctactctggctcccagagaccaccggagaaattgtgttgacacagtctccaggcaccctgtctttgctccagggganagacgtccaccctctcctgacgagggccagccggagtgtttagtaagtacttaggcctggtaaccaacagaaacctggccaggctccaggctcctcatctatgatgtcnccaacaggtcactggctcccgcaggttcagtggcagtgggtctggacagacttcacttcgcaccgtnagcagcctagacgcctagaagtattttgacggtttactacttcgtcagccagccgtttccgccgttcggccgtcgtaacgttttcgggccggggggaccacggggtggaggacgaggacgaacgngtcgcgtgccgtacagtctgttctctactcgttcccgctactntcgaactntaacgg

SEQ ID NO: 23312 - DNA, 675 bp, Homo sapiens
  misc_feature: GYAE6OF01B40QM.24.35.D02.1.454.CMB.1.raw
  modified_base (202)..(202): a, c, t, g, unknown or other
  misc_feature (202)..(202): n is a, c, g, or t
  modified_base (648)..(648): a, c, t, g, unknown or other
  misc_feature (648)..(648): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctccagagaccaccggagaaattgtgttgacacagtctccaggcaccctgtctttgtctccgagggganagacgcccaccctctcctgcgacgggccaggccggagtgttagtaagtacgttaggctcggtaaccaacgaacgaaaccgtcggaccaacggcctcccgaggcctcctacatctatgaaatcgtacctaccgaacgtagggtccacgtcggcccgttccccgccgtacggttcaggtcggactagggtggtcgtagggacacgtacttcactctaccgaccgtcgacgcgacgaccgtagcgtccgtagtaacgttagttttcggtacgtttactacgttcgtacgtacgtcgtacgtccggtttcccggccgtcgggcccgttaccgttaacgggttccggggaccggggggtaccgagggggttcgggaacggtagggacggaacggtacgtggtcgcggtcgccgtaccgtacgtcgttcgtccttcgaccttccgttccccnctacgttacacgtaacgtagttaacgg

SEQ ID NO: 23313 - DNA, 597 bp, Homo sapiens
  misc_feature: GYAE6OF01C8G14.24.35.D02.1.454.CMB.1.raw
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (543)..(543): a, c, t, g, unknown or other
  misc_feature (543)..(543): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccaggccggagtgttagtaagtacttaggctggtaaccaanagaaacctggccaggctcccaggctcctnatctatgatgtcctaccaacgngggtcacgtggccgtcccgcgtaggttcaggtgcaggtggtctgggacagacttcactctcaccgtcagcagcctagacgtcctagtaagtagttttgtacggtttactacttgtctagctacgtccgttccgccgtcggcccgtacgttaaccggtttccggggccggggggaaccgtagggggtacggaggagggacggacgtaacgtggtggccgtagccacgtntcgttcgttcttctacttcccgttcccgtcctacttcgtacgaactgttaacgg

SEQ ID NO: 23314 - DNA, 641 bp, Homo sapiens
  misc_feature: GYAE6OF01E41AZ.24.35.D02.1.454.CMB.1.raw
  modified_base (313)..(313): a, c, t, g, unknown or other
  misc_feature (313)..(313): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtctttgtctccgaggggagagagcccaccctctcctgcagggccagccggagtgttagtaagtacttaggctggtaccaacagaaacctggccaggctcccaggctcctcatctatgatgtctccaacngggtcactggccgtccccgccaggttcagtcggcaggtgggtcctgggacagaccttcacctctccgaccgtcagcaggccctaggacgcctggaaagtatttttcggacggttttactacgttcgtcagtcgacgtccggttcccgtcccgttcgggcccgtcgttaaccgtttccgggggaccgggggggtaccgagggggttcgggaagggaggtaacgggacggtaacgttggtacgggcgtcggaccgaccgtacgttccgttgttccttccgactttcccgttcccccggtacctacgttcctacgaaccgtagttaacggg

SEQ ID NO: 23315 - DNA, 750 bp, Homo sapiens
  misc_feature: GYAE6OF01C6547.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctcgagggganagacgccaccctctcctgcacgggccaggccggtagttgttagtaagtacgttaggcttaggtaccaacaacgaaaccgttcggaccgaacggtccctacccgaagggtccttaccctacaattaccttaatcgaattcgtacctaccgaacgtcgggtccacgtcgggcccgttcccgccgtaggtttcaggtcggacaggtgggtacctgggaactacggtaccttcaccgttctacgcttacgattccgaacagtaccgtgggaccgaacccgtaagttacgttttacgacgtaacggtttagttacgtttaacgtggtaccgtacgttcgttttcggttttacccgtccctttcctttcccgttacctttagtttaccggtttaacctttaccggtttttccgggtacccggttacgggtttaccgtacgggttaccggtagggtaacgtaacctaccggtaacggtaccgtaacggttcgggtcggtaccgttacgacccgtaactcgttcgttacttcgtttacctcgtttaccccgtccccg

SEQ ID NO: 23316 - DNA, 739 bp, Homo sapiens
  misc_feature: GYAE6OF01EXP2L.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgttctttgtctccgagggganagacgcccaccctctcctgcacgggccaggccggtagtgttaagtaagtacgttaggctacggtaccaacgagaaacctggaccacggcctcccgaggcctcctcatctatgtattcgtcctaccgaacgtacgggtccacggtcggcccgtccccgacgtaggttcgaggtcggacgtagggtcggtcgtgggacctaggtacttcgactctaccgaccgtcacgcacgtcctaggacgtaccgtagtaacgttacgtttcggtacgtttacgtacgtcgtacgtacgtacgtacggtccgttacccggtccgtccgggtacccgttaccgttaacccgggtttccgggggaccgggggtaaccggtagggggtacgggaacgggtaacggggaacggtaacggtaacggttcgggtaccgggtcgttacggtacccgaccgttacgttccggtttacgttaccgttccgttaccgttccccgtttaccccgtaccttacgttaccgtaaccgtaaacgttacggtttaaccggg

SEQ ID NO: 23317 - DNA, 697 bp, Homo sapiens
  misc_feature: GYAE6OF01BKMPF.24.35.D02.1.454.CMB.1.raw
  modified_base (204)..(204): a, c, t, g, unknown or other
  misc_feature (204)..(204): n is a, c, g, or t
  modified_base (421)..(421): a, c, t, g, unknown or other
  misc_feature (421)..(421): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccacggagaaattgtgttgacacagtctccaggccacccttgtctttgtctccgaggggganagcgcccaccctctccgtgcagggccaggccggagttgttaagtaacgtacgttaggctaggtaaccaaacacgtaaaccgtggaccaggtcctacccgaggccttcccgtcctctatcgcttcgtcctccaccgcgggtcccctgggtccgtcccacggtccgtaggtttcggtgggcgggttggtctgggactagtctttcacgttctacctacntcgacgcgtaccctccgagttccagtaacgttcttttcgtctttaccgttttactttcttcgtacctaactacgttagtcggttacgtacgttcggtcccttacccgttacgttacggttttcggaacccgtacggggaacctaaacgtcgggacgtaacgtacccgaaacgtacggtacgtaggtaccgtcgaacccgaccgttaacgtcgttacgttacctttctaccgtttccctacccgtcctacgttacgtaactaacgttacgttaacgg

SEQ ID NO: 23318 - DNA, 632 bp, Homo sapiens
  misc_feature: GYAE6OF01BYI0P.24.35.D02.1.454.CMB.1.raw
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctccagccatcaccggaggaattgtgttgacgcagtctcaggcaccctgtctttgtctccgaggggagagacgcccaccctcgtcctcgcgacgggccagtcagagtgttagcagcagctacttacgcctggtaccagcaagaacctggacctggcctccgaggcctcctacattctagtcggtcgccgtaccaccgacgggcccacggtcgggccgtacgccggacgtacgggttcagggtcgcgtaggtggtcgttagggacagtcttcntctcatctacncganagacgtgacgaccgaagtactttcgngtacgtagttattacgtcgtcgtacgttcgttacggtttccgttacccgttcgttacccgttaccgttacgtttcgtttaaccgttcgttttaccggaccggttacgggttccgtacgggtccggtaggtaacgtacgttacgaaacggtacgtaggttcggcggttaccttcgccgtacctaccg

SEQ ID NO: 23319 - DNA, 596 bp, Homo sapiens
  misc_feature: GYAE6OF01BXH2D.24.35.D02.1.454.CMB.1.raw
  modified_base (262)..(262): a, c, t, g, unknown or other
  misc_feature (262)..(262): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaanagaaacctggccaggctcccaggctcctcatctatgatcgtctaccaacgtagggtccacgtcggccgtccccgcgtaggttcaggtcggacaggtcgggtcgtgggacagtacttcacttctccgaccgtcacgcagtcctagacgcctagaacgttgttttacgtcggtttactacgtgtacagcctagtccgttccgcgtcggcctcgttaacggttccggggcggggtaaccgtggggtggaggaggacgaacgacgttggcggcgtcgaccgtacgagttcgtgtcttcacgttcccttcccgactacgtactacgtaactgttaacgg

SEQ ID NO: 23320 - DNA, 751 bp, Homo sapiens
  misc_feature: GYAE6OF01BDR5T.24.35.D02.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccagccggagtgttagtaagtacttaggctggtaccaacagaacctggccaggctcccaggctcctcatctatgatgtctccaacngggtcacgtggccgtcccgcaggttcagtggcaggtggtctgggacaggtacttcgactctaccgaccgtcgacgccggtacctaaggacgtcccgtaggtaacgttacgtttttcggaccggtttttaaccttacgttacggtaccgtaacggtacgtaaccgggtcccggtttcccggtcccgttccgggtccccggtaccgttttaaacccgggttttccgggggacccgggggggtaacccgtaagggggttacgggacggggaacggggtaaccggtaaccggtaaaccggttgggtacgggtaccgttaccgggaccgttaaccccgtaagttcccgttacggttacccttttaccgtaacccgtttccccgtttacccccgttacccgtaccgtttaccgttaaccggaaacccttaacgttacggttaaccgg

SEQ ID NO: 23321 - DNA, 615 bp, Homo sapiens
  misc_feature: GYAE6OF01E35OK.24.35.D02.1.454.CMB.1.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccagccggagtgttagtaagtacttaggctggtaccaacagaaacctggccaggcctcccaggctcctnatctatgatcgtctccaacgngggtcacgttgggccgtccccgcaggttcaggtgcagtgggtctggacngacttcactctcaccgtcacgcacgcctagacgcctagaagtattttcgacggttttactacgtgttcagtcgacgtccgttccgccgttcggcccgtacgttaaccggtttccggggacggggggtaacctagggggtcgggaaggtacgggaacggacggtaacgtggtcgggctggcctaacctacgttcgttagttccttcgtacgttcccgttaccccgtcctacttccgtagtaactcgttaacgg

SEQ ID NO: 23322 - DNA, 620 bp, Homo sapiens
  misc_feature: GYAE6OF01BNYK4.24.35.D02.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttaagtaagtacttaggctggtaaccaacagaaacctggaccaggcctcccaggtctcctnatctatgattgtcctccaacgtgggtcacgtcggcccgtccccgctaggtttcaggttcggaccgtagggtcgggtcgtgggacagtaccttcactctcaccgtcacgcagccgtagacgtcctaggaacgttcgttttggtacgttttactacttgtacgaagtcgtacgtccgttccgccgtcggccctacgttaaccggttcggggacggggacgaggggtaggacggtacggagtaccgagtcgcggtctagcctacgtagtcgttgtccttcaccgttcccgttcccgtactacgttaccgacgtaaacgtgttaacgg

SEQ ID NO: 23323 - DNA, 664 bp, Homo sapiens
  misc_feature: GYAE6OF01CDX6P.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgcgacggccaggccggagtgttagtaagtacgttaggctggtaaccaagaacgaaccgtggaccaggtcctacccgaggcctccctacactctatgtatcgtacctaccaagtcggtccacgtcggcccgtccccggcgtaggttcgaggtcggacgtagggtcgggtcgtagggactacgtcttccgacttcgtaccgaccgtacacgaccgacgtcctaaggacgcccgttagtaacgtttacgttttcggtaccggtttactacgttgtacgtacgcgtacgtcccgttccgccgtcggcccgtacgtttaccgggttccggggaccggggtacgagggtcgggaggtagggacgaacgtacgtggcggcgtcgccgtactcgttcgtacgttcttcctaccgttccgtccccgtactacgtacctacgtaactagttacgg

SEQ ID NO: 23324 - DNA, 592 bp, Homo sapiens
  misc_feature: GYAE6OF01AZOQS.24.35.D02.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
tcagactactatgtcacgaccggtgctcgatttagcacacgatagttgggtttgggggaggaactgctcagttaggacccagagggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatggttggcagcaacttagcctggtaccagcagaacctggccaggcctccaggctccncctctatgcctgtcctccaccgacgggtcccctggtcgtccccagcctaggttcgttgggcggttgggtctggggactagtacgtttcacgttctccgacctatccgaggccggtcctccgagtcgtagaagttgttttcgcttactttattctacgtctaactctagtcgtagcttcggtccttccgtaacttcgtttcgggccgtaacggggtacctaacggtggaacgtactacgaaacgtacgtagtcggactcggacctactacttcgtgttacttctacttcccgttcccgtacc

SEQ ID NO: 23325 - DNA, 648 bp, Homo sapiens
  misc_feature: GYAE6OF01CKNGO.24.35.D02.1.454.CMB.1.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccgagggganagacgcccaccctctcctgcgagggccagccggagtgttagtaagtcttaggctggtaccaanagaaacctggcctggctccgaggctcctcgatctatggtgccgtcaccgaggccacgtgcgtcgcgacaggtcagtggcagtggctttgggacagtactcacgtctcgatcactcgacagacgtgggaacgtacccgtaagtacttttgacgtagttcgtaattacgtagtactagtcgtttggtttccgtcccgttcttccccgttcttacgttcgttaaccttacgttttcggaccgttacgggttcccgtaagggtccgttagggtaactacgtacgtaaacggccggtaaacgttcgggtaggtaccgttcggtacccgtaacccgttaacgtcccgtttcggttacttttacccgtacgtttcccccggtttaccccgg

SEQ ID NO: 23326 - DNA, 669 bp, Homo sapiens
  misc_feature: GYAE6OF01BYX3Q.24.35.D02.1.454.CMB.1.raw
  modified_base (201)..(201): a, c, t, g, unknown or other
  misc_feature (201)..(201): n is a, c, g, or t
  modified_base (375)..(375): a, c, t, g, unknown or other
  misc_feature (375)..(375): n is a, c, g, or t
  modified_base (421)..(421): a, c, t, g, unknown or other
  misc_feature (421)..(421): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagacgcccaccctctcctgcagggccaggccggagtgttagtaagtacttaggctggtaccaacagaaacctggccaggcctcccaggcctcctcatctatgatcgtctaccaacgagggtcacgtcggccgtccccgctaggttcaggtcggcgtaggtcgggtctagggacnggtacttcacttctcaccgtcagcagcctagacgtcctagtaagtnttttggcgtttactacgtgtcagtcgacgtccgttccgccgtcggcccgtacgttaaccgggtttccggggaccggggggaccgtagggggtcgggaagggtacgggtaacggaaccggtaacggttcgggtcgggtccgtacggaccgtacccgtacgtttccgttacgttacccgtttccgtaaccgtttccccgttaccccgtacccttaacgttacctaacggtaaaccgttaagttaaccggg

SEQ ID NO: 23327 - DNA, 603 bp, Homo sapiens
  misc_feature: GYAE6OF01D0UZ5.24.35.D02.1.454.CMB.1.raw
  modified_base (446)..(446): a, c, t, g, unknown or other
  misc_feature (446)..(446): n is a, c, g, or t
  modified_base (565)..(565): a, c, t, g, unknown or other
  misc_feature (565)..(565): n is a, c, g, or t
  modified_base (576)..(576): a, c, t, g, unknown or other
  misc_feature (576)..(576): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccaccctctccctgcgagggccaggccggtagtgttaagtaagtacttaggctaggtaccaacagaaacctggccaggcctcccgaggcctcctcatctatgattcgtctaccaagagggtccacggtcggcccgtccccggactacggtttccaggtcggcgtagggttcgggtcgtcgggacagtaccttcacctctaccaccgtcacgcacgcctaagacgtcctagtaacgttntttacggtacggtttactacgtgtacagccgtcgtccgttccgccgtcggacccgtcgttaaccggttccggggacggggacgtgggtacggagaggacgacgagtgcggctgccactntcgtagtctcncttcctacccgctagtcagactgtacg

SEQ ID NO: 23328 - DNA, 639 bp, Homo sapiens
  misc_feature: GYAE6OF01DPXYV.24.35.D02.1.454.CMB.1.raw
  modified_base (205)..(205): a, c, t, g, unknown or other
  misc_feature (205)..(205): n is a, c, g, or t
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (383)..(383): a, c, t, g, unknown or other
  misc_feature (383)..(383): n is a, c, g, or t
tcagactactatgtcacgaccggtgctcgatttagcacacgatagttgggtttgggggaggaactgctcagttaggacccagagggaaccatggaagccccagctcagcttctcttcctcctcgcctactctggctcccagacgaccaccggagaaattgtgttgacacagtctccaggcaccctgtctttgtctccgagggganagagccacctctcctgcagggccagccggagtgttagtaagtacttaggctggtaccaanagaaacctggccaggcctcccaggcctcctnatctatgatgtctaccaagngggtcacgtcggccgtcccgcaggttcagtgcaggtggtctggacagtacttcactctcgaccgtanagccaggcccttagacgtccgtagtaagtagttttcggtacggttttaacttacgttgtacgagtccgtacgtcgttcccggtccgtcggtccgtaccgttaacggtttccggggacggggggtaaccgtaggggtcggaaggtagggaacggtacggtaacggtggtacggcgttcggacctaccgtaacgttcgtacggttctttacgacgtttcccgttaccccggtcttactccttaacgactagttaacgg

SEQ ID NO: 23329 - DNA, 793 bp, Homo sapiens
  misc_feature: GYAE6OF01EELY4.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccgggagaaattgtgttgacacagtctccaggcaccctgtctttgtctccgaggggagagacgcccaccctctcctgcagggccaggccggagtgttagtaagtacttaggctaggtaccaacagaaacctggaccaggctcccgaggcctcctcatctaatgattcgtcctaccaacgtacggggtccacgtcgggcccgtcccccggcgtacgggtttcaggttcggacgtaggtcgggtcgtgggactaggtaccttcgacttcctaccaccgtcacgccgacggtccttaaggacgtcccgtaggtaaacgttacgtttttacggaccggtttttactacgttcggtaccgtacggtaccgtacgggtcccggtttacccggccgttaccgggtaccccgttaccggttttaaacccgggttttcccggggggacccggggggggtaacccggtaagggggggttacggggaacggggtaacggggtaacgggtaaccggtaacgggttcgggtacggggtaccgttacgggacccgtaacccgttagtttcccggttacgtttacccgtttaccgtaccgtttccccgttacccccgggtcctacgtttacccgtaacggttaaaccgtaggtttaaaccggg

SEQ ID NO: 23330 - DNA, 612 bp, Homo sapiens
  misc_feature: GYAE6OF01BG4JY.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagtcagagtgtagcagcagctactagcctggtaccagacagaaacctggcctggcctccacggtctcctcatctatggtcgcgtccaccgacgggccacgtggccgtcgcggacgtacggttccagtggactaggtcggtacgtttcgggacacgtacttacacgttctacatcaatcgactagacgtcggacgacccggtaagtactttgacgtagttcgtaagtttacgtgtacctagtcgtttcgtttccggtcccttctcccgttcttacttacgttacttaccgttttcggacccgttcgggttccgtacggtccgtaggtacgtacgtacgaacggtaccgtaaacgttcgggtacggtcgtagacctaccgtcgttaccg

SEQ ID NO: 23331 - DNA, 662 bp, Homo sapiens
  misc_feature: GYAE6OF01E3R54.24.35.D02.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcagggccagccggagtgttagtagtactaggctggtaccaanagaaacctgccaggctcccgaggcctcctcatctatgatcgtcctccaacgagggtcacgtcggccgtccccgctaggttcaggtggcgtaggtcgggtcgtcgggacaggtacttcacctcctccgaccgtcacgcacgcctaggacgtccgtaggtaacgttagttttcggtacggttttaactacgttgtacagtaccgtacggtcccgttcccgccgttcggcccgtacgtttaaccgggtttccgggggccggggggtaccgagggggttggaacgggtagggaacggaccggtaacggtgggtcggacgtcggacctaccgtagttccgttacgttccttctaccgttcccgttccccgaccgtattacccgtacgtaaacgtaggtttaacg

SEQ ID NO: 23332 - DNA, 559 bp, Homo sapiens
  misc_feature: GYAE6OF01EJLW2.24.35.D02.1.454.CMB.1.raw
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
  modified_base (550)..(550): a, c, t, g, unknown or other
  misc_feature (550)..(550): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagtcagagtgttagcagcagctacttagcctggtaccagcagaacctgcctggctccaggctcctcatctatgggtcgcgtccaccgagggccacgtggcgtcgcggactaggtcagtggcaggtggctttgggactagacttcgacttcncatcatcgacgagacgtggacgcccgtaagtactttgctagttgttattacgtcgtctagtcttcgtttcggtcccttcttcccttctattcgttacttacgtttcggccgtagggttcctacggtcgtacggtacgtactacgaacggtaccgtaacgtggtcgcgtgtaccncgtgttccg

SEQ ID NO: 23333 - DNA, 802 bp, Homo sapiens
  misc_feature: GYAE6OF01D23BW.24.35.D02.1.454.CMB.1.raw
  modified_base (228)..(228): a, c, t, g, unknown or other
  misc_feature (228)..(228): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctccagacgaccgaccggaagtaaattgtgttgacacagtcctccaggcctacccttgtctttgtctccgaggggagagacgcccacctctccgngcgaggccagtgagtagtgtggcagactaactacgccgtacggaccagacaacgaaaccgtggaccgacggccctccgaggtccctacctactattcctaatgacttcgtaccctaccggaacgtaccgggtcctaccggtcggtccccggtaccccgtaccgttacggggttactacggtcggtacggtagggttccggggttacggacgggaaccgttacgtaacccgtttcaccgtttaccgaccgtaccgtacgtaacgaccgtaacggtccgtaacggaccgtaccgttaggtaaacgtttacggtttaccgtaaccggtttactaaccgtcggtactacggtcccgtacggtttacccggtcccgtacgggttacccgggaccgtttaccgggtttaaccgggggttccgggggaccgggggttaaccggagggggttaacgggaacgggacgggtaaccggaaccggttcggttacggggcggttaccgtaccggtacctaaccgtcgttacccgttcggttaccttaccggtaccttacccccgggtttcccagtttagtaacccg

SEQ ID NO: 23334 - DNA, 555 bp, Homo sapiens
  misc_feature: GYAE6OF01DUE3K.24.35.D02.1.454.CMB.1.raw
  modified_base (202)..(202): a, c, t, g, unknown or other
  misc_feature (202)..(202): n is a, c, g, or t
  modified_base (531)..(531): a, c, t, g, unknown or other
  misc_feature (531)..(531): n is a, c, g, or t
  modified_base (545)..(545): a, c, t, g, unknown or other
  misc_feature (545)..(545): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggcaccctgtctttgtctccagggganagagcccaccctctcctgcagggccagccggagtgttagtaagtacttaggctggtaccaacgagaaacctggcctggcctcccaggcctcctcatctagtggtcgccgtccaccgagggccacgtggccgtcgcggacaggttcaggtggcagtcggtctttgggactagaccttcactcgtcatcatcgaacagacgtggacgacccgtaagtagtttgcgtagttagtattactgtcgtagtcttgtttcgtccctcgtcctctatgtactcgtttcgccgtcggttccaggcgtggagtactcgaagtcgacgtgtgctcgcacncgtctgttcttctnttccgtcccg

SEQ ID NO: 23335 - DNA, 648 bp, Homo sapiens
  misc_feature: GYAE6OF01BFYB5.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagcccaccctctcctgcagggccagtgagaatgttggcagcaacttagcctggtaccagcaagaaacctggccaggcctccgaggcctcctcctctatgctgtcctaccgaccgacgggtcccctggtctcccagtccgtaggtttcgttgggcggtgggtctggggactagtactttcacttctcaacctatccgacggccggtccctaccagtctagtaagttattttcgacttacttttatttctacgttacaactacttagtggtactacgtcggtacccttccgtacgttacgtttcgggacccgtaaggggtaaccctaaaggtcggaagtacgtaacgtaaaacggtaacgttggtaccggtctacggacctaaccgtcgttccgttacggttacctttaccgtacctttcccgttaccccgtccttacgttacccg

SEQ ID NO: 23336 - DNA, 230 bp, Homo sapiens
  misc_feature: GYAE6OF01CL5AC.24.35.D02.1.454.CMB.1.raw
  modified_base (197)..(197): a, c, t, g, unknown or other
  misc_feature (197)..(197): n is a, c, g, or t
  modified_base (215)..(215): a, c, t, g, unknown or other
  misc_feature (215)..(215): n is a, c, g, or t
  modified_base (221)..(230): a, c, t, g, unknown or other
  misc_feature (221)..(230): n is a, c, g, or t
tcagactactatgtcacgaccggtgctcgatttagcacacgatagttgggtttggggggaagaggaagactggcggtcctcccaggagttcaggtgctgggcaccgttgggcacgggggaggtgtgtcacaagatttgggctctgggcacagcggccctgggctgcctggtcaaggactacttccacatagtagtcngagcgggctggcaaggcncatagnnnnnnnnnn

SEQ ID NO: 23337 - DNA, 744 bp, Homo sapiens
  misc_feature: GYAE6OF01D4ZFN.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgttctttgtctccgagggganagacgcccaccctctcctgcagggccagtcagagtgtagcagcagtctacttagcctggtaccagacaacgaacctcggcctgggcctccgaggcctcctcatctagtcggtcgcgtcccaccgacgggcctacgtcggaccgtcggacggacgtacggttacgaggttcggactagggtcggtacgttttaggggaacctacggtaccctttaccgacctttccgtacaacgttaccgtacgttacggaaccgtaaggtaaccggtagggaacccggtaccccggttaaagtttaacgttttcggacggttaaggtttagtttaacgtttacgttcggtacgttacggttcgttttcggtttttcccgggtccccgttttaccgttccctttaccgtttagtttacccgtttacctttaccggttttccgggaccggtttaccggggtttaccgacgggttcgttaacggggtaacttacgtacggtaacggtaccgtacgttacggtcgggtaccttacggacctaccgttagttcccg

SEQ ID NO: 23338 - DNA, 563 bp, Homo sapiens
  misc_feature: GYAE6OF01BB4UG.24.35.D02.1.454.CMB.1.raw
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagataccactggagaagtagtcagtgacgcagtcctccagcccacctgtctgtntctcgaagggaacncgccaccctctcctgcgagggccaggtgagagtgtgcagctaattgctggtatcaaanagaaccgtgccaggcctaccgaggtctcctcatcgtntaggtactactccgagcgaggccacgtgtccgccagccgtaggttcgagtcggcagggttcggtcgtaggactaggtacgtcactcctacacgtataccgagtcctaacgtctacggctaaggtctagaagtttactttcgacgtttatttaacgttcacgctagctacgactacacggttgacgttcgaccgtactgtaccggttgacggacggtacgaggtgagtacaccgaaaggacttggacgtagtccagtcccgta

SEQ ID NO: 23339 - DNA, 580 bp, Homo sapiens
  misc_feature: GYAE6OF01AXGCE.24.35.D02.1.454.CMB.1.raw
  modified_base (263)..(263): a, c, t, g, unknown or other
  misc_feature (263)..(263): n is a, c, g, or t
  modified_base (312)..(312): a, c, t, g, unknown or other
  misc_feature (312)..(312): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccaggccggagtgttagtaagtacttaggctggtaccaanagaaacctggccaggctcccgaggcctcctcatctatgatgtctccaangggtcacgtggcctcccgctaggttcaggtcggcaggtgggtctgggacaggtacttcactctcacgtcagcagtcctagacgcctgaagtattttgacggtttactacgttgtcagcacgtccgttccgcctcggcccgtcgttaaccggtttcggggccgggggtaccgagggggtcggagggtacgggaagacggaacgtggtggcgtgccaccgtacgtcgtgttcttcgacttccttccccgctactcctagaacgtgtaacg

SEQ ID NO: 23340 - DNA, 579 bp, Homo sapiens
  misc_feature: GYAE6OF01BW47D.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagataccactggagaagtagtcatgacgcagtctccagccaccctgtctgtgtctccgagggaaancgccaccctctcctgcagggccagtgagatgttggcagcaacttagcctggtaccagcaagaaacctggccaggcctccaggcctcctcctctatcgctgtcctccgagccgacgggcctacgtggtcgtcccagccgtaggttcaggtcggacgtaggttcgggtcgtagggactaggtacgttcacgttcctcaaccatcgagctagtctgctagtctagagtgtttgctagttttatacgtcgtaccagcacgacagtacgtcgactcggcccgtctaccgtacggttccgggaccgggtaacgggaccgtaaggggtagacgtacgtaaccgaaacggtacgtcggtaggaccttacgaccgaccgttaacg

SEQ ID NO: 23341 - DNA, 554 bp, Homo sapiens
  misc_feature: GYAE6OF01CE53Y.24.35.D02.1.454.CMB.1.raw
  modified_base (214)..(214): a, c, t, g, unknown or other
  misc_feature (214)..(214): n is a, c, g, or t
  modified_base (398)..(398): a, c, t, g, unknown or other
  misc_feature (398)..(398): n is a, c, g, or t
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggcacctgtctttgtctccagggggagagagccaccctntcctgcaggggccagccggagtgttagtaagtacttaggctggtaccaacagaaacctggccaggcctcccaggctcctcatctatgatcgtctaccaacgagggtcacgtggccgtccccgcctaggttccaggtggctaggtgggtctgggacagacttcactctcacgtcagcagcatagngcctagaagtattttgacggtttactacttgtcagcacgtccgttccgccgtcggccgtcgttaaccgtttcggggcgggggaccgaggggtggaggaggagacggatggnggctgcacgntctgtcttcacttccgtcccgctatcctgaactag

SEQ ID NO: 23342 - DNA, 612 bp, Homo sapiens
  misc_feature: GYAE6OF01APAG7.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccaggccggagtgttagtaagtacttaggctggtaccaacagaaacctggccaggcctcccaggcctcctcatctatgatgtctccaacagggtcacgtcggccgtccccgctaggttcagtgacgaggtgggtctgggacagtacttcactctcaccgtcacgcacgcctagacgcctagtaagtattttcggtacggttttattacgtgtcacgtcaccgtgaactacgtcggccctacgtttccggcccgtcgggacccaggtacctcgggaacctacgtacccgaaacgacgtggtcggccttacgacctacctacgttccttcgttcctttaccgtacctttcccgtttacccccgacctagttaccctaggtaaccttaacg

SEQ ID NO: 23343 - DNA, 577 bp, Homo sapiens
  misc_feature: GYAE6OF01BGHH1.24.35.D02.1.454.CMB.1.raw
  modified_base (203)..(203): a, c, t, g, unknown or other
  misc_feature (203)..(203): n is a, c, g, or t
  modified_base (428)..(428): a, c, t, g, unknown or other
  misc_feature (428)..(428): n is a, c, g, or t
  modified_base (566)..(566): a, c, t, g, unknown or other
  misc_feature (566)..(566): n is a, c, g, or t
  modified_base (572)..(572): a, c, t, g, unknown or other
  misc_feature (572)..(572): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggaagttgttagcctggtatcaacacaaacatggccaggcctcccggctcctcatctatcgatcgcactccaaagtacgggcctaacgtggccaagtccccaaggtaccacggtttcaaggttggcaaggttgggtctggggacaggacttcactctcaccatcagcaagtgtagagtccctaggtaagtnttttggaccttaaggttttaacttactacggtactaggtaccacccgttagaacctaacgtcgtaccctacgtttcggccctgggacccagcgtaggacctacgtccgaacgtatcggtcggctgactacctattctntcgttntaccg

SEQ ID NO: 23344 - DNA, 710 bp, Homo sapiens
  misc_feature: GYAE6OF01BVF7I.24.35.D02.1.454.CMB.1.raw
  modified_base (195)..(195): a, c, t, g, unknown or other
  misc_feature (195)..(195): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccacggagaattgtgttgacacagtctcaggcacctgtctttgctcgagggganagacgcccacctctcctgcagggccaggccggagtgttaagtaacgtacgttaggctggtaaccaacagaacctggccaggcctcccgaggcctcctcatctatgatcgtcctaccgaacgtagggtccacgtcggcccgtccccgcgtaggttcgaggtcggcgtacggtgggtactgggacacggtactccactctaccaccgtcacgtcagtccctaaggctaccgtaggtaacgtttagttttacggtaccggttttactacgttcgtaccgtagtacctacggtacccggttcggccctttagggccccgttacgttaacgggtttccgggggaccggggtaaccgggtaggggtacggtaaggggacgggtaacggtaacggtaacccggtgggcccggtacgtaccgggacctaaccggtacgttcccgtttggttaccttaccgacccgttttccccgacccggttaccctaacgttaccgttagtaaacccggtgttaaaccgggg

SEQ ID NO: 23345 - DNA, 684 bp, Homo sapiens
  misc_feature: GYAE6OF01C56E0.24.35.D02.1.454.CMB.1.raw
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggccaccctgtctttgtctccgaaggggaaancgcccaccctctcctgcagggccagtgacaagttgttaaggtaagttgttagccttaggtactcaaacaacaaaacngtcggaccacggtccctccccggcttacctcattctatgatcgacaactaccgaaagtcgggcctacgtggacctactcccgagtacgtaggttacgaggttcggcgtaggttcggggtcgtacggggactaacggtcttacgacttccgtaccaccgtatcgagtacgtaggtacgtaacggacgtaccgtaaggtaacgtttacgttttacgggttaccgttttacgtacgttcggtacgtacgtccgtacggtccgttaccgccgtcggtcccgtaccggttacgggttccggggacgggggtaccgtaggggtacgggaggacggtacggacgtaggtggtcggtcgtgaccgtacgtagttcgtcgttcctacgtacttcccgtcccgtcgtacg

SEQ ID NO: 23346 - DNA, 557 bp, Homo sapiens
  misc_feature: GYAE6OF01EUMD9.24.35.D02.1.454.CMB.1.raw
  modified_base (204)..(204): a, c, t, g, unknown or other
  misc_feature (204)..(204): n is a, c, g, or t
tcagactactatgtcacgaccggtgctcgatttagcacacgatagttgggtttggggggaggaactgctcagttaggacccagagggaaccatggaagccccagctcagcttctcttcctcctgctactctggctcccagagaccaccggagaaattgtgttgacacagtctccaggcaccctgttctttgtctccgagggganagagcccaccctctcctgcagggccaggccggagtgttagtaagtcttaggctggtaccaacagaaaaccgtggccaggcctcccgacggcctcctcatctatgtatcgtctaccaacgaggtcaactgggcgttcccccgccagggtttccagtggcaggtgggtctgggacagacttcactctcaccgtcagcagcctagagccttgaagattttgcggtttactactgttcagcagcgttccgcctggccgtctaaccgtttcgggcggggggaccgagggtgggaggaggaggacggaacgtggtggcgtgcaccgatctcgtcttctatccttcccgccatctgaaca

SEQ ID NO: 23347 - DNA, 624 bp, Homo sapiens
  misc_feature: GYAE6OF01BEV6X.24.35.D02.1.454.CMB.1.raw
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccgggagaaattgtgttgacacagtctccaggcaccctgtctttgtctccgaggggagagagcccaccctctcctgcgagggccagccggagtgttagtaagtacttaggctggtaccaanagaaacctggccaggcctcccaggctcctcatctatgatgtctaccaacgngggtccacgtcggccgtccccgctaggttcaggtggcgtaggtgggtctgggacagacttcactctcactgtcagcagcctagcgctagtagtagttttcggtacggttttactacgtgtacgacgtcgtacgtccgttcccgccgttcggcccgtacgttaaccgggtttcggggccggggggtaccgtacggggtagggaaggacgggacggaacggtaacgtggtcggcgtacggactaccgtacgttcgttcgttccttaccgtacttcccgttcccaccttattccgtaagtaaccgtaacg

SEQ ID NO: 23348 - DNA, 796 bp, Homo sapiens
  misc_feature: GYAE6OF01EE7UM.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgccaccctctcctgcagggccaggccggagtgttagtaagtacttaggctggtaccaacagaaacctggccaggctcccaggcctcctcatctatgatcgtctaccaagacggggtccacgtcgggccgttcccccgcgtaaggtttccaggttcgggaccgtaggttcggggtcctggggaacacggtacctttccacttcctaccaacccggtcacggcctaacggcccttaaggacggtcccttaggtaacggttacgtttttagggaccggtttttaaccttaccgttacgttacgaacggtccgtaacggtccccgggtttacccggcccgttacgggccccggttacgtttaaccgggttttccggggggaccgggggggttaacccgaagggggggttacgggaacggggtaacggggtaaacgggtaaccggtaaaccgggttgggtaccgggtaccggttacgggacccgtaaacccgtaccgtttccggtttcggtttacccgtttcccgtaaccgtttccccgttaccccggttaccccttacgtacccgtttaacggaaacccgttagttaaaccggg

SEQ ID NO: 23349 - DNA, 627 bp, Homo sapiens
  misc_feature: GYAE6OF01BF118.24.35.D02.1.454.CMB.1.raw
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccagggggaaagagccaccctctcctgcagggccagtgagaatgttggcagcaacttagcctggtaccagcagaaacctggccaggcctccaggcctcctcctctatcgctcgtcctccgaccgacgggcccctgggtcgtccccagccgtaggttcggtcggcggtcgggtcgtgggacagtactttcacttccgtcacctatccgacggtcccgggtcccttcccgacggttctaggtaacggttatttttcggaccttacttttaactttcctaggttacctaaactctttagtcgggtctaccgtcggtcccttccggttaccttacggtttcgggcccggtaagggaccctaacggtggacacgtacgaaacgtacgttggcgtctggccacgtacttcgtcgttccttcgtacttcccttcccggtacc

SEQ ID NO: 23350 - DNA, 573 bp, Homo sapiens
  misc_feature: GYAE6OF01EOIRJ.24.35.D02.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (388)..(388): a, c, t, g, unknown or other
  misc_feature (388)..(388): n is a, c, g, or t
  modified_base (412)..(412): a, c, t, g, unknown or other
  misc_feature (412)..(412): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgccaccctctcctgcagggccagccggagtgttaagtaagtacttaggctggtaaccaacagaaacctggccaggcctcccaggcctcctnatctatgatcgtcctaccaacgngggtcacgtcggccgtcccgctaggttcagtcgcgagtcggtctggacagacttcactctcgaccgtnacgcacgcctagacgtctagagtntttgcgttttacactgtcagcacgtcgttccgccgtcggcctcgttacggttcggggacgggggaccagggggtggaggacggtaagaccggtaagtggtcggcgtgccaaccgtgtcgtagttcttcacgttccctcccgactattccagaactagtacg

SEQ ID NO: 23351 - DNA, 650 bp, Homo sapiens
  misc_feature: GYAE6OF01DH5U5.24.35.D02.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (411)..(411): a, c, t, g, unknown or other
  misc_feature (411)..(411): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccgagggganagagcccacctctcctgcagggccaggccggagtgttaagtaagtacttaggctggtaccaacagaaacctggccaaggcctcccgaggcctcctnatctatgattcgtctaccaagacgggtcacgtggcccgtcccgctaggttcagtggcaggtgggctggacagtacttcactcncaccgtnagcagcctagacgtctagaagttnttttcggtacgtttactacgtgacagtcacgtccgttcccgcgttcggtacctacgtttaaccggttcggggacgggggtaaccgtagggggtacggagggtaggaacggaacggtaacgttcgggtcggtaccgtcggacccgtaaccgtcgtttccgttacggtttcctttaccgaccgttttccccgttaccccggtccttaagttcccgttaacgtaaaccgttggtttaaacgg

SEQ ID NO: 23352 - DNA, 871 bp, Homo sapiens
  misc_feature: GYAE6OF01CU8RA.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccgaccggagaaattgtgttgacacagtctccaggccaccctgtctttgctccgagggtanagacgccaccctctcctgcgaggccagccggagttgttagtaagtacgttaggctaggtaaccaacgagaaacctggccaaggtcctacccgaggcctcctagactacgtatgtactcgtacctaccgaagtacggtcacgtcggccgtccccgccgtaggtttcgaggttcggacgtacgggttcgggtaccgttacgggaacgtaacggtaccgttaccgtaaccgttccgttacccgtaaccggttccgaacggtaccgaacggttacccgtttaacggaccggttaacccgtacggttaaacgttacgttttttacggggttaacccggttttaacgtaacccgtttcggtaaccgtaaacgggtccgtaaccggttcccgggtttaccccgtaccggtttacccggggtaccccgtttaacccgggtttttaaaccccgggttttccgggggggtaacccgggggggtacccgtaaagggggggttaacccggggtaacgggtacggggtaaaccggtaaacccgggtaacgggtttcgggtaccgggttacccggtacgacccgttaaccgtacggttcccgttaggtttacccgttaaccgtacgtttccccgtttacccggacccttagttacccgtaacgtaaacgttacggttaacgg

SEQ ID NO: 23353 - DNA, 707 bp, Homo sapiens
  misc_feature: GYAE6OF01AZ5N5.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctcgaggggagagagccaccctctcctgcagggccagccggagtgttagtaagtacttaggctggtaaccaacagaaaccgtggaccaggcctcccgaggcctcctcattctatgatcgtcctaccaacgtagggtccaacgtcggccgtcccccgactaggttcagtcggcgaggtgggttcgtcggacgacgacttcactcctcgaccgtcagccgacgtaccgtagacggcctagaacggttaattttcgggttaccggttttaaccttaacgttacgtacgtacgtaccgtacggttacccggttcccggtcccgtacgggtcccggttaacgtttaacccggtttacggggggtacccggggggaccgaacgggggttagggaacgggaagggtacgggaaaccggtaaccgttagggtcggtgtaccgtcgaacccgtaagttcccgttgttacccttctacgtcccctttaccccggaccctagttaccgtacgtaaacgtacgttaacgg

SEQ ID NO: 23354 - DNA, 608 bp, Homo sapiens
  misc_feature: GYAE6OF01DBSZM.24.35.D02.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcgagggccaggccggagtgttagtaagtcttaggcttaggtaaccaacagaaacctggccaggcctccgaggcctcctnatctagtggtcncgtccaccgagggcccacgtcggcctcccgagccgtaggttcaggtcggctaggtggtctgggacaggtacttcactctacgaccatcacgctagtctgactagtctagtagttagtttgtacgttagtttacttacgtcgacctagactacgacgtacgtagtacgacgtcggccgtccttaccgtacggtttcgggacgggtacgggtacgagggtaggaacgtacgtaaccgtaaacgtacgtcggtaggctcgaccacgtacttcgtacttcttacctcgttcccgtacccg

SEQ ID NO: 23355 - DNA, 679 bp, Homo sapiens
  misc_feature: GYAE6OF01D30C0.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaattgtgttgacacagtctccaggcaccctgtctttgtctccgaggggagagagcccaccctctcctgcacgggccaggccggagtgtaagtaagtactaggcgtgtaccagcaagaactggccgtgcctccgacggctcctcactctagtggtcgccgtccaccggacggccacgtggccggtccggcggacgtacggttctaggtcggcgtggtcgggtcgtttagggactagtaccttcgacttcgtccatacacgtacgaaccgtagacggtcggacgacccgtaagtaagttttcgacgtagttagttaattacgttgtactacgtcggtttcggtttcccggttcccttccgtttacccttccgtttacgttacgttaccgtttacgttttccgggtacccgttacgggttacccgtacggtacggtaggtaccgtacgtaccgaacggtaccgtaacggttcgggtacggtcgtcgtaccgtaccgttacgtacctttcggttccttccgtcgttcccccg

SEQ ID NO: 23356 - DNA, 690 bp, Homo sapiens
  misc_feature: GYAE6OF01A0RU7.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccgaggggagagagcccacccctctccgtgcgagggccagccggagtgttagtaagtcgtaggctggtaccaacgacgaaacctggaccaggcctcccgaggtcctcctcatctatgatcgtctaccgaacgtagggtccacgtcgggcccgtccccggcgtacggttcaggtcggacgtagggtcgggttcgtacgggactacgactttcacttccgtacgaccgtcacgccgacggcctaggacgtcctagtaacgttagtttcggtacgtttacgtacgtacgtacgacgtccgtaacgtccgttaccgccgttcggtacccgtaccgttaaccggtttccggggaccgggggtaaccggtacggggtacggggaacgggtacgggaacgggtaacggtaacgtcgggtaggtcgtacggtaccgaccgtacgtcgttacgttacttcttaccgtcccttaccccgtactacgtacgtacgtaacgtaagttacgg

SEQ ID NO: 23357 - DNA, 675 bp, Homo sapiens
  misc_feature: GYAE6OF01DBSU3.24.35.D02.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggcaccctgtctttgtctccgaggggganagacgcccacccctctcctgcagggccagccggagtgttagtaagtacttaggctggtaccaacacggaaacctggccaggcctcccgaggcctcctcatctangatcgtcctcaacgngggtcacgtcgggcctccccgctaggttcagtggcagggtggtctgggacagtacttcgacctcgtcaccgtcaggcacggcctagacgtcgtagtagttattttcggtacgtttactacttgtcgtagcgtacgtccggttcccgtccgtcggtcccgttaccgtttaaccgggtttccgggggacgggggggtaacccgtagggggttacggggaacgggtacgggaacgggtaaccgggtaacgttgggtacggtcgtacggcccaaccgtagttccgttacggtttccttccgtcctttcccgttacccccgtccttacgttccgtacgaaaccgttcggttaaacgg

SEQ ID NO: 23358 - DNA, 605 bp, Homo sapiens
  misc_feature: GYAE6OF01D2IFB.24.35.D02.1.454.CMB.1.raw
  modified_base (543)..(543): a, c, t, g, unknown or other
  misc_feature (543)..(543): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgcagggccagccggagtgttagtaagtacttaggctggtaccaacacgaaacctggccaggcctcccaggctcctcatctatgatgtctccaacgacgggtcacgtcggccgtccccgcaggttcaggtggcgtaggtgggtcgtgggacagtacttcactctcaccgtcgagcacgcctaggacgtccgtagtaagtacgtttggtacggtttacgttactcgtcgacgcgtacgtccgttccgccgtcggtccgtcgttaacggttcgggcgggggacgaggggtacgggaggacggaggacggaacgtggtcgcggggtcnccgacctacgtcgttgttccttcctactcccgttcccgtcctactctacgtaacgtgtacgg

SEQ ID NO: 23359 - DNA, 861 bp, Homo sapiens
  misc_feature: GYAE6OF01DMQN9.24.35.D02.1.454.CMB.1.raw
  modified_base (214)..(214): a, c, t, g, unknown or other
  misc_feature (214)..(214): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccggaagtaaattgtgttgacacagtctccgaggccacccttgttctttgtcctaccgaaggggaaancgccctacctctcctgcgaggccagtgagtaagttggttcggacacgtactaacgttcgccgttacggtaccaggtacaaacggaaacccgtcggaccgaacgggtccctacccgaggtccctccgttcctactacgttcgcctcgttcccaccgaccggaccggtcccgtggtcccgtcccgacgtcccgtagggtttccggtcggggtcgggttgggtccgtacgggacgtacgttcgttaccaccttccgacctaacgtcgtaccggaccgtcccggtacccgttaccgtacggttaacgttacgttaacgtttcgttttaccgtacgtttttaactttttaacgtttccgttaacggttaacctaaaccgttacgtttacggttacgggttaccgtacccggtttccggttacccggttttaaccgtttaccggtttaccggttttaccgggaacccgggttaaccggggtaaacccttaaagggtaccgaacgttaaaccgtaaccgtaaaaccggttcgggttacggtaccggtacgttaccgtaaccgttaccggtactttccgttttaaccggttccgtttaaccccgttccgtttacccccgttacccggttaccttaaccgtccggttaaaacccgg

SEQ ID NO: 23360 - DNA, 1012 bp, Homo sapiens
  misc_feature: GYAE6OF01DSWEN.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccacccttctccctgccgacgggccacggccggagttacggtttaaggtaaacgttacgtttagggccttagggtaaccccaaacgaacgaaaacccgttcgggacccaacgggtccctaccccgagggtcccttccctacctaattccttagttacggtaacgtttcgttacccgtaccctaaaaccggtacggggttaccctaaccggttccggggtacccccggttccccccggtacccggtaacgggttttaccgaacgggttcggggtaccggttacggggtttccgggggtaccggttacgggggtaaaccgtaacgggttaccctttaccgaaccctttcccgtaccgtaaccccggttcgaaccggcccgtaaaacggtcccggttaaaacggaccggtaaccccgtttaagggttaaacgtttaacggtttttttccgggtaacccgggttttttaaaccgttaaccgtttccggttacgtaaaccgggtccgtaccgggttaccccggtttccccggtaccccggttccgggtacccccggttaacccggtttttaaccggggttttacccggggggaccgggggggttaaaccccggttagggggggttaaccgggtaaaccggggtaaggggtaaaccgggttaaccgggtaaaccgggtttcgggtaaccggggtcttaccggacccggtaaacccgttacgttttcccgttcggttaccttttacccgtacccggtttaccctcccccggtactttacgtaccgttaaacggaacttaacggtttaacgg

SEQ ID NO: 23361 - DNA, 766 bp, Homo sapiens
  misc_feature: GYAE6OF01BF575.24.35.D02.1.454.CMB.1.raw
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatcgccaccggagacattgtgttgacacagtctccaggccacctgtcttgtctccgaaggggaaancgccacctctctgcagggccagtcagagtanaaganctaacttacgtagcctaggtatacgaacacgaaacctgggaccaggcctccgaggctcctcattcctagtggtaactctaccgagacgtacgggccacgttcggtcgtacccacggtaccgtaggttccgaaggttcggctacggtcgggtacgtcgggaactaggtacgttcaacgttctaccgaaccctaagtcaacgactacggtccttggacccaggttccgtaaggtaaaagttttcgttttaacggtacgttttaaagttttacgggtttaaacttccgggtacccgttaagacccgtaacgacccgaacggttacgggtaaccggtacccggttaccggtacccggtacccgtttaaccggttaacccggttttcgggggaacgggtttaaaccccggggaaacccgttaaggggggttaaccgaacgggtttaaccgaaaaacccgggtaaaccgttaaccggttagggtacccggggttaccaaaccggggtccaaacccgtttcgtttaacccgg

SEQ ID NO: 23362 - DNA, 723 bp, Homo sapiens
  misc_feature: GYAE6OF01AMGCE.24.35.D02.1.454.CMB.1.raw
  modified_base (210)..(210): a, c, t, g, unknown or other
  misc_feature (210)..(210): n is a, c, g, or t
  modified_base (318)..(318): a, c, t, g, unknown or other
  misc_feature (318)..(318): n is a, c, g, or t
  modified_base (342)..(342): a, c, t, g, unknown or other
  misc_feature (342)..(342): n is a, c, g, or t
tcagactactatgtcacgaccggtgctcgatttagcacacgatagttgggtttgggggaggaactgctcagtttaggacccagagggaaccatggaacgcccccagctcagcctttctcttcctcctgctactctggcctcccagagacccaccggagaaattgtgttcgaccacagtctccaggccaccctgtccttgctccgaggggnagagcccacctctccgtgccacgggccaggccggagttgttaagtaagtcttaggcttacggtaaccaagacgaaacccgtggacccaggcctcccgaggtcctcctnatctaatgactcgtcctcgaacgnggtccacgtcggcctccccgctaggttccagtccggcgtaggtcggtcgtagggacctacggtaccttcgactcccgtaccgacccggttcacggtccgaacggtccccgtaaggacctaccgttaggtaacgttacgtttttacgggacccggtttttaactaacggttcgttaccgaacgtccgtacggttcccggtttcccgaccggtttcgggacccgttcgttaaccgggtttccgggaccgggggttacccgtaggggttcggaacgtacgggaacgtaccggtaccgttcggcggtaccgtcgtaccgtaacctccgttcgtacgttcctctacccgttccttcccgactacgttacgacgtaacgttggtacg

SEQ ID NO: 23363 - DNA, 747 bp, Homo sapiens
  misc_feature: GYAE6OF01C9LDS.24.35.D02.1.454.CMB.1.raw
  modified_base (173)..(173): a, c, t, g, unknown or other
  misc_feature (173)..(173): n is a, c, g, or t
  modified_base (201)..(201): a, c, t, g, unknown or other
  misc_feature (201)..(201): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (384)..(384): a, c, t, g, unknown or other
  misc_feature (384)..(384): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagacccaccggagtaattgtgttgacacagtcnccagcaccctgtcttgcctcgagggganagacgcccaccctctccctgcgagggcccaggcccggtaagttgttaagtaaagttacttagggcctaggtaacccaagaacggtaaaccgtggcccgaaggccctacccgaggtccctccctanactcctaagtntacgtcgtcctaccgaacgcgggtactacgtcgggcccgtcccccgngtacggttcgaggtcggactagggtcgggtctaggggacacgtaccgtttccacctcctaccgtacccgtgacgtccctaaggaccctaggaccgtcctacggtaaggtttacgtttacggttaccggttttaacttaccggttgtaccgtaacggtcggtacgttcccggttacccggccgttaccgggtaccccgttaccgtttaaccgggtttccggggaccgggggggttaacccgagggggttaacggaacgggtagggtaacgaacggtaacggtggtcggaacgtcgacccgtacgacgttcgtagtttccttcgtacttacctcccgtacttactaccttacgaatcggttaacg

SEQ ID NO: 23364 - DNA, 762 bp, Homo sapiens
  misc_feature: GYAE6OF01DDYSH.24.35.D02.1.454.CMB.1.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (730)..(730): a, c, t, g, unknown or other
  misc_feature (730)..(730): n is a, c, g, or t
tcagactactatgtcacgaccggtgctcgatttagcacacgatagttgggtttgggggaggaactgctcagttaggacccagagggaaccatggaacgccccagctcagcttctcttcctcctgctactctggcctacccagacgacccaccggagaagtagtcatgacgcagtctccacgccaccctgtctgtgtcgtacgtaaggggaaanacgcccaccctctccgngcgacgggccagtcgaagtagtggtaggcagactaacttagccgttaggaaccagaacgaacgaacgtcggacacggcctccggagtccctcctccttcgtacgtcgtccgttactccccgtaccgacccggtacgggtcccccgtggtaccgttaccccgagaccggttaggttcccgggtgggtaccgggtgggtacgtggggtaactacgtttacgttccgtaccgtcgtaacacccgtagtcgacggccggtaccctaccgtagtacgtaagaacgttactttacgaccttttaactttacgttcctagttaacctaacgttagtaacgtttggtacgacgttcgtacccgtaaccgttcggttaaccggttccggtaaaccggtaaccggtaaacccgtaagggtcgaaccgtaacgttaaaccgtaaacggtacggtcgtaacggtaccctaggtaacccctcgtacggttaccgttaccggttcccctttaanacccggtttaccccctacccgacgttaaccgg

SEQ ID NO: 23365 - DNA, 742 bp, Homo sapiens
  misc_feature: GYAE6OF01B2262.24.35.D02.1.454.CMB.1.raw
tcagactactatgtcacgaccggtgctcgatttagcacacgatagttgggtttgggggaggaactgctcagttaggacccagagggaaccatggaagcccagctcagcttctcttcctcctgctactctggctccagagaccaccggagaattgtgttgacacagtctcaggcaccctgtcttgtctccgaggggagacgacgccaccctctcctgcgacggggccaggccgggaagttggttaagtaaagttacgttaggccgtagggtaacccaaagtacgaaaccgtggacccaggcctccgaggtccctccgtactaactcctagtcgacttgtaccgtaccgaacgtacgggtccacgttcgggacccgtcccccgacggtacggttcgacggtcggtacgtagggtcgggtccgtagggacctacggtaccttccgtacgtccgtaccgtaccgtagacgaccacggtacctaggaccgtcgtaacggtaagtttacgttttaggtaccgtttaactcgtagtacaggaccgtcgtacccggtttccgccggttggtacccgttaaccggttttagggtcccggggggaacgggggtaaccgagggggttaggaacgggtacgggaacggtaaccgggtaacgttcgggtacggcttaccggaccgttactacgttcgttcggttactccttacgtcccctaccccgacttacgtccctaaaggtctaaggttacg

SEQ ID NO: 23366 - DNA, 615 bp, Homo sapiens
  misc_feature: GYAE6OF01DWPLT.24.35.D02.1.454.CMB.1.raw
  modified_base (290)..(290): a, c, t, g, unknown or other
  misc_feature (290)..(290): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgcagggccagccggagtgttagtaagtcttaggctggtaccaacagaaacctgccaggctccaggctcctnatctatgatgtctaccaacgacgggtcacgtggccgtccccgcgtaggttcaggtggcgtaggtgggtctgggacagtacttcactctccaccgtcagcagcctagacgtcctagaattagtttgtacgtttactacttgtcagtcgacgtcgttccgccgtcggcccgtacgttaaccggttccgggccggggggaccgtaggggtacggagggagggaagacggaacgttggtcggtcgtcggccgaacctagttccgttgttccgttactacgttccccgttaccccgtacctaacttccgtaacgtaaacgtgttaacggg

SEQ ID NO: 23367 - DNA, 805 bp, Homo sapiens
  misc_feature: GYAE6OF01CGFEW.24.35.D02.1.454.CMB.1.raw
  modified_base (209)..(209): a, c, t, g, unknown or other
  misc_feature (209)..(209): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagaccactgggagaagtagtcatgacgcagtctccagcccaccctgtctgtcgtctccgaaggggaaancgcccaccctctcctgcgacgggccaggtagagaattggttggacaagactaacgttacgccgttacggtaaccaggacaacgaaaccgtggaccgacggccctacccgacggccttccctccttactacgtcgtccttcgtaccctacccgtacccggtaccggggtccccttcgggttccgacccccgtacgggtacccggtttacggggttccgggtttcgggggtccggggttcggggttccggtacggggtaacgttacggttaacttttcccgaacgttccctaccgaacctaacgtccgacggcccgtcccgtacgtacgttacgtacggttaacgttacgttttacgtaccttttacgttttacgtttctacggttaacctaaacttacgtttaggtacggtacgttacgttcccggttacccgttaccgttaacgtttccggttttaccggggacccggtaaaccggggtaaccttaaacggtcggtaaacgtacgtaaaccgaaaaccggtcgttacgggtcggtaccgtacgacctaaccgttcgttctacgtttcctaccgttaccttcccgttacccgtaccg

SEQ ID NO: 23368 - DNA, 556 bp, Homo sapiens
  misc_feature: GYAE6OF01CMMN2.24.35.D02.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (359)..(359): a, c, t, g, unknown or other
  misc_feature (359)..(359): n is a, c, g, or t
  modified_base (399)..(399): a, c, t, g, unknown or other
  misc_feature (399)..(399): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccagggganagagccaccctctcctgcagggccagccggagtgttagtaagtacttaggctggtaccaanagaaacctggccaggctcccaggctcctcatctatgatgtcctccaccacgggcccctggtctcccgagccaggttcgtggcggtgggtcgtgggacngacttcactctacaccatcagcagtgtagacgctgaagtntttgactagtttatactgtcagtcacgtcacaacgtcgccctacgtttccggccctgggacccagaccgtacggtacacgtaccaacgacgtggtcggctcgactaccgattcgtcgttcttcgacttcccttcccgactatccgtgtaacctaacg

SEQ ID NO: 23369 - DNA, 634 bp, Homo sapiens
  misc_feature: GYAE6OF01CFBS4.24.35.D02.1.454.CMB.1.raw
  modified_base (262)..(262): a, c, t, g, unknown or other
  misc_feature (262)..(262): n is a, c, g, or t
  modified_base (393)..(393): a, c, t, g, unknown or other
  misc_feature (393)..(393): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgagttgacacagtctccaggcaccctgtctttgtctccaggggagagagccaccctctcctgcagggccagccggagtgttagtaagtacttaggctggtaccaanagaaacctggccaggctcccaggctcctcatctatgatgtcctaccaacgtgggtcacgtcggccgtccccgctaggttcaggtggcaggtggtctggacagtcttcactctcgactcagcagcctagacncctgaagtattttgacggtttactactgtacagctacgtccgttccgccgtcggcccgtacttaaccgggtttccggggacgggggtaacccgtagggggttacggagggtaacgggaacggaacggtaacgtgggtacgggctacggacctaccgtacgttccgtaggttccttcgtaccgttccccgtttaccccggacccttaagtttaccctaacggtaaaccgtagttaaaccggg

SEQ ID NO: 23370 - DNA, 759 bp, Homo sapiens
  misc_feature: GYAE6OF01ETY06.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcagggccagccggagtgttagtaagtactaggctaggtaccaacagaaacctggaccaggcctcccgaggtcctcctcattctagtgattgtcctaccgaacgtcggggtccacgtcgggacccgtcccccgacgtacggttcaggtcggccgtagggtcgggtcgtagggaactacggtacctttaccgaccttcccttaccgaacccggtcgaaccggtccaacggtacccgtaaggaccgtaccgtaggtaaacgtttacgtttttacggtaccgggtttttaactacgttacggtactaacggtaccgtacggtcccggtttcccgtacccggttcggtcccgtaccgtttaaccgggtttccggggaccggggggtaccgtagggggtacgggaagggtaacggggaacggtaaccgggtaacgttcgggtacggtcgttaccggccgtaaccgtacggtttccgtacgtttccgttacctacgttccccttacccggaccttacgtacccgtaagtaaccgtagttaaccgg

SEQ ID NO: 23371 - DNA, 658 bp, Homo sapiens
  misc_feature: GYAE6OF01DHVGH.24.35.D02.1.454.CMB.1.raw
  modified_base (263)..(263): a, c, t, g, unknown or other
  misc_feature (263)..(263): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtcctcgaggggagagagccaccctctcctgcagggccagccggagtgttagtaagtacttaggctggtacccgnacgaaacctggccgtggcctcccgaggccttcctcatctagtggtcgcgtcccgaccgagggccacgtcggccgtccggcggacgtagggtttcacggtggacgaggttcggtcgtttgggacaggtacttcactctcatcagtcgacagtacgtaggacgacccgtaagtacgtttagcgtagttagttacttacgtgtcgtacgtcgttggtttccgttcccttccgttacccttcttacgttcgttaacctttacgtttccggtaccgttacgggttccgtagggttccgtaggtacgtacgtacgaacggtaccgtaacgttcggtacggtccgtacgacccgtacctacgttcgttacgtttaccttacctaccgttcccgttaaccccg

SEQ ID NO: 23372 - DNA, 598 bp, Homo sapiens
  misc_feature: GYAE6OF01EKLVR.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggangagccaccctctcctgcagggccagccggagtgttagtaagtacttaggctggtaccaacagaaacctggcctgctcccaggctcctcatctatggtcgcgtccaccgagggccacgtggcgtcggcggacaggttcagtggcaggtggcgtttggacgagacttcactctcagtcatcgacaagctagggacgacccggtaagtacgttttagcgtaagttgttattacgtgtacagtcgttgtttccggtcccttccttccttcctacttcgtacttacgttttcgggacccgttacggggttcccagggttcgtacggtacgtactacgaagtccgtaacgtggtcggctggacctaccagttcctcgttcttcctacgttcccgttaccccg

SEQ ID NO: 23373 - DNA, 575 bp, Homo sapiens
  misc_feature: GYAE6OF01BLSTL.24.35.D02.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (413)..(413): a, c, t, g, unknown or other
  misc_feature (413)..(413): n is a, c, g, or t
  modified_base (536)..(536): a, c, t, g, unknown or other
  misc_feature (536)..(536): n is a, c, g, or t
  modified_base (565)..(565): a, c, t, g, unknown or other
  misc_feature (565)..(565): n is a, c, g, or t
  modified_base (568)..(568): a, c, t, g, unknown or other
  misc_feature (568)..(568): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagcccaccctctcctgcagggccagccggagtgttagtaagtacttaggctaggtaccaacagaaacctggccaggcctcccgaggcctcctnatctatgatgtcctaccaacgaggggtccacgtcggaccgtccccgctagggtttcaggtcggactagggtgggtcctgggacaggtacttcactctcaccgtcagcagcctaggngtcctagaagtatttgacttactttatttctagtactaactacttagtgtagtacgtcggtccttccgtactcgtttcggaccgtacgggacctaacgtggagactacgaacgtacgtgtcgntcgctactctctctcttctcttcctcccnctntcgtacg

SEQ ID NO: 23374 - DNA, 576 bp, Homo sapiens
  misc_feature: GYAE6OF01BW9GC.24.35.D02.1.454.CMB.1.raw
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctcgagggganagagccaccctctcctgcagggccaggccggagtgttagtaagtacttaggctggtaccaacagaaacctggccaggctcccgaggcctcctcatctatgatgtcctaccaagngggtccacgtggcctccccgctaggttcagtcggcaggtcgggtcgtggacagtacttcactcgtcaccgtcagccagcctagacgctagtagtagtttcgcggttttactctgtcagtcgacgtccgttccgcgtcggcctacgttacggtcgggcggggacagggtggaggtaggacgtacgacgtggtacgcgtgcctacctgtccgttcgttcttcgacttcccgtacccgctacttaccgtactaacgtgttaacg

SEQ ID NO: 23375 - DNA, 621 bp, Homo sapiens
  misc_feature: GYAE6OF01BZF3T.24.35.D02.1.454.CMB.1.raw
  modified_base (266)..(266): a, c, t, g, unknown or other
  misc_feature (266)..(266): n is a, c, g, or t
  modified_base (315)..(315): a, c, t, g, unknown or other
  misc_feature (315)..(315): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccaccctctccctgcagggccagccggagtgttagtaagtacttaggctggtaccaanagaaacctggccaggcctcccaggctcctcatctatgatgtctccaacngggtcacgtggccgtccccgcaggttcagtggctaggtgggtctgggacaggtacttcactctcaccgtcagcagcctagacgacctgaagtatttgtcggtttactactgtcagcacgtcgtttcccgccgtcggcccgtcgttaaccggtttccggggaccggggggtaccgaggggtgggagggagggaaggaaccggtaacgtggtacgggtccgtcgccgaccgtagtccgttaggttcctttcgaccgtttcccgttacccccgtcccgttacttaccgttacgaacctaagttaaccgg

SEQ ID NO: 23376 - DNA, 725 bp, Homo sapiens
  misc_feature: GYAE6OF01CQDBD.24.35.D02.1.454.CMB.1.raw
tcagactactatgtcacgaccggtgctcgatttagcacacgatagttgggtttgggggaggaactgctcagttaggacccagagggaaccatggaagccccagcgcagcttctcttcctcctgctactctggctcccagataccactggagaagtagtcatgacgcagtctccagcccaccctgtctgtcgtctccgaaggggaaaagcgcccaccctctcctgcgagggccagtgagaatgtcggcagactaacgttcgctacggtaccacgcgaacgaaaccgtcggaccgacggtccctacccgacggtcctccgtcctactagtcgcctcgtccctacccgaccggtaccgggtccctggtccgtacccgcggtccgtacgggttcggtcgggtcgggtgggtacgtggggactacgtcgtttaccacttcctaccgacctacgtccgaccggtcccggtcccttaccggtacgttaccgttaaggtaacgtttacgttttacgtaccgttttaacttttacgttttccgttacgttaacctaaaccttacgtttacgttacgggtaccgtaaccgttccgggtccctttaaccggttacccttacggttttaccgggaccgggtaaccgggtaacctaacggtgaacgttaaccaacgtaaacgacgtaggtccgtactagacctaccgattcgtcgttcttacctcttccctccgtacc

SEQ ID NO: 23377 - DNA, 746 bp, Homo sapiens
  misc_feature: GYAE6OF01B596P.24.35.D02.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagcccaccctctcctgcagggccagccggagtgttaagtaagtacttaggctggtaccaanagaaacctggccaggcctccaggcctcctcatctatgatcgtctaccaacgagggtccacgtggcccgtccccgcgtacggttcaggtcggcgtaggtcgggtcgtagggactagtactttccaacttcgtaccgacccgttcgacggccacgtaccctaaggacgtcccgttaggtaacgttacgtttttacgggtaccggttttaactacgttcggtaccgtaaggtccgtaacggttcccggtttcccggcccgttcgggacccgttaccggtttaaaccgggttttcccggggggaccgggggggtaacccgtaggggggtacgggaacggggtaacggggaacgggtaaccggtaacggttgggtaacggccgttacggacctaacccggtagttccgttacggtttaccctttccgtacgtttcccccgttccccggaccttacgttaccgtaacggtaaacctaggtttaacgg

SEQ ID NO: 23378 - DNA, 758 bp, Homo sapiens
  misc_feature: GYAE6OF01BJZW7.24.35.D02.1.454.CMB.1.raw
  modified_base (270)..(270): a, c, t, g, unknown or other
  misc_feature (270)..(270): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccacccttctcctgccgagggccaggccggagtgttagtaagtacttaggctaggtaccaanacgaaacctggccaggcctccgaggcctcctcatctatgatgtcctaccgaacgtcgggtacacgtcggcccgtccccgcgtacgggtttcacgggttcggacgtacgggttcgggtaccgtggggacctacggtacccgtttccgtaccgttcccgtaccgtaacccggttcaacggccctaacggtaccctaaggacgtccgtaagtaacgtttacgttttcgggttaccggttttacttaaccgttgtacgtacggtccgtacggtcccggtttaccgccgtcgggtacccgttaccgtttaaccgggtttccgggggacgggggtaccgtagggggtacgggacgggtaacggaggtaaccggtaccggtggtacggtccgtcggtacccgtaacgtcgttcccgttaggtttacccgtttaccgtaccgtttccccgtaccccgtcgttacccgttactaaccggtaaacgttgttaaccggg

SEQ ID NO: 23379 - DNA, 578 bp, Homo sapiens
  misc_feature: GYAE6OF01DB2YW.24.35.D02.1.454.CMB.1.raw
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
  modified_base (532)..(532): a, c, t, g, unknown or other
  misc_feature (532)..(532): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggataaattgtgttgacacagtctccaggcaccctgtctttgtctccaggggagagagccaccctctcctgcagggccagccggagtgttagtaagtacttaggctggtaaccaacagaaacctggccaggctcccaggctcctcatctatgatgtctccaanagggtcacgtggccgtcccgcaggttcagtgcagtggtctggacngacttcactctcaccgtcagcagcctagacgtccgtaggaacgtattttcggtcggtttaactacgttgtacaagtcgacgtccgttcccgccgtcggcccgtacgttaaccggtttccggggaccgggggtaccgaggggtggaaggaggagaacggtacgtggtggctgccacngtctgttcttcacttcccttacccgctactctacgaactgtaacgg

SEQ ID NO: 23380 - DNA, 793 bp, Homo sapiens
  misc_feature: GYAE6OF01EH5FY.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacgcagtctccaggcaccctgtctttgtctccgaggggagagacgccaccctctcctgcagggccagtcagagtgttagcagcagctacttagcctggtaccagcaagaaacctggcctggctcccgaggcctcctcatctagtgggtcgccgtccaccgagggcccacgtcgggccgtcggcgggacgtacggttcgaggtggacgaggttggtcgttttaggggaactaacggtacctttaccgtaaccgttcctacgtacttaccgtagttaccggaaccgtaacggtaaccgttacggggtaaacccggtaacccccggttaaaaggttaacgttttttacggaaccgttaaggtttacgtttaacgtttaccgttacgttaccgtacggtttccggttttcgggtttttccggttacccccgtttcccgtttacccccgttttcccgtttaacgttttaccggttttaaacccgtttacggttttttacccggggtacccggtttacgggggtttaccccggtaaggggttccgttacggggtaaacgttaccgttacggtaaacggtaccggtaacggttacgggttcggtaccgttaccggtaccctaaccgttcgtttaccgg

SEQ ID NO: 23381 - DNA, 549 bp, Homo sapiens
  misc_feature: GYAE6OF01DKBJJ.24.35.D02.1.454.CMB.1.raw
  modified_base (149)..(149): a, c, t, g, unknown or other
  misc_feature (149)..(149): n is a, c, g, or t
  modified_base (158)..(158): a, c, t, g, unknown or other
  misc_feature (158)..(158): n is a, c, g, or t
  modified_base (164)..(164): a, c, t, g, unknown or other
  misc_feature (164)..(164): n is a, c, g, or t
  modified_base (167)..(167): a, c, t, g, unknown or other
  misc_feature (167)..(167): n is a, c, g, or t
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
  modified_base (261)..(261): a, c, t, g, unknown or other
  misc_feature (261)..(261): n is a, c, g, or t
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccacgganaattgtgtnacacgntcnccaggccacctgtcttgcaccgagggganagacgtccaccctctccngaccgaggccagccggtagtgttagtaacgtcttaggctaggaacanagaacctggccaggcctaccagcctcacatctatgcttcgtcctaccgaaggcggttctaaccggcggcccgttcccgatacggtcaaggtcgctggtcggcaggacnttacgcactgcacgnacgcacgctagcncgtagtatgtacatntgtactcgtagcgncgagtacgtacgacgtactcgtacctactactactacgtcgtacgacgtacgtacgtacgacgtacgacgacgtagacgtacgtacgtacggtcgacgacgactactactacgtcgtctcgtc

SEQ ID NO: 23382 - DNA, 735 bp, Homo sapiens
  misc_feature: GYAE6OF01D7R3H.24.35.D02.1.454.CMB.1.raw
  modified_base (313)..(313): a, c, t, g, unknown or other
  misc_feature (313)..(313): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccaccctctcctgcagggccagccggtagtgttagtaagtacttaggctggtaccaacacgaaacctcggccgacggcctcccacggcctcctcatctatgtatntctccaacgtacgggtcacgtcgggccgtccccgccgtaggttacaggtcggacgacggttggggtcgtcgggacgacgtacttcactctccgaccgtcagcacgacctaggtaacgcctaaggtaacgttagtttttcgggtaccggttttaacttacgttcggtctaaacggtccgtaacggttcccggtttccccggtcccgtcgggtccccgtaccgttttaaaccgggtttccggggggacccgggggggtaaacccgagggggttaggggtaaacggggacgggtaacgggtaaccggaaacggtgggttcgggaccttcggacccaaccgtacgttccggttacgttcttacccgtagttcccccgtttccccgtaccccgtaagttccctaaacggtaccgtaaagtttaacgg

SEQ ID NO: 23383 - DNA, 637 bp, Homo sapiens
  misc_feature: GYAE6OF01AHGN5.24.35.D02.1.454.CMB.1.raw
  modified_base (264)..(264): a, c, t, g, unknown or other
  misc_feature (264)..(264): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccgaggggagagagcccaccctctcctgcagggccaggccggagtgttagtaagtacttaggctggtaccaanagaaaccgtggaccaggcctcccaggcctcctcatctatgatcgtcctaccaacgtgggtcacgtggccgtcccgaggccgtagggttcggttgggcgggttgggtcgtggggactaggtactttcacgttctcaccatcgacgccggtcctaccgagtctagtaagttatttcgtacttacttttatttctgtactaactactagtggtcgtacgtcgtccgttccgtacttacgtttcggaccggtaacgggaacctaacgtggtaacgtacgtaaccgtaaacgaacgttagtcggtctacggacctaccgtattcgttcgttacttaccgtaccttcccgttaccccgacctacttccgtacgtaaacg

SEQ ID NO: 23384 - DNA, 711 bp, Homo sapiens
  misc_feature: GYAE6OF01BYXM0.24.35.D02.1.454.CMB.1.raw
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcaggccagtgagatgtgcagcaacttgctggaccngcagaaacctggccaggctcccaggctcctcctctatcgcttgtcctccaccgacgggtcccctggtcgtcccgagccctaggttcgtggcggtgggtcgtgggacagtactttcacgtctcgacctatcgacggccggcctccgacgttcgtacgtaaacgttagttttacggcctttaacgttttaacttttcgtacgtttaccgtaaacgttaacctttaagttacggtttacgtaaccctttcgggtaccccttttacccggttaacgttaccggttttttaaccgggaccccggtaacggggggtaaccctaaaaccggttcgggtaacggtaacttaaccggtaaaacgtaacggttaccgggttacgggaccgttcggaccctaaccgtacgttacccgttcgtttacccttaccgttacttacccgttccccgtccctaacgttacccg

SEQ ID NO: 23385 - DNA, 785 bp, Homo sapiens
  misc_feature: GYAE6OF01D2LTF.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtcctccgaggggagagacgcccaccctctcctgcacgggccagtgacaatgttaggaagttgttacgctggtatacaacaacaactagtcggacccgacggtcccgtcccccggtcttccctacacttcctaagtgaagttcgacctaacgttaccccaaaggttaccgggccctacgtggacctacctacccgagtaccgtaggttaccagggtgacgtagggttcgggtcgtacgggactaggtaccttaccgaccttcgtaaccaacctacgtaccgaggtaccgtaaggttcgtaacggacgtacccggttaaggtaaacgtttaacgttttgaaccgttttaagtttttacgttaccgtttcggacctaacggtccctaacccgggttaagtaaccctaaccgggttaccccggtacccccggttttacggtttaccccggaccccgggttaacgggaacccctagggtacccggtaacggaaacccttaacccgttaacccgaaacggttaaccggttggtacgggaccctacggacccctaacttcccgtttacttcccgtttaccctttccgtcccgttttacccccg

SEQ ID NO: 23386 - DNA, 571 bp, Homo sapiens
  misc_feature: GYAE6OF01DPETW.24.35.D02.1.454.CMB.1.raw
  modified_base (200)..(200): a, c, t, g, unknown or other
  misc_feature (200)..(200): n is a, c, g, or t
  modified_base (317)..(317): a, c, t, g, unknown or other
  misc_feature (317)..(317): n is a, c, g, or t
  modified_base (565)..(565): a, c, t, g, unknown or other
  misc_feature (565)..(565): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccagggganagagccaccctctcctgcagggccaggccggagtgttagtaagtacttaggctaggtaaccaacagaaaacctggaccaagggcctcccaggcctcctcatctatgatgtctccaangggtcactggccgtccccgcaggttcaggtcggctaggtggtctgggacagacttcgactctcaccgtcagacagcctagacgtcctgaagtattttggacggttttaactactgtacagctagtcgttccgccgtcggccgtcgttaacgtttccgggcgggggaccagggggtacggaggaggagacgaacgtggtcggcgtgcctaccgatcgtgtcttcactcgttacccgcaactctagactntaacgg

SEQ ID NO: 23387 - DNA, 138 bp, Homo sapiens
  misc_feature: GYAE6OF01D1GJD.24.35.D02.1.454.CMB.1.raw
  modified_base (130)..(138): a, c, t, g, unknown or other
  misc_feature (130)..(138): n is a, c, g, or t
tcagactactatgtcacgaccggtgctcgatttagcacacgatagttgggtttgggcacagcggccctgggctgcctggtcaaggactacttccacatagtagtctgagcgggctggcaaggcgcatagnnnnnnnnn

SEQ ID NO: 23388 - DNA, 750 bp, Homo sapiens
  misc_feature: GYAE6OF01DDW5X.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgccaccctctcctgcagggccagccggagtgttagtaagtacttaggctggtaaccaacagaaacctggccaaggcctcccgaggcctcctcactctaatgacttgtacctaccaacgtacgggtcacgtcggcccgtccccgcgtaagggtttcaaggtcggacgaggtgggtcgtgggacacgtacttcgactctcgaccgtcagtcacgtcctaagacgtcctaggtaacgtattttacggtacggttttaaacttacgttcggtacgtacgtcgtacgggtcccggtttacccggtcccgtccgggtacccggttaccgtttaacccgggttttccggggggaccgggggggtaaacccgtagggggggttaacggggtaacgggtaacggggaacgggtaaaccggtaaacgggttcgggtttacgggaccgttacggacccgtaaccgtacgttaccgttcggtttacctttccgaacctttcccgttaaccccggtcctaacgtttccgtaaacggtaaccgttaaggttaaacggg

SEQ ID NO: 23389 - DNA, 646 bp, Homo sapiens
  misc_feature: GYAE6OF01BPR4B.24.35.D02.1.454.CMB.1.raw
  modified_base (203)..(203): a, c, t, g, unknown or other
  misc_feature (203)..(203): n is a, c, g, or t
  modified_base (456)..(456): a, c, t, g, unknown or other
  misc_feature (456)..(456): n is a, c, g, or t
tcagactactatgtcacgaccggtgctcgatttagcacacgatagttgggtttggggaggaactgctcagttaggacccagagggaaccatggaagccccagctcagcttctcttcctcctgctactctggctcccagagaccaccggagaaattgtgttgacacagtcctccgagcaccctgttctttgtctccgagggganagacgcccaccctctcctgcagggccagccggagtgttaagtaagtacgttaggcttggtaaccaagagtaaacctggaccaggcctcccgaggcctcctcattactatgattgtcctaccgaacgcgggtcacgtcggcccgtccccgacgtaggtttcgagttggacctaggttcgggtcgtacgggacctaggacctttcgaccgttctaccgacccgtcacgctacgccctaagacgcctagtaagttntttggtacgtttatacgtgtacagtcacgtccgtccgcgtcgccgtcgttaacggttcgggcggggaacgtggggtacggagtaggagaacgtacgtggtcggtcgtacgacctaccgtagttccgttacgttccttccgtaccttcccgttaccccgcttactaccgtacgtaaaccgtaggttaacgg

SEQ ID NO: 23390 - DNA, 757 bp, Homo sapiens
  misc_feature: GYAE6OF01BD5IL.24.35.D02.1.454.CMB.1.raw
  modified_base (207)..(207): a, c, t, g, unknown or other
  misc_feature (207)..(207): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagataccactggagaagtagtcatgacgcagtctccagcccaccttgtctgtacgtctccgaagggaaacncgcccaccctctcctgcgacgggccagtgagtatgtggctagactaacttacgccgtggtaccagcgtaacgaaaccgtcggaccaaggtccctaccgacggtcctccctcttacctagtcgtctccgtcctacccgaccgtcggtccctgtactcccgacgtccgttaggttcggtcgggcggttcggtacgtcgggtactaggttactttccgaccttcgtacccgtactacgttccgacggtcccgtacccttaccgtaagttcctaaggtaactttcgtttacgaacctttacgttttacgttccgtacgtaacccttaacgtacgtttagttcgggtacgttaccggtacccgtttacgttaccccgttaacgttcccggttttaccggaacccgggtaacgggtaaacctaacgttagggaaaccgttaacgtaacccggaaacgttaaccggtgggtaccgtaccggttacgtaccccgtaaccgttaacgtccgttttacccgttacccttaaccggttaccttccccggttcccccggaac

SEQ ID NO: 23391 - DNA, 621 bp, Homo sapiens
  misc_feature: GYAE6OF01CZO0T.24.35.D02.1.454.CMB.1.raw
  modified_base (269)..(269): a, c, t, g, unknown or other
  misc_feature (269)..(269): n is a, c, g, or t
  modified_base (424)..(424): a, c, t, g, unknown or other
  misc_feature (424)..(424): n is a, c, g, or t
tcagactactatgtcacgaccggtgctcgatttagcacacgatagttgggtttgggggaggaactgctcagttaggacccagagggaaccatggagccccagctcagcttctcttcctcctgctactctggctcccagagacccaccggagaaattgtgttgacacagtctcccaggcaccctgtctttgtcctcgaggggagagacgccacccctctcctgcagggccagccggagttgttagtaagtacttaggctaggtaaccaanacgaaacctggccaaggcctccaggctcctcatctaatgatcgtcctccaacgagggttcacgtcggccgtccccgcgaggtttcagtcggcaggttggtctgggacagtcttcacttctccgaccgtcagcacgcctagacgtcctagaacgtnttttcggtcggttttactagttcgtctacgtcaggtccgtccgtccgtcgggccgtacgtacggtttccgggcgggggtaaccgtaggggtggacggaggtacggacgtaacgtggtcggtcgtcgacgaccgtacgtcgttagttccttacgtacttacccgttcccgtcctacttcgttacgtaactagttaacg

SEQ ID NO: 23392 - DNA, 746 bp, Homo sapiens
  misc_feature: GYAE6OF01EC0B0.24.35.D02.1.454.CMB.1.raw
  modified_base (226)..(226): a, c, t, g, unknown or other
  misc_feature (226)..(226): n is a, c, g, or t
  modified_base (731)..(731): a, c, t, g, unknown or other
  misc_feature (731)..(731): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagacgaccacggaagtaaattgtgttgacacagtctccaggccaccctgtctgtgtccgtcgaaggggaaagcgccctacccgtctccgngccgagggccaggtagaagtaagttggttggcagactaacgttcgccgtacggtaccacgacaacgaaaccgtcggaccgacggtccctaccgacggtcccttaccgtcccttacttacgtcgtccgttccgttccgtaccccgacccggtccgggtccccgttgggtaccctcccgacggtccggttacggggtttcgggtcggggtccgggttcgggtcggtacggggactacgttactttccgaccttcctaccgtaacctacgtccgacggtcccgtaccttcgtacggttctaaggttagtttacgttttcgtacctttattttctacgttacgtaccttaacgtcgttacgtcgggttctaccggttcgtaccgttaccgttacgttccggttacggaaccggtacgggtaacaacggttggtaactaacgtaccgtaaacgtagtcggtacgtcgtacgtacctacgtctcgtttctaccttaccgtaccgtttcccnctccgtaattaccgg

SEQ ID NO: 23393 - DNA, 834 bp, Homo sapiens
  misc_feature: GYAE6OF01DSHLA.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctaccgagggganagacgcccaccctctccgtgcgacgggccaggccggtagttagtttaagtaaagttaccgttaggccgttacggtaacccaaacgacgtaaaaccgtcgggacccaagggtccctacccgacggtcccttcctacaacttccttagtcgtacgttcggtacctaccgaaacgtacggggttaccaaccggttccgggtaccccgttacccccggtacgttaacgggtttaccaacgggttcgggaccgttagggttcggggttaccgtacggggaacctaacgttaaccgtttccgaccgtttccgtaccgtaacccggtcgacgtaccgtaacggtacccgttaaggaccgttacccgttaaggtaacgtttacgtttttacggttaccggttttaactacggttacgtaccgtaacggtccgtaccgggttcccgtttacccggccgttaccggtacccgttacgtttaaccgggtttccggggaccgggggtaaccgtaggggtacggaacgggtagggaacgtacgtaacgttcgggtacgtcgtacgccgtaacctaggttccgttgttaccttccgtacttcccgttacccgtaccttacttaccggtaataacgtagttaacgg

SEQ ID NO: 23394 - DNA, 707 bp, Homo sapiens
  misc_feature: GYAE6OF01B5KHN.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcacccttgtctttgtctcgaggganagacgcccaccctctcctgcgacggccaggccggtagtcgttagtaagtacgttaggcttacggtaaccaacgaacgaaaccgtggacccgaggcctcccgacggtcctccctactatcctatgatcgttccaccgaacgacgggtccacgtcggcccgtccccggcgtacggttcgaggtcggcgtacggtcgggtccgtgggactacggtaccttaccaccgtttccgtaccgtacccgtcacgtccgaacgtccgtaagaccgtacgtagtaagtttacgttttcgtacggttttactaacgttcgtacgagtccgtacggtccgttccgccgtaccggtcccgttacgttaacgggttccggggacgggggtaccgtagggggtacgggaaggtaacgggagaaccggtagttcgggcggtccgtacgtcccctaagttcgttcggtctttcttacgtacgttcccgtcccgttctacgttaccgacgtacgtaagttacgg

SEQ ID NO: 23395 - DNA, 682 bp, Homo sapiens
  misc_feature: GYAE6OF01EPAIN.24.35.D02.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
  modified_base (410)..(410): a, c, t, g, unknown or other
  misc_feature (410)..(410): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaacctgtctttgtctccgagggganagacgccaccctctcctgcagggccaggccggagtgttaagtaagtacttaggctacggtaccaacgagaaaaccgtggacccgaggcctcccgaggcctccncatctatgatcgtctaccaactagggtcacgtcggccgtccccggctaggttcaggtggctaggtgggtcgtgggacacgtacttccgactcctacgtacccgtnacgcgacgtacccgtaaggacgacccgttagtaacgtagttttcggtaccggttttactacgttgtacgacgtaccgtacggtccgttcccgtaccgtcggcccggtacgttaaccgggtttccggggaccggggggtaccgtacggggtacgggacgggtaagggacgtaccggtaacggtggtcggcgtcgaccgaccgtacgtccgttgttccttacgtaccgttcccgttccccgtacctacgttaccgtacgtaactacgttaacgg

SEQ ID NO: 23396 - DNA, 716 bp, Homo sapiens
  misc_feature: GYAE6OF01D3JHE.24.35.D02.1.454.CMB.1.raw
  modified_base (210)..(210): a, c, t, g, unknown or other
  misc_feature (210)..(210): n is a, c, g, or t
tcagactactatgtcacgaccggtgctcgatttagcacacgatagttggggtttgggggaggaactgctcagttaggacccagagggaaccatggaagccccagctcagcttctcttcctcctgctactctggctcccagatgccaccggagacattgtgttgacacagtctccagcccacccttgttctttgtctaccgaaggggaaancgcccaccctctccgtgcgagggccagtgagtaatggtgcagctaacttgccgtagtaccagacaacgaaccgtggaccgaggtcctacgtccgaggtccctcccgtcctactagtcgtctcgtcccacccgaccgcccgggtccccttaggtccgtacccgacggtacccggtagggtttcggtcggggtcgggttagggttcgtacggggaacttacggttactttaccaccgttctaccgaaccgtacgtccggaaccggtcccggtccctaccgtacggttacgttaacggtaacgtttacgttttacgtacctttaacgttttactttacgtacgtaacttaaacgttacgttgtacggttcgtacgtccgtccgtaccgttaccgttacgtttaccgggaccggttaacggaacctaaggtaggtaacgtaacgtaaccgaaacgtacgttggtcgtactacgacctacgtatcgtacgttctactccttccgtccgtac

SEQ ID NO: 23397 - DNA, 642 bp, Homo sapiens
  misc_feature: GYAE6OF01CBKDX.24.35.D02.1.454.CMB.1.raw
tcagactactatgtcacgaccggtgctcgatttagcacacgataggttgggtttgggggaggaactgctcagttaggacccagagggaaccatggaagccccagctcagcttctcttcctcctgcttactctggctcccagagaccaccggagaaattgtgttgacacagtctcaggcaccctgtctttgtctccgaggggagagagccacctctcctgcagggccaggccggagtgttagtaagtacgttaggctggtaaccaacgacgaaacctggaccaggcctcccgaggctcctcatctatgatcgtctccgaagcggtcacgtggccgtccccgactaggttcagtaggcaggtggtcgtgggacagtacttcacctctccgacgtcacgtcacggcctaaggacgtcctagtaacgttgttttgacggttttattacgtcgtcgacgtccgacgtagaacctaacgtcggacccttacgtttcccgggacccgtagggtacccacggtaccgtagggtaacctacgtacccgaacgtaccgtggtcggtcctccgacctaaccgttcgttccgttcgttcctttacccgacgtttccccgttacccgtaccttactccgttaagaaaccttacgg

SEQ ID NO: 23398 - DNA, 649 bp, Homo sapiens
  misc_feature: GYAE6OF01E3ZS0.24.35.D02.1.454.CMB.1.raw
  modified_base (203)..(203): a, c, t, g, unknown or other
  misc_feature (203)..(203): n is a, c, g, or t
  modified_base (427)..(427): a, c, t, g, unknown or other
  misc_feature (427)..(427): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccgggagaaattgtgttgacacagtctccaggcaccctgtctttgtctccgagggganagagcccaccctctcctgcagggccagccggagtgttagtaagtacttaggctggtaccaacagaaacctggccaggcctcccgaggtctcctcatctatgatcgtctccgaacgacgggtcacgtcggccgtcccccgctaaggttccaggtcggacgaggttgggtcgtagggaccaggtacctttcgaaccttccgtccaccgtcagccagccctaggacnccgttagaacgttagttttcgtccggttttaactacgttgtcgagccacggtccgttccgccgtcgggccctacgttaaccgtttccggggcgggggtaccgagggggtcggaagggtacggacgaacgtaacgtgggtcggcgtcgaccaccgtagtccgttacgttctttcgacttccccgtttcccggaccttacgttacgtactaaacgtgttaacgg

SEQ ID NO: 23399 - DNA, 1010 bp, Homo sapiens
  misc_feature: GYAE6OF01DLR9S.24.35.D02.1.454.CMB.1.raw
tcagactactatgtcacgaccggtgctcgatttagcacacgatagttgggtttgggggaggaactgctcagttaggacccagagggaaccatggaacgccccagctcagcttcttcttcctcctgctactctggcctccagacgaccacggagaattgtgtgacacagtctccgagcctaccgttgttctttgtccgtccggaggggagagaccgccctaccctctccgtcgccggacgggccacgggacggtaggttagttaggttaaaggttacgttacggcgtacggtaaccaacgtaacggtaaaccgtcggaccgacggccctaccggacggtccttcctacctacttacgtagttacggtacttacgttacccgtaaccgtaaaccgggtacgggttacccgtaaccgggttcccgggtcccccgggttaccccccggtacgggttaaccgggtttttccgggaaacgggttcggggtacgggttacggggttttcgggggtaccgggtacggggtaaaccgtaacggtttacccggtttaaccgttaccctttaccgtaccctaacccgttagtaccggacgggttaaccggttaggttacgggtaaccgggttaaccggtcggtttaaggtaaacgggttttttacgtttacgggtttaaacgttttttaacgggtttttaacttttacggtaaccggtttccggaaccgggttacccgggtttaaccgtacggtaaccccgtttaaccgggtttccccggtaacccggtttcccgggttaccggggtaacccggtttaacccggggtaacctaccggttaaaccggggtacgtaaccccgttaaaccggtttacccggaaacgttaccccggttggggttacccgacccggttaccgacccgtttaacgggtttacccttcggttttaccgttaacccgttccgttaaccccggtttaccccttaaccccggttactttaaccgggttacgtttaaaccgg

SEQ ID NO: 23400 - DNA, 224 bp, Homo sapiens
  misc_feature: GYAE6OF01BCO5E.24.35.D02.1.454.CMB.1.raw
  modified_base (218)..(224): a, c, t, g, unknown or other
  misc_feature (218)..(224): n is a, c, g, or t
tcagactactatgtcacgaccggtgctcgatttagcacacgatagttgggtttgggggaagaggaagactgacggtcctcccaggagttcaggtgctgggcaccttgggcacgggggaggtgtgtcacaagatttgggctctgggcacagcggccctgggctgcctggtcaaggctacttccacatagtagtctgagcgggctggcaaggcgcatagnnnnnnn

SEQ ID NO: 23401 - DNA, 661 bp, Homo sapiens
  misc_feature: GYAE6OF01C7I00.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacgcagtctccaggcaccctgttctttgtctccgaggggagagacgccaccctctcctgcagggccagtcagagtgttagcagcagctacttacgcctaggtaccagcagaaaccgtggcctggcctcccgaggcctccgtcactcctagtcggtgccgtaccgaccgacgggccacgtcggcgtcgcggacaggttcaggtgcaggtcggtcgtttggacagtacttcactctcactctactcgacacgtacgtggaccgtacccgtaagtttacgttttagcgttaggttacgttaacgttttaacttcgtacggttactttcggttttcggtttcccgttccctttccgttccttacgttcgttaccgttaccgttttaccggttaccggtaccggtttaccggtacggtacgggttcggtaacggtaacgttacggtaacgtacgtaaccgttacggtcgggttcgtccgttaccgtaccctacgtttcgttaccg

SEQ ID NO: 23402 - DNA, 878 bp, Homo sapiens
  misc_feature: GYAE6OF01C8ZQ6.24.35.D02.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
  modified_base (487)..(487): a, c, t, g, unknown or other
  misc_feature (487)..(487): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagacgaccaccgganaaattgtgttgacacagtctccaggcacctgttctttcgctcgagggganacgacgcccaccctctccgtgccgacgggccacggccggtagttacgttaagtaaacgtacgttaggcgttacggtaaccaactaacgaaaccgtcgggaccaacgggtccctcccgaacgggtcccttccctacacttaccgttagtcgtagttccggttaccctaacccgaaacgggtacggggttaccaccggttccgggtccccggtaccccggccgtaaggtttccgagggtcggacgtagggtcgggtacgtcgggactacgtaccttccacgttaccnccgaacgtccgacgtcctaacgtcctaaggacgttcctaaggttaacgttacgtttttaccgggtaccgttttaacgttacgttcgtaacgaccgtccggttaaccgttccccgggttacccgtcccggtaccgggtacccggtttaacccggttacgggggttttacccgggggggaaccgggggtaacccgggggtagggggttaacggggaacgggaaccggggtaacgggttaaaccccgggtaacgtttccgggggtaaacggtccgggttaccggaaccgttaacccgtacgttccttaccgggtttccttaaccggttaccccgtttccccgttaccccggtacttaccggttactaaaccgggtccttaaggtttaaaccggg

SEQ ID NO: 23403 - DNA, 820 bp, Homo sapiens
  misc_feature: GYAE6OF01DADYQ.24.35.D02.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccagggganagacnccacccgtctccgtgcgacgggccaggccggtaagtggttagtaaagttacgttaggccttaggtaaccaacgaacgaaacctgggacccagggcctacccgacggtctccctacacttctatgacttcgtcctaccgaacgtcgggtccacgttccgggcccgtccccgtcgtaggttccaggttcggacgtagggttcgggtcttacggggaactacggtacccttcgaccttccgtaccgtaccgtcagcccaaggtcccttaaaggactccgttagtaacgttacgtttttacggtacggttttaacttaccgttcgttacgagggtacctacggttacccggtttcccgtaccggttccggtacccggttaccggtttaaccgggtttccgggggaaccgggggggtaaccgtacgggggtacgggtaaacgggtaggggtaaccggaacggttaacgggttacggggtcgggtacccgttacgggacccgtaaccgtacggttttcccgttaccgggtttaccctttccggttacccgttaccccgtttcccccggacccgtttaaccgttccggtttaaaccgtaaacccgtttaacggtttaaccgg

SEQ ID NO: 23404 - DNA, 631 bp, Homo sapiens
  misc_feature: GYAE6OF01APMH9.24.35.D02.1.454.CMB.1.raw
  modified_base (201)..(201): a, c, t, g, unknown or other
  misc_feature (201)..(201): n is a, c, g, or t
  modified_base (314)..(314): a, c, t, g, unknown or other
  misc_feature (314)..(314): n is a, c, g, or t
  modified_base (381)..(381): a, c, t, g, unknown or other
  misc_feature (381)..(381): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccacctctcctgcagggccagcccggagtgttagtaagtacttaggctaggtaccaactagaaaacctggaccaggctcccaggctcctcatctatgatgtctccaacngggtcactggacgtcccgcaggttcaggtgcagtgggtctgggacaggtacttcactctacaccgtnacgcagcctagagtcctagaatagttttgacggtttactactgtcagtcagtccgttaccgccgtcggcccgtacgttaacgtttccgggacggggggtaccgtagggggttacggagggtaacggaacggtaaccggtaacgtaggtacggcgttacggaccgtaacccgtacgttccgttagttcgtttaccggtaccttaccttaccccggtacctacgtaccgtacgtaaacctagtttaaaccgg

SEQ ID NO: 23405 - DNA, 637 bp, Homo sapiens
  misc_feature: GYAE6OF01DHHJN.24.35.D02.1.454.CMB.1.raw
  modified_base (200)..(200): a, c, t, g, unknown or other
  misc_feature (200)..(200): n is a, c, g, or t
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (433)..(433): a, c, t, g, unknown or other
  misc_feature (433)..(433): n is a, c, g, or t
  modified_base (473)..(473): a, c, t, g, unknown or other
  misc_feature (473)..(473): n is a, c, g, or t
tcagactactatgtcacgaccggtgctcgatttagcacacgatagttggggtttggggaggaactgctcagttaggacccagagggaaccagtggaagccccagctcagcttctcttcctcctgctactctggctcccagagaccacggagaaattgtgttgacacagtctcgaggccaccctgtcttgctcgagggganagcgccaccctctcctgcagggccaagccggagtgttacgtaagtacttaggcctgggtaaccaataacgaaaccgtggaccaaggcctacccgaggcctcctcattctattgattgtactccaaagngggtccacgtggacctccccgactgttccnggtcgctaggtcgggtactggacaggtaccttgaaccttcnccgtaaccgtnaaacggcaacgttcgtacggacnccgtaggaacgttcgttttcgacggttttacctacggttntaccagtccgagttcccgttcgccgtcggtaccgtcgttaaccgggtttccgggaccgggggtaccgtaggggttcggaacgtcggttaacgaacggttccgaacgtgggtacgctaggacctacgatctgttcctctacgtcctccctacatctagaacttag

SEQ ID NO: 23406 - DNA, 689 bp, Homo sapiens
  misc_feature: GYAE6OF01CF7AU.24.35.D02.1.454.CMB.1.raw
  modified_base (201)..(201): a, c, t, g, unknown or other
  misc_feature (201)..(201): n is a, c, g, or t
  modified_base (418)..(418): a, c, t, g, unknown or other
  misc_feature (418)..(418): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccgagggganagacgcccaccctctcctgcgagggcccaggccggtagtgttaagtaagtacttaggcttaggtaaccaacgaggaaacctggacccaaggcctcccaggcctcctacatctatgactcgtacctaccgaagtacggggtcacgtcgggacccgtccccggccgtaggttccaggtcggcgtaggtcgggtctgggacagtcttcactcgtcacgtnagcacgtacctagacgtcctagtaagttacttttcggtacggtttactaccgttgtacagcgtacgtccgttcccgccgtcgggtcccgtaccttaccgggtttccggggccggggggtaccggtaagggggtacgggaacgggtagggacggacgggtaacggttgggtacgggtactcgggacctaccgtacgtccttcggtttccgttaccgttacgttccccgtttacccgtaccttacttacgttacgtaaacgttagttaacggg

SEQ ID NO: 23407 - DNA, 757 bp, Homo sapiens
  misc_feature: GYAE6OF01DGQ75.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctcgaggggagagacgcccaccctctccgtgcgacgggccaggccggtagtgttaagtaagtacttaggctggtaaccaacagaacctggccaggcctaccacggcctcctcctctatgctcgtcctaccaccgacggtccccgtgggtctacccgacgccgtacgggtttcggttgggtcgggtgggtcgtgggactacggtcttttaccgacgttcctactaaccgtataccgacggtcccgcccgttaccgtacgttcgtaacggtaagtttacgttttacgtacctttactttttaacgtttcttacgtactaaacgttaacttagttacgggtacgtacgtccggttacccgttccgttaaccgttttacccggtttacgggacccgggtaacggggtaaaccctaaacggttacgggtaacgtaacgtaaccgtaaaacgtaacgttcgggtacggtctaccggaccgtaccgtacgttccgtttacgttcctttaccgaaccgtttccccgttacccggtaccttacttaccgtaaccgtaaacgtacggtttaaccggg

SEQ ID NO: 23408 - DNA, 923 bp, Homo sapiens
  misc_feature: GYAE6OF01CE53V.24.35.D02.1.454.CMB.1.raw
  modified_base (203)..(203): a, c, t, g, unknown or other
  misc_feature (203)..(203): n is a, c, g, or t
  modified_base (537)..(537): a, c, t, g, unknown or other
  misc_feature (537)..(537): n is a, c, g, or t
tcagactactatgtcacgaccggtgctcgatttagcacacgatagttgggtttgggggaggaactgctcagttaggacccagggggaaccatggaagccccagctcagcttctcttcctcctgctactctggctcccagagaccaccggagaaattgtgttgacacagtctccaggccaccctgtctttgctccgaggggganagacgcccaccctctcctgcgagggccaggccggtagttgttaaggtaacgtacgttaggctacgggtaacccaaactacggaaaacccgttcgggaccctaaggggtccccttaccccggacgggtccttacccctactacttaccgttaagtcggtaacttccggtaccctaacccgtaaacggtggggttaccctacggtcccggggtcccgtaccccccgtacggttacggggttctaacggggtcgggtccgtaaggggttcgggttaccggtcggggaactaaacggttacccgtttaccacctttacccggtcctaaacccccggtnaaaccgggtacccctacgggttaccctaagggggtaacctttcccggttaaaggtaaacggttttacggtttttaccggtaccggggttttaaacttcccgtttacggtaaccgtaccggtccgttaaccgggtcccggtttcccggtacccggttccggtaccccggtttaccggtttaacccggggttccggggggggtaaccggggtaacccgggtaggggtaccggggaacggaacggggtacgaaacccggtacgtgggtccgggaacgtccggtaacgtaccctacgtttcccgtacggtttaccttacccgttacgttccccgtttaccccggccttaacgggttccctaaacgtaaacgttggttacgggttaaccgg

SEQ ID NO: 23409 - DNA, 803 bp, Homo sapiens
  misc_feature: GYAE6OF01DVSWE.24.35.D02.1.454.CMB.1.raw
  modified_base (200)..(200): a, c, t, g, unknown or other
  misc_feature (200)..(200): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagacgaccaccggagaaattgtgttgacacagtctccaggcacctgtctttgtctccgaggganagacgccaccctctcctgcgacggcagtcagtgtgtacgcagcagtctaacttacgccgtacggtaccagacaacgaaccgtcggcctacggccgtacccgacggcctcccgtactacttcgtacggtcggtcgtccgtacccgaccggacgggtacccgtacgtcgggtaccggtccgggaccggtaacgtacgggtttacggacggtcgggacgtagggtcggtacggtttacggacttacggtaccttctaccttcgtactacgtacgtacgtacgtacgtaaggtaccgtacgggaaccgttaacccggtaagtttaggtttacgacggttagtttacgtttaacgttaccgtttcggttaccgtaggttttcccggttttccggttttacccggtttcccctttccgttttacccgttaacccgttttacgttaccgggttttaaaccttttccggggttttaccgtacccgggggttttaaccgtacccgggttacgggttacggttaaccgggtacgttaaccgttacgggtaaacggttaccggtaacggtttcgggtcgtaccgttacccggaacccttaccgttcgtttaccg

SEQ ID NO: 23410 - DNA, 770 bp, Homo sapiens
  misc_feature: GYAE6OF01B08UA.24.35.D02.1.454.CMB.1.raw
  modified_base (159)..(159): a, c, t, g, unknown or other
  misc_feature (159)..(159): n is a, c, g, or t
  modified_base (204)..(204): a, c, t, g, unknown or other
  misc_feature (204)..(204): n is a, c, g, or t
tcagactactatgtcacgaccggtgctcgatttagcacacgatagttgggtttggggaggaactgctcagttaggacccagagggaaccatggaagccccagctcagcttctcttcctcctgctactctggcctcccagagaccaccggagaaattggngttgacacagtctccaggcaccctgtcctttgcctccgagggganagacgccaccctctccgtgcgacgggccaggccggagtcgttaagtaacgtcgttaggctacggtaacccaagaagaaaccgtggacccgaaggcctccgaaggcctccgtacatccgtaatcggtaatcgtcctccgaaacgtcgggtcacgtcggaccgtccccgactaggtccagtcggctaggtggtacgcgggaacacggtacttccgaccgtcgtaccgaccgttcgacgtccgaacgtcctaggacgtaccgttacggtaacgttacgttttcgggtaccggtttacttaccgtcgttacgaacgtacggtacccgttccggtttacccggtcccgttccgggtacccggttacgttaaccggggtttccgggggacccggggggttaccggaagggggttcgggaaagggtacgggtaacgaacgggtaacgtcggggtacggtccggtacggtaccctacggttacgttacccgtttggttaccgtttcccgtaccttccccggttaacccccgtcccttaacgttacccgttaggaaaaccgttccgtttaaaggg

SEQ ID NO: 23411 - DNA, 776 bp, Homo sapiens
  misc_feature: GYAE6OF01CNY3G.24.35.D02.1.454.CMB.1.raw
  modified_base (177)..(177): a, c, t, g, unknown or other
  misc_feature (177)..(177): n is a, c, g, or t
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
tcagactactatgtcacgaccggtgctcgatttagcacacgatagttggggtttgggggaggaactgctcagttaggacccagagggaaccatggaacgccccagctcagcttctccttctcctgctactctggcctccagacgaccaccggaataaattgtgttagacacagtccnccgaggcctaccctgttctttgtcctcggagggganagacgcccacctctcncggacgacggcaggccgtagttagttaagtaacgtagttacggtcgtacggaaccaaacgaacggtaaaccgcgggacctaccgggaccctacccgacggtccttaccactacttctaaggttcacgttcgttacccaaccgaagtcgggtcctaaccggtcgggtaccctccccggacgtacgggttcagggtcgggtacgtacgggtgggttccgacggacgaacgttcccttaccgaccttccgacgaaccgtcgacgaccggagtacccgtagacccggttactaagggtaagtttacgttacgggttacgtttactaacgtccgtagacggtactcggtcccgttcggaccgtcggcccggttaagttaccggggttaccgggggacggggggtaaccggtaggggttaacgggaggaacgggaaccgggaacggtaggtacggtcggtccgaaccaccgtaacgttcgttccgttacggttcccttcggttaacccttcccggttacccacgttacgttacgaacgtaagtacggttaacg

SEQ ID NO: 23412 - DNA, 805 bp, Homo sapiens
  misc_feature: GYAE6OF01DPG0P.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagtaaattgtgttgacacagtcctccgaggccacccttgtctttgtcctccgaggggagacgacgccctaccctctccgtggcgacgggcccaggccggtaggttaggtttaagttaaacgttacgtttaggccttacgggtaacccaaacgaacggtaaacccgtcgggacccgacgggccctacccgagggtcccttaccctctaacttccttaagtgtacgttccgtacctaccgaacggtcggtaccgacggtcggtcccgtccccgacgtacggtttcgaggtcggacgtgggttcgggtccgtagggacctacgtaccttcgacgtccgtaccgtaccgtcgacacgtacgtcccgtaggaccgtccgttaaggtaacgttttacgtttttcgggacccggtttttaactccggttgtacccgaggtcccgtacggttccccggttacccgcccgttcgggacccgttacggtttaaccggggttccggggggaccggggtacgtaggggtcgggaacggtcgggaacggtaccggtagtgggccggtacttacggacccgtattaccggtttcttacgggttactttcccgaccgttttccccgtacccctacgttaccgtttagaaccgttaaggttgtttaccggg

SEQ ID NO: 23413 - DNA, 779 bp, Homo sapiens
  misc_feature: GYAE6OF01COWZ3.24.35.D02.1.454.CMB.1.raw
  modified_base (215)..(215): a, c, t, g, unknown or other
  misc_feature (215)..(215): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagacccaccggagaaattgtgttgacacagtctccaggcacctgtctttgactccgaggggacagacgcccaccctntcctgccgaggggtccaggtccgggagttggtttaaggtaaacgtacgttagggctacgggtaacccaacaacggaaaccgttcggacccgaagggcctaccccgagggtccttccctcactctagtgtaatcggttacctaccgaaacgtgggtaccaacgtccgggtcccgtccccgcgtaggttcccgaggtcggactagggtcgggttcgtacggggaactacggtacggtttacccaaccgtttcccgtaccaaacccgttacgtaccgaaccggccgttaaggttcccgtgtaccgtacggttcttaagggtaacgttagtttttcgacgtttaaagttttacgttaacgtcggtacacgtacgtacgactaccgaaggttcgtaacgtcggccctacgttacccgtacgggtttccggggaaccgggtaacgggaaccggtagggtacggtaaggtaaccgtaaccggaaacggtaacgttcgggtaggtcgtaccggtaccctaacgttacgtacgtttacgttaccctttaccgttaccgttcccgttaccccgg

SEQ ID NO: 23414 - DNA, 707 bp, Homo sapiens
  misc_feature: GYAE6OF01DH71A.24.35.D02.1.454.CMB.1.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcgagggccaggccggagtgttagtaagtacttaggcttaggtaaccaagacgaaaccgtggccaaggcctcccgaggctcctnatctatgatcgtctaccaagcgggtcacgtcggccgtcccgcgtaggttcaggtggcgtaggtgggtctgggacagtaccttcgactctcaccgtcagcacgctagacgtcctaggtaatcttttaggacgttttactacgttgtacgagcgtacgtccggttcccgccgtcgggtacccgttacgtttaaccgggtttccgggggaccgggggggtaaccgtaggggggtacgggtaacggggaacgggtaacggtaaccggtaacggttgggtacggggttacccgtacggaccgtaacccgtacgtttccggtttcggtttacctttaccgtaaccgtttcccccgttaccccggtaccttaaccgttcgtttaaacgggaaccttaggtttaaaccggg

SEQ ID NO: 23415 - DNA, 746 bp, Homo sapiens
  misc_feature: GYAE6OF01C2WV2.24.35.D02.1.454.CMB.1.raw
  modified_base (200)..(200): a, c, t, g, unknown or other
  misc_feature (200)..(200): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccacggagaaattgtgttgacacagtctcgaggcaccctgttcttgtctcgagggganagacgccaccctctccgtgcgacggccgagccggtagttggttaagtaagttacgttaggtctacggtaaccaacgtacggaaaccgtcggaccgacggccctacccgacggtcccttcctactacgttactagtcgtagttcgtacccgtaccgtaaacggtcgggtacctaccggtccgggccccgtaccccggtacggtacggttccgtagggtcggacgtcgggttcgggtcggtacggacgacgttaccttcctaccgtcctaccgcgtcgacgccgtacgaccgtaggacgtccgtagtagtttcgtttcggtacgtttactcgtcgtacgacgtcgtaccggtccgttccggccgtcggtaccgttaacgggttacgggtttccgggggacggggtcggtaaggggtacgggaagggtacgggaacgacggttaggttcggtaccggtcgtacgaccgtaccgtagttcggtacctttccgtacgtaccccgttcccttacccgtcttaacgttccgtaacgtacgttaggttaccggg

SEQ ID NO: 23416 - DNA, 686 bp, Homo sapiens
  misc_feature: GYAE6OF01D9MNL.24.35.D02.1.454.CMB.1.raw
  modified_base (397)..(397): a, c, t, g, unknown or other
  misc_feature (397)..(397): n is a, c, g, or t
tcagactactatgtcacgaccggtgctcgatttagcacacgatagttgggtttgggggaggaactgctcagttaggacccagagggaaccatggaagccccagcgcagcttctcttcctcctgctactctggctcccagataccactggagaagtagtcatgacgcagtctccagcccaccctgtctgtgtctccgaggggaaagcgcccaccctctcctgcagggccagtgagaatggtggcagcaacttgcctggtaccagcaagaaacctggaccaggcctcccgaggcctccctcctctatgtctcgtcctccgaccgacgggcccctggtcgtcccacgccgtaggttcgtgggtcggtgggtcgtgggacagtactttcacgtctcacctntcgacgccggcctccgagttcctaggtaagttacgtttttgacttaactttttagtttccttacggttacctaaacctacgtttaagttcgggtttacgtaccgtttccggtcccgttacccggttaaccttaacggtttttccggggaacccggtaacgggggtaaaccctaaacggttgggaacgttaacgtaacccgtaaaacggtaacggttggtaccggtacgtaccggaccacccgtattaccgttcgttacccttacctacctttcccgttcccccggtacc

SEQ ID NO: 23417 - DNA, 563 bp, Homo sapiens
  misc_feature: GYAE6OF01EK7OK.24.35.D02.1.454.CMB.1.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (406)..(406): a, c, t, g, unknown or other
  misc_feature (406)..(406): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccaggccggagtgttagtaagtacttaggctggtaccaacagaaacctggccaggcctcccaggcctcctnatctatgatgtcctccaacgngggtcacgtcggccgtccccgctaggttcaggtggcaggtcgggtctgggacagacttcactctcacgtcagcagcctagacgctgaagtnttttgacggttttacactgtcagcgacgtccgttccgcgtcggcccgtacttaacggtttcgggacgggggtaccgaggggtggaggaggagacgaagttggtcggcgtagcaccgtagtcttgtcttcacttcctcccgctactctgaactgtacg

SEQ ID NO: 23418 - DNA, 761 bp, Homo sapiens
  misc_feature: GYAE6OF01EWIF1.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctcaggcaccctgtctttgtctccgaggggagagagccaccctctcctgcagggccagccggagtgttagtaagtacgttaggctaggtaccaacgacgaaacctggaccaggcctccgaggcctcctcatctatgatgtctaccaacgtacgggtcacgtcggccgtcccgcgtaggttcgagtcggctaggtcgggtctagggactagtcttcacgtctaccgaaccgtcaacgctaaggtcccttaagaccgtaccgttaggtaacgtttacgttttacgggtaccgttttaacgtacgttcggttacgtaggtaccgttacggttcccggtttcccggtcccgttacggggtaccccgtaacggttttaaaccccgggttttccggggggaccggggggggtaacccgttacggggggtacgggaacggggttaacggggaacggttaaaccgggtaaccggttacggggttacgggtccgttacggtacccgtaaccgttaacgttccgttacgttccgtttacctacccgtttacccgtttacccccggaccttacgttaccgtacggtaaacctaggttaaacgg

SEQ ID NO: 23419 - DNA, 729 bp, Homo sapiens
  misc_feature: GYAE6OF01AQQ1H.24.35.D02.1.454.CMB.1.raw
  modified_base (242)..(242): a, c, t, g, unknown or other
  misc_feature (242)..(242): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagataccactggagaaatagtgatgacgcagtctccagcccaccctgtctgtgtctccgaggggaaacacgcccaccctctcctgcgacgggccagtcagagtanaagacgactaactacttagcctggtatacaacacgaaccgtggccagcctcccgaggtcctaccctcctcttactcgcctcggtcctcccgaccgtaccgggtccccgttcggtccgtaccccgacggtaccgtacgggtttcggttcggggtcgggtcggggtcggtaggggacgtaggttacgtttcacgttcctcacctagtccgacggtcccggaccttaccgtacgtccgttaaggtaacgtttacgttttcgtaacctttacgttttaacttttccgtacgttacctaaacctaccgtttagttacgggtttaccgtagttacccggtacccgtttcccggtttaacctttccggttttacgggaccccggtaacgggtaacctaacgtacgggaacgtacgtaaccgtaaacgtacgttggtacggtacgtacgcctaacctcgttccttcgttacttacgtccttcccgtacccgtacc

SEQ ID NO: 23420 - DNA, 812 bp, Homo sapiens
  misc_feature: GYAE6OF01D2MV9.24.35.D02.1.454.CMB.1.raw
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (543)..(543): a, c, t, g, unknown or other
  misc_feature (543)..(543): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctccagatcgccaccggagacattgtgttgacacagtcctccacgccctaccttgttctttgtcctaccggaaggggaaacncgccctacctctccngcgacggcagtnactatggtaggtaacgttgtacgcgtaggtactacgaacaaccaaacgtacgtcggaccgaccgggtcccgtcccccggtcttacccctctaacgtttctaacgttagacttcgacctaacgtaacccgaaggttaccggggaccctaccggttcgaaccctaccgttaacccgacggtaaccgttacggttacgagggttacggtcggtaacgggttcgggtacggtccgggaaactcggttaacccttcctaacggttacccacctaacgtactacggacgtacgtaggttacgtacgnggttaacgttaggtagtttacgtttacgggttaccgttacgttacgtagtacgtacgtacgtccgttccgttaaccgggtcccgtcgggttaacccgttaccgggttttaacccgggggtacgggggggtaccggggttaaccgggaggggttaaccggggaaagggttaccgggtaacgggtaaccgggtaacggtcgggtacggtacggtccgacccgtagtccggtttacgtttcgtaacccgtttcgttaccgtccggttacccg

SEQ ID NO: 23421 - DNA, 653 bp, Homo sapiens
  misc_feature: GYAE6OF01BKOJQ.24.35.D02.1.454.CMB.1.raw
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (416)..(416): a, c, t, g, unknown or other
  misc_feature (416)..(416): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccaccctctcctgcagggccaggccggagtgttaagtaagtacttaggctggtaccaacagaaacctggccaggcctcccgaggcctcctcctctatgctcgtctacccgaccgacgggcccctggtcgtcccgagccgtaggttcgtgggcggtggtcgngggacagtattcactctcactntcagccgcctcagttcagtaagttntttcgacttacgttttattcgtgtacctaactacttagtggtacgtacgtcgtcccttacgtactttaccggtttcggaccggaacgggtaacctaacggtggaacgtaacttaaccgaaacggtacgttggtacggacctaggaccctaacccgtggttccttgttacccttcttacccgtttcccgttacccccggtacttaccttaccgtaacgtaaaccgtttcgttaacggg

SEQ ID NO: 23422 - DNA, 892 bp, Homo sapiens
  misc_feature: GYAE6OF01D40JY.24.35.D02.1.454.CMB.1.raw
tcagactactatgtcacgaccggtgctcgatttagcacacgatagttgggtttgggggaggaactgctcagttaggacccagagggaaccatggaacgccccagctcagcttctcttcctcctgctactctggcctcccgagacgaccaccggaagaatttgtgttcgacacagtcctccgaggccacccgttgttctttgtcctaccggaggggagacgacgcccctaccgtctcctcgcgacgggccacggccggtagttagttacggtaacgttacgttaggcttacggtaaccaaacgtacggtaaaccgtcggtaccgaacggtcccgtacccggacggtccttaccgtacgaacttcttaagtcgtacgtccgttacctaccgaaccggtacgggttaccaccgggttacccggtcccggttacccccggtacggttacggttccggtaacggtaccggtacggtacggggttcggtacggtacggaaccgtacgtaccggtttacctaccgttccctaaccgtaaccgtccgtaaaggcccgtaacccggtaaccgtggtaacccgtacggttaacgttaacgtttacggtttaccggttacgtttaacgttacgtaccgtcgtaccggtaccggtaccggtttccggttacccggtccggtaccggtacccgtttacccgggttaacggggtttccgggggaccgggggttaaccgggtacgggggttaacggaccgggtaacgggtaacggttaaccgtaacgggtacgggtacgtaccgtacgttaccgacggttacgtaccggttcgtttaaccctttccgtaccgttaccccgttacccggtacttaccggtaacgttacgtaaccgttaggttaaccgg

SEQ ID NO: 23423 - DNA, 603 bp, Homo sapiens
  misc_feature: GYAE6OF01A53ZB.24.35.D02.1.454.CMB.1.raw
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (313)..(313): a, c, t, g, unknown or other
  misc_feature (313)..(313): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (425)..(425): a, c, t, g, unknown or other
  misc_feature (425)..(425): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctcgaggggnagancccaccctctcctgcngggccagccggagtgttaagtaagtacttaggctggtaccaacagaaacctggccaggcctcccaggctcctcatctatgatcgtctccgaacngggtcacgtggcccgtcccgcaggttcagtcggctaggtcgggtctgggacagtacgttcactctcaccgtnagcagcctagacnctagattatttgcgtttactgtgtacngtcgacgtccgtccgccgtcggccgtacgttacggttccggggcggggaaccgagggtcggaaggtcgggaagtaaccggtacgtgggtacgcgttaggcccaacgtacgttccgtggttaccctttccgacctttcccgttacccgcgtattacccgttacgaaacttggtaaaccg

SEQ ID NO: 23424 - DNA, 660 bp, Homo sapiens
  misc_feature: GYAE6OF01ACX8M.24.35.D02.1.454.CMB.1.raw
  modified_base (197)..(197): a, c, t, g, unknown or other
  misc_feature (197)..(197): n is a, c, g, or t
  modified_base (379)..(379): a, c, t, g, unknown or other
  misc_feature (379)..(379): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagacattgtgttgacacagtctccagcacctgtcttgtctcgagggaanagccacctctcctgcaggccagtcgactatgtagagttgtagctggtactcgaactacaaactagtcggaccaggccgtcccggcttcctcgactctaagtgactcggaccactaccgaaagttcgggaccctactggtacactacccgagacgtacggttcaggtcgacgtggtcggtcgnggactgtacttcgactctcgacactcgtacggccgtacctcctaacgtcgtacgtaacgttagtttgacctttaacttttcgtttactacgttactaacgtctttaagtccgggttactaccgttacggtacccgttaccgttacgttacggtttaccgggacccgggttaacgggacctaaacggttacggaagtaaccgtaacgaaacggtaccgtagggttaccgcgtaccgtaccgttacgtaccgttcgttacgttaccgtccgttacgttccccg

SEQ ID NO: 23425 - DNA, 688 bp, Homo sapiens
  misc_feature: GYAE6OF01A64SI.24.35.D02.1.454.CMB.1.raw
  modified_base (207)..(207): a, c, t, g, unknown or other
  misc_feature (207)..(207): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatgccaccgggagacattgtgttgacacagtctccagcccaccctgtctttgctccgaaggggaaacncgcccaccctctcctgcgagggccagtgactaagtgttaaggaagttcgtagccgttaggtaactacaaacaactaaaacgagtcggaccgacggtccctccccggccttacctactacttcctaatcggtaactcggtacctaccgttacccgaaacggttaccggggaccctaccggttaggacccctaacgttacccccgaaagtaccggaacggtttaccgaaggtggaccgtaggggttcggggtaacgtgggaaccctaggtaccctttacgaccttaccacaacccgtattcgaacgtacgtacggtacggtaaggtacgtaccgtaggtaacgttattttacgacgtttaagttttacgtactcgttacgactacggactacgacctaacgtcgtccctacgttccgccgtggaccagctagacctactaccgacgtagtcgtcgctacgcctacattcgtcctgttctaccg

SEQ ID NO: 23426 - DNA, 640 bp, Homo sapiens
  misc_feature: GYAE6OF01A3H1U.24.35.D02.1.454.CMB.1.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
  modified_base (413)..(413): a, c, t, g, unknown or other
  misc_feature (413)..(413): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagcccaccctctcctgcagggccagccggagtgttagtaagtacttaggctggtaccaacagaaacctggccaggcctcccaggctcctnatctatgatgtcctaccaacgtagggtcacgtcggccgtccccgctaggttcaggtggcaggtgggtctgggacagtacttcactctcaccgtcacgcacgcctagcgtcctagaagtnttttgacgtttactattgtcagtcacgtcgttccgcgtcggcccgtacgttacgtttcggggaccgggggtaaccgtagggggtacgggaaggtacgggaacggtaaccggtaacgtcgggtcggaccgtcggtaccgtaacccgtacgttccgttcggttccttcgtaccgttccctttacccccggtacctaccgttaccgtacgtaaaccgtagttaaaccggg

SEQ ID NO: 23427 - DNA, 633 bp, Homo sapiens
  misc_feature: GYAE6OF01BAIR8.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcgacgggccaggccggagttgttaagtaagtacttaggctggtaccaaacacgaaacctggaccaggcctacccgaggcctcctcatctatgatcgtctaccgaacgtaggtcacgtcggccgtccccgctaggttcaggtcggctaggtggtctgggacagtacttcactctacgtaccgtcacgcacgcctaggacgcctagtaagttacgttttcgacggttttactacgtgtacagtccgtacgtccgttccgccgtcggcccgtacgttaaccggtttccgggggacgggggtaccgtaggggtggaaggtagggacgtaacgacgtggcggcgtacgacgtaccgtagttccgttgttccttcgaccttcccgttccccgctaacgttctacgtaacgtagtacgg

SEQ ID NO: 23428 - DNA, 639 bp, Homo sapiens
  misc_feature: GYAE6OF01C2BQB.24.35.D02.1.454.CMB.1.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
  modified_base (395)..(395): a, c, t, g, unknown or other
  misc_feature (395)..(395): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcagggccagccggagtgttagtaagtacttaggctggtaccaacgagaaacctggccaggcctccaggctcctcatctatgatgtctaccaacgnggtcacgtggccgtcccgcaggttcagtcgctaggtggtctgggacacggtacttcactctcgaccgtcagtcagcctagngctagaagtatttgcggttttacacttgtcagtccgacgtcgttcccgccgtcggcccgtacgtttaaccggtttccgggggaccggggggtaccagggggtacgggtaacggaggggaacggtacggtaacgtcgggtacggtacgttcgggacctaaccgtacgtccgttacgggttccctttaccgaccttttcccggttaccccgacccttaacgttccttaaacgaacttaggtaaacg

SEQ ID NO: 23429 - DNA, 763 bp, Homo sapiens
  misc_feature: GYAE6OF01B4JFV.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgttctttgtctccgaggggagagacgccaccctctcctgcgaggccacggccggagttgttaagtaagtacgttacggcgtaggtaaccaacgaacgaaaccgtggacccgaagggtccctcccgaacggccttcccgtcctataccgtagtcgtattcgtacctaaccgaacgtacggggtcctacgtccgggtaccccgtcccccggaccgtacgggttcgtacgggtcggtacgacgggttgggttccgttacgggaaccgtacgtaacccttccgtaaccgttcctacccgaccggtacacgcgtaacgtccgtaacgtaccgtccgtaagtaagtttcgtttttacggtaccggttttacctacgttacgtacgtagtacccgtacggttccgttcccgcccggttcggtcccgttaccgttacgggtttcccgggggacggggtacggtaggggtacgggaagggtacgggaacggtaccgtaggtacggcgggtccgacgtccgaacgtcgttcgtcttcccgttcgtaccgttcccgttcccgaccttacgtccgttacgaagttgttaaccgg

SEQ ID NO: 23430 - DNA, 605 bp, Homo sapiens
  misc_feature: GYAE6OF01AWQW1.24.35.D02.1.454.CMB.1.raw
  modified_base (201)..(201): a, c, t, g, unknown or other
  misc_feature (201)..(201): n is a, c, g, or t
  modified_base (416)..(416): a, c, t, g, unknown or other
  misc_feature (416)..(416): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagacgccaccctctcctgcagggccagccggagtgttagtaagtacttaggctaggtaccaacagaacctggccaggctcccaggcctcctcatctatgatgtcctaccaacgtgggtccacgtcggcccgtccccgctaggttccagtcggcaggtcgggtctgggacacgtacttcactctccacgtcagcagcctaggacgcctagtaagtnttttgcggtttactacgtgtcagcacgtcgttccgccgtcggtccgtcttacgttcggggacgggggaccgtaggggcggaggtacgggacgacggtaacgtgggtcggcgtcgccgaacgtacgttcgttacgttccttcctaccgtttcccgttccccgtactaccttcgacgtaactaagttacgg

SEQ ID NO: 23431 - DNA, 812 bp, Homo sapiens
  misc_feature: GYAE6OF01DJBBC.24.35.D02.1.454.CMB.1.raw
  modified_base (536)..(536): a, c, t, g, unknown or other
  misc_feature (536)..(536): n is a, c, g, or t
  modified_base (787)..(787): a, c, t, g, unknown or other
  misc_feature (787)..(787): n is a, c, g, or t
tcagactactatgtcacgaccggtgctcgatttagcacacgatagttggggttgggggaggaactgctcagttacggacccaggagggaaccagtggaacgcccagctcagcttctcttcctctgctactctcggcctccgagacgaccgaacggtaagtaattgtgtagacactagtcctcgaggcctacccgttgttcgtttcgccgtacggaaggggagacgaccgccctacccttcctccgtaggacgacgggccgacggtccgggtagttacggttaagtaacgttacgttaggacgtacggtaaccaagaacgtaacgtcgaccgacgtcctaccggagtcctcctatacgttctagtcgtacttccggtaccctaaccggtaacggtaccggtaccgtaccggtccccgggtccccgtaccccggtacggttaacggttacggacggggtcggtaaccggtggggttccgggtaccggtaacgggaaacctacggttcctaccgtaaccgttcccgtaccgaccggtanaccggacgtacggtaccgtagaccgtacggttaagttacggtttcgttttccgaccgttttacaggtcgtagtacgacgttccgtccggtacctcgggtacggtacccgttacggttacggggtccggggggacgggtacggaagggtacggaagggtaacggaacggtaccggtagtccgggtcgtacgcccgaaactaccgttcgtccggttactttcccttaacgtcccgttaaccctcccgaacttntacgtaaccgtaaaggttagttcgg

SEQ ID NO: 23432 - DNA, 968 bp, Homo sapiens
  misc_feature: GYAE6OF01DR0MV.24.35.D02.1.454.CMB.1.raw
  modified_base (960)..(960): a, c, t, g, unknown or other
  misc_feature (960)..(960): n is a, c, g, or t
tcagactactatgtcacgaccggtgctcgatttagcacacgataggtttggggtttgggggaggaactgctcagttaggacccaggagggaaccatggaacgccccagctcagcttctcttcctcctgcttactctggcctccgagacgacccacggaagtaagttgtgttacgacacgtagtcctaccgacggcctacccgtttgttccgttttcgtccgtaccgggaagggggagtacggaccgtaccccctacccgttcctaccgtcggacggaaccggggtcccgacgggtacccgggtaggtttacggtttaaaggttaacggttaaccggttttacgggccgttaaccgggtaaaacccaaaacgaaccggtaaaacccggtcggacccgtaaccgggacccttacccggaacggtcctacccgtactacttacgttaacgtgtacgtttacgtaccgtaaccgaaacggtacgggtaccctaccggttcccggtaccccggtcccccggtaacggttacgggttacgtcgggttcggacggttaacggttcggggttccggaacggactaaccggttacttaccgtaccgtttccgaacccgtaccgtaccgtacgacccgtaacgtacccggtaaggtaccgttacgtaagtttaacggtttacgtttttaccgggtacgtttttaaacccgtacgttcgtacgtaacggttacccgccggtttcccggttcccggtaccggttaccggtaccccggtttaacccgggttttaaccgggggttacccgggggggaccgggggtaaccggttaagggggagggtaaacggggacgggtaaccgggacggttaacgggcgggttacggaccgtgtaacccggacttacgtccgtttacggttcccttaacctccgttacccctcccggtaacttacgtacgtacgttaaaccgnggttacgg

SEQ ID NO: 23433 - DNA, 800 bp, Homo sapiens
  misc_feature: GYAE6OF01AJ2IV.24.35.D02.1.454.CMB.1.raw
  modified_base (741)..(741): a, c, t, g, unknown or other
  misc_feature (741)..(741): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagacgaccgaccggaagtaaattgtgttagacactacgtctccgaggcctacccttgtctttcgtccgtccgaggggacgacgaccgccctaccctctccgtcgaccggacgggaccgacggaccggtaggttacgtttaacggtaacgttacgttacgggtccgtacggtaaccaacgtaacggtaacccgtggtaccgacggcctacccgacggtccttccctactattccttaagtcgtacttccgtaccgtacccgtaaacggtcgggtacctacccggtccggtccccgtaccccgtaccggttaaggttccgacgggtccggtacggtacgggttcgggtcggtacggaccgtacgttaccgtaccctacgtcctcccgtacgtcgacgacctaccggtacgtaacgcccgtacgtaacgttagtttacgttttccggttacggtttactaccggtcgttacgacgtacgtcgttaccccggttccgtcccggtacggtaccccgtttacgttaaccggggtttccgggacgggggttaacggacgggggtaggaacgggtacggacggtaccggtaggtcggacggtgaccgtacncgttcgtcgttctaccttcgtcccttccgacccttacgtctaactcgtaactacggtag

SEQ ID NO: 23434 - DNA, 599 bp, Homo sapiens
  misc_feature: GYAE6OF01E1PQJ.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagcccacctctcctgcagggccagccggagtgttagtaagtacttaggctggtaccaacagaaacctggccaggcctcccaggctcctcatcatgatgtcctccaacagggtcacgtggccgtccccgctaggttcagtggcaggtggtctggacagcttcactctcaccgtcagcagcctagcgacctgaagtatttgtacgtttactacgtcgtcagtcagtcgttaccgccgtcggccgtacgttaaccggtttcgggaccgggggtaccgaggggtacggaggagggacgacggtaacggtaggtacggcgtcgccaccgtacgtccttaggtaccttcgtaccttcccgttaccccgtacctacgttacctcgtaaaccgtagttaacgg

SEQ ID NO: 23435 - DNA, 780 bp, Homo sapiens
  misc_feature: GYAE6OF01EKM48.24.35.D02.1.454.CMB.1.raw
tcagactactatgtcacgaccggtgctcgatttagcacacgatagttgggtttgggggaggaactgctcagttaggacccagagggaaccatggaagccccagcgcagcttctcttcctcctgctactctggcctccagactaccacgtggagaagtagtcatgacgcagtctccagcccaccctgtccttgtcgttcaccggagggaaagcgccaccctctcctgcgacggccagtgaagtaagttggttcgacagacttaacgtcgtccgaggtaccacgacaaccgaaccggtcgaccgacgcccgtaccgacggtccctcccgtcctcgtacgtccgtacgtccgtacccgtacccgacccggacccgggtcccgttcgggttacccgtaccccgtacgggttccgggttacggttttaccgggggtcgggttccggggttccgggttacgggtacgggtaacgttacgttacggtttcctaaccgttcctaccgaccgtagtcccgacggaccctccgtaccgtacgttacgtagttacgtttacgttcgttaactttacgttttacgtaccgttaccgacttaaacttcgttacgtacggttacgtacgtccgggttaccttcgttaaccgttaccggttaccggaaccggtaccggtaaaccgtagtacggtaacgtaaccgtaaccgtaaccgttaggtacgtacgggtactaccggtaccgtacctaacgttccgttacttccttaccgtccttcccgttacccgtaaccg

SEQ ID NO: 23436 - DNA, 782 bp, Homo sapiens
  misc_feature: GYAE6OF01DCEZR.24.35.D02.1.454.CMB.1.raw
  modified_base (198)..(198): a, c, t, g, unknown or other
  misc_feature (198)..(198): n is a, c, g, or t
  modified_base (626)..(626): a, c, t, g, unknown or other
  misc_feature (626)..(626): n is a, c, g, or t
  modified_base (673)..(673): a, c, t, g, unknown or other
  misc_feature (673)..(673): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcacctgtcttgtctcgaggganagacgcccacctctcctgcgaggccaggccggagtcgttagtaacgtacttaggcttacggtaaccaacgagaaaaccctgggacccaacggccctacccgaggtcccttccctacaacttccgttaatcggtaacgtttcgttaccctaaccgaaacgtacggggttccaacggttccgggccccgtaccccgtaccgtaagggttccgaagggttcggacgtacggttcggggtcctgggaacctggtaaccctttcaccgttcctcgtacccgcacgtcgacgtccgttagacgtccgtaaggtacgtaccgtttttaggtacccggtttacttaccggttaatccgaacgaccgtacggttccgttccccggtcgtcgggtacccgtacgtttaacgggtttcccgggggacgggggtaaccgngggggtacggaacgggttagggaccgttaaccgggtactggggtacnccgggttaacgccgttaaccgcgttttacgggcccttttacggtttccccaaccgtttccccgttaacccgtccttaacgtttccgaaccgtaacgtagtttaaccggg

SEQ ID NO: 23437 - DNA, 771 bp, Homo sapiens
  misc_feature: GYAE6OF01DSZA5.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagacgaccaccggagtaaattgtgttagacactagtctccaggctacctgtcttgtctcgaggganagacgccacctctcctagacgacgggcctagtacaggtagtgttaagcagcgagtacttacgtacgcctaggtaccaggacaacgtaaaccgtcggccgtcggaccttacccgacggtcctacctccaacgtttccgtaagttcggtcgtccgtacccgaccggtacggccctacggtcggtacggtccggacggtacgtcggttacgacggtggtccgtaggtcgggtacgttttaggaaccgtacgtacgtttaccgaccgtttactacgtaccgtacgtaccgtacgaaccgtacgtaccggtaacggaccgtaaccgttaaggttacgttcgtaaccgttagtttacgttaacttacggtcgttaacggttcgttacggtttaccggtttaccgttccccgtttacccttccgttacctttaccggtttaacgtttaccggttttaccggtttaccgggtacccggttacgggttccggtaaccggttacgggtaacgtaccgttaacgtacgtacggtaacggtcgttcgggtactacgtaccggtacctgtcgtttacccgg

SEQ ID NO: 23438 - DNA, 696 bp, Homo sapiens
  misc_feature: GYAE6OF01BYO65.24.35.D02.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (299)..(299): a, c, t, g, unknown or other
  misc_feature (299)..(299): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccgagcacctgtcttgctcgaggganagacgccaccctntccgtgcgagggccaggccggagtgttaagtaagtacttaggctaggtaaccaagacgaacctcggaccaggcctaccgaggtctcctanactctactggattcgtacctacgaacgtacgggttccacgtcggacccgtccccgacgtaacggtttcaggttacggccgtagggtcgggttacgtagggaacctaggtacttcaccgttactaccgtaccgtacgacgccacggtacctaggacgtaccgttacgtaacgtttagttttacggtaccggtttaacgttacgtacgtaccgaagtaccggtacgtccggtttaccgcccgttacggacccgttacggttaacggttccggggacggggaccgtaggggtcggagtagggacgtacggtaacgtcggacgtcgtataccgaccgtacgttacgtcgttcttacgtccttccgttacccgtactacgtacgtaagtaccgtggttaacg

SEQ ID NO: 23439 - DNA, 830 bp, Homo sapiens
  misc_feature: GYAE6OF01E0W87.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgttctttgtctccgagggganagacgccaccctctccgtgcgacgggccaggcccgggagttgttaaggtaacgttacgttagggccttagggtaaccaaacgaaggaaacccgttggacccaagggccttccccgagggtccttcctctatccttaatgacttcgtcctaccgaaccgaggggtccaacgtcgggcccgttcccccgaccgtaggtttccgaggtcggcctagggttcgggtccgtaggggacacggtaccttcaccgtctccgaccgtcacggtcacgacccgttaaggacgcccgttaggaacgtttacgtttttcggtaccgggtttttaccctaacgtttcggttacgaaggtaccgaacggttcccggtttcccggtacccgttcgggtaccccggtacgtttaaaccccggggttttcccgggggccgggggggggttaaccggtaacggggggttacggggaacgggtacgggtaacgggtaaccggtaacggttccggggttaccgggtacgttacgggaccgtaacccgtagttaccggtttacggttcccgtttcccggtaaaccttccccgtttaccccggtccgtttacgttaccgtaaccggttaaacgtacgtttaaaccggg

SEQ ID NO: 23440 - DNA, 767 bp, Homo sapiens
  misc_feature: GYAE6OF01DWX00.24.35.D02.1.454.CMB.1.raw
  modified_base (197)..(197): a, c, t, g, unknown or other
  misc_feature (197)..(197): n is a, c, g, or t
  modified_base (565)..(565): a, c, t, g, unknown or other
  misc_feature (565)..(565): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagacgaccacggagaattgtgttgacacagtctccaggccacctgtctttgtctcgagggnagacgccacctcgtcctgcgacggcacggccggtagttgttaagtaacgttacgttacggcgttacggaacctaacgaacgtaaaccgtggaacccgacggcccgttacccgaggtcccttacctacctacttaccttagtacggtacttcgtacctaccgaaaccggtcggtaccgtacggtccgggtccccgttccccgacggttacggtttccgagggttcggaccggtagggttcggggtcgttacgggaactacggttacctcgtaccttaccgtccgaccgttacgactccggtactacggtaacgcggtacctaggtaacgttttacggtttccgttaccggtttactacggttcgtacgngtaccgtacgtccggtttcccgacgtcggtaccgtacggtttaacgggtccggggacggggtaactagggggtacgacgtaagggtacgtaacgtcgggttagcgtacgtacgcctaacgtcgttacgggttccttacttccggttacccttaccccggtccgtaccttaacgtactttaacggaaccgtttaagtaccggg

SEQ ID NO: 23441 - DNA, 778 bp, Homo sapiens
  misc_feature: GYAE6OF01A0K7D.24.35.D02.1.454.CMB.1.raw
  modified_base (197)..(197): a, c, t, g, unknown or other
  misc_feature (197)..(197): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccacggagaattgtgttgacacagtctccaggcacctgtctttgctccgaggganagacgccacccttctcctgcacgggccaggccggtagtgttaagtaagtacttaggctaggtaaccaacgagaacctggaccgaggcctacccgaggtcctcctcgattcctatcggtatcgtacctaccgaagtacgggtccaccgtcgggcccgttccccggacttaacgggttcacgggttggcctaggggttcggtaccgtcgggaacctaggtaccttaccacgttccgtccgaaccgtcaacggtcgaacggtacccgtagaacggttcccgtaaggtaacgtttacgttttacgggtaccggttttaaccttacgttgttaccgaacggttccgaacgggtttccggttcccgtacccggttcggtacccggttaccgtttaaccggggtttccgggggaaccggggggttaccgtaacgggggttacgggaacgggtaacggggagtaacccggtaggttacgggtacggcgttacggaccctaacgttcgttccgttaggttaccgttaaccgtccgttaccccgttacccgtactaacgttaccgtaacgtaaccgttaggttaaacccgg

SEQ ID NO: 23442 - DNA, 862 bp, Homo sapiens
  misc_feature: GYAE6OF01DV3DK.24.35.D02.1.454.CMB.1.raw
  modified_base (149)..(149): a, c, t, g, unknown or other
  misc_feature (149)..(149): n is a, c, g, or t
  modified_base (198)..(198): a, c, t, g, unknown or other
  misc_feature (198)..(198): n is a, c, g, or t
  modified_base (496)..(496): a, c, t, g, unknown or other
  misc_feature (496)..(496): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccacgganaaattgtgttgacacagtctccaggcacctgtctttgctccgagggganagagcccacctctcctgcgacgggccaggccggagttacgttaaggtaacgttacttgggcttgggtaacccaacgagaaacctggaccctaaggccttcccaggtccttcctacatcgtaatggtatcgttacctaccgaagacggggttccaacggttccgggacccgttcccccggaccgtttaacgggtttcccgtaagggtcggacccggtaagggtttccgggggtccgtttacgggggaaacctaacggtaacccttttccggaacctttcccgttaccgacccggttacncggtaccacggtccccgtaagaaccggtccgtaaggtaacgttacgttttcggtacgttttaccgttacgttacgtacgtacgtacgtacggtcggtttacccggtccgttacgggcccgttaccgtttaacccgggtttccgggggtaaccgggggggtaccggacggggttaggggacgggggtaacgggtaacgggtaaccggtaaaccggttccggggtaacgggtccgttaaccgggtcccgtaacccggttaacggtttccggtttaccgggtttaccctttacccggtaacgtttcccccgtttaccccgtacccgttaacgtttacccggtaaccgttaaacgtaacggtttaaacgg

SEQ ID NO: 23443 - DNA, 674 bp, Homo sapiens
  misc_feature: GYAE6OF01BX4FR.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggccaccctgtctttgtctccgaggggagagagcccaccctctcctgcgagggccaggccggagtgttaagtaagtacttaggctaggtaccaacagaaaccgtggaccaggcctcccaggcctcctcatctatgatgtcctaccaacgtacggtcacgtcggccgtccccgactacggttcaggtcggactaggttcgggtcgtgggactagtaccttccgactcgtcacgtcagcagcctagacgcctagaagttgttttagccggttttaactcgttgtacagtcctagtccgttccgcgttcgggccgtacgttaaccggttcggggaccgggggtacgtaggggtcggaggtaacgggacgtacggtaacgttcgggtacggccgtacggacccgaaccgttaacgttcgttaccgttaccgtttcccgtacgttcccccgtttaccccgtacctaacgtttacccgtaacgtaaaccgttacgttaaacgggg

SEQ ID NO: 23444 - DNA, 724 bp, Homo sapiens
  misc_feature: GYAE6OF01BHVC3.24.35.D02.1.454.CMB.1.raw
  modified_base (273)..(273): a, c, t, g, unknown or other
  misc_feature (273)..(273): n is a, c, g, or t
  modified_base (332)..(332): a, c, t, g, unknown or other
  misc_feature (332)..(332): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (579)..(579): a, c, t, g, unknown or other
  misc_feature (579)..(579): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgttctttgtctccgaggggagagacgcccaccctctcctgcgagggccaggccggagttgttaagtacgtacttaggcgtggtaaccaanacgaaacctggaccacggcctcccgagcctcctcatctatggattcgtcctaccaacgngggtcctacggtcggccgtccccgcgtaggttcaggtggcgtagggtcgggtccgtgggaacctagtacttccaccgtctaccnccggtanacggtccaacgtccgtaggacgtcgtagtaaggtttacttttcggtaccgttttaacgtcgttacgtacgtaagtccgacggttcccgtttcccggcccgtttacgggaccccgttccgtttaacccgggtttccgggggacgggggttaacccgngggggtaacggaacggggtagggtaacgtaaccgggtacggtgggtccgggtacgtcggcccttaaccggtcttccggtttcgtacccttacgtacgttcccccgttccccggtactaacttagaccgtaacttggttaaacggg

SEQ ID NO: 23445 - DNA, 601 bp, Homo sapiens
  misc_feature: GYAE6OF01EWYZW.24.35.D02.1.454.CMB.1.raw
  modified_base (292)..(292): a, c, t, g, unknown or other
  misc_feature (292)..(292): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccgaggggagagagcccaccctctcctgcagggccagccggagtgttagtaagtacttaggctaggtaccaacagaaacctgccaggctcccaggctcctnatctatgatgtctccaacgagggtcacgtggccgtccccgctaggttcagtggcaggtggtctgggacagactcactctcacgtcagcagcctagacgtcctagaagttattttgtacgtttaactactagtacagaccgagtccggttccgccgtcggccgtacgttaacggttccgggacgggggtaccgtaggggtacggaggagggaacgacgtaacgtggtcggacgtcgaccaccgtagttccgtaggttctctacgttcccttaccccggtacctacttaccgtacgtaaactgttaaacgg

SEQ ID NO: 23446 - DNA, 695 bp, Homo sapiens
  misc_feature: GYAE6OF01CSP1P.24.35.D02.1.454.CMB.1.raw
  modified_base (202)..(202): a, c, t, g, unknown or other
  misc_feature (202)..(202): n is a, c, g, or t
  modified_base (450)..(450): a, c, t, g, unknown or other
  misc_feature (450)..(450): n is a, c, g, or t
  modified_base (679)..(679): a, c, t, g, unknown or other
  misc_feature (679)..(679): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctccagagaccaccggagaaattgtgtgacacagtctccgaggccaccctgtctttgctccgagggganagacgcccacctctccgtgcgacgggcctacggccggtagttaggttaacgtaaagtcgttaacggcgtacggtaaccaaagtacggaaaccgttcgggaccacgggtcctcccgaagggtccttacctacgacttactacggtcgtacggccgttacccaaccggagggccccaggtcggcggtacgaccggtaacgtagttcgaggtcggcgtaggtggtcgttacgggactacgttactcacctntaccagtcgacgttacgaaccgtgacggtaggaccgaccgtaagtattacgggactagttagttacttacggagttcgtacgttcgttcggtttccgtacctccttcctacgttattacgttacttacgtttcggccgggttaacgtcgtacgtcgtcggagtactacgacgggtaacgtcgacgggttcggcacggtaccgtacgttcttacgtaccgttagttaccnccgttcccgttacccg

SEQ ID NO: 23447 - DNA, 693 bp, Homo sapiens
  misc_feature: GYAE6OF01BKU53.24.35.D02.1.454.CMB.1.raw
  modified_base (332)..(332): a, c, t, g, unknown or other
  misc_feature (332)..(332): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccaccctctcctgcagggccaggccggagttgttagtaagtacttaggctaggtaaccaagacgaaacctggaccacggcctcccgaggcctcctcacttctatgattcgtacctaccgaacgngggtccacgtcgggcccgtccccgcgtaggttcaggttcgccgtaggtcgggtctagggacagtaccttcgactcgtaccaccgtcacgcctagccgtaggacgtccgtaggtaagttacgttttcgtacggttttactacgtcgtacagtccgtacgtccgttccgtccgtcggtcccgtacgttaccgggtttccggggacggggggtaccgtaggggtacgggaacgggtaaggggaacggaacggtaacggtagggtacggtccgtacgtaccgaaccgttacgttccgttacggttccgttccgtaccttccccgttcccgtacctacgttacctacggaaacgttaggttaacgg

SEQ ID NO: 23448 - DNA, 769 bp, Homo sapiens
  misc_feature: GYAE6OF01DZWLE.24.35.D02.1.454.CMB.1.raw
  modified_base (199)..(199): a, c, t, g, unknown or other
  misc_feature (199)..(199): n is a, c, g, or t
tcagactactatgtcacgaccggtgctcgatttagcacacgatagttgggtttgggggaggaactgctcagttaggaccagagggaaccatggaagccccagctcagcttctcttcctcctgctactctggctccagagaccacggagtaaattgtgttgacacagtctccaggcctacctgttcttgtctcgaggganagacgccacctctccgtagcgacgggcacggcggtagttggttaagtaacgtacgttaggccgtaggtaaccaaacgaaggaaacccgtcggaccacgggtcctaccccgaggtccttcccgtactaacttaccttaagtcgtaacgttcgtacctaccgaaacggtacgggtccacgtccgggcccgttcccccgacgtaacggtttcgacggttggaccgtacgggttcgggtaccgtagggaacctacggtacctttaccgaccgttacctccggtaaccgtacgaccgaccgtaacggtcccttaaacgggacgtaccgttaaggtaacgttttacggttttacggttacgggttttaactaccggttcgttacggacgtacggtaccgtcccggttcccgccggttaccggtcccgtaacgttttacccgggtcggggtaccggggtaacggaggggtacggaggaacgggacgaacggtaacgtggtacggtcgtacgcctacgtacgttcgtcgtttcactccgttaccgtccctactagtaccgtactaaagtcgttaacgg

SEQ ID NO: 23449 - DNA, 937 bp, Homo sapiens
  misc_feature: GYAE6OF01D43KD.24.35.D02.1.454.CMB.1.raw
  modified_base (213)..(213): a, c, t, g, unknown or other
  misc_feature (213)..(213): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccacggagaaattgtgttgacacagtctccaggcaccctgttctttgtctcgaggggagagacgccaccctntccgtgcgacgggccaggccggtagttgttaagtaagttacgttaggcttaggtaaccaacgaagaaaccgtggaccaggcctacccgaggtcctacctcactactatgatcgtctaccgaacgtacgggtcacggtcggcccgtccccgtacgtacggttcgtaagggtcggtcgtacgggttcgggtacggtacggggaacctagggttaccttcccgaaaccgtttccgttacccgtaaccccggtacgtaaccggtacccgtaacggtaacccgttaaagggtacccggtacccgttaagggttaaacgggtttaccggttttttaaccgggtttaaccgggtttttaaacccgtttacccgtttaggtaacccggttaacggtacccggttaaccgggtttaccccggtttcccccggacccgggtttacccgggtacccccggttttaacccgggttttaaccccggggttttaccgggggggacccgggggggggttaaacccgggtaacggggggttaccgggggaacgggggtaacggggttaaacggggtaacccgggttaaaccgggttacggggttaccgggttccggttaccggaccccgttaccggttaacgttcccggtttcgtttacccgttttaccggtacccgtttccccggttaccccggtacctaacgttaccccggttaagtaaccgtaacggtttaaacggg

SEQ ID NO: 23450 - DNA, 893 bp, Homo sapiens
  misc_feature: GYAE6OF01DLV0X.24.35.D02.1.454.CMB.1.raw
  modified_base (216)..(216): a, c, t, g, unknown or other
  misc_feature (216)..(216): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccgacggagtaattgtgttagacactagtcctaccgaggcctacccttgttctttcgtccgtaccggaggggtanacgaccgccctacccttctaccgtcgccgacgggccacgggtccggtagttacggttaacgtaacgttacgttacggcttacgggaaccaacgtaaccggaaccgtcggacccgtacgggtcccttacccgaacggtcccttacccgtactacttaccgtacgttagtacgttccgtacccgtaccgaacggtcggtcctacggtcccggtcccgtacccgcgttacggttaccgaggtcggacgtagggttcggtaccggtacggtactaacggttaccttccgtacccgtaccgttacccgaccgttacgaccgttacgaaccggttacccgtaagaccgggttaccttaaggttaacggtttttacgtttccggtttaacggtttacgttaacgtttcggaaccttcggacgggttttaccccgtcccgggtttcccgacccggggttaccaccccggggtttttaacgggtaaccggggttcccgggggggaccgggaagggttaccgggggtaacggtagggtaaccggggtaacctaacggggttacggtgggtaccctcggtaccgaccctttaacggttcctttcgggtaccctttccgttaacctacccgtttacccccgtacgtaaaccttacggttaccccgttaagaaacggtttgttaaccggg

SEQ ID NO: 23451 - DNA, 797 bp, Homo sapiens
  misc_feature: GYAE6OF01A3DUX.24.35.D02.1.454.CMB.1.raw
  modified_base (204)..(204): a, c, t, g, unknown or other
  misc_feature (204)..(204): n is a, c, g, or t
  modified_base (513)..(513): a, c, t, g, unknown or other
  misc_feature (513)..(513): n is a, c, g, or t
tcagactactatgtcacgaccggtgctcgatttagcacacgatagttgggtttgggggaggaactgctcagttaggacccagagggaaccatggaagccccagctcagccttctcttcctcctgatactctggcctccagagaccaccggagaattgtgttgacacagtctccaggctaccctgttctttgtctccgagggganaggacgccacccttctccgtgcgacgggccaggccgggagttaggttaagtaacgttacgtttaggcttaggtaaccaaacacggtaaaccgtcggcccaagggtccctacccgaggtcccttcctacgtactcgtaacgttcgtaacgtcggttacccctacgaaaccggtacggggtacccacggttcgggtccccgtccccggtaccgttacgggttcctaacggggttcgaccggttaggggttccggggttccgacggggtaaccaacgggttaccctttaccgtacctccgtaccgaccgtanaccgtacgacgaccgtaggcgtaccgtagtaacgttacgttttcggtaccgtttactacgtcgtacgtacgtactaccggtacaaccgtaccgtccggtaacccttacgtttccggacccgttacggaccttaaggcctacgggaactacggtacccgtaacgtacgtaccggtcgtactaccggacccttaaccgttacgttcccggttacgttcccttacccgtaaccgtttaccccgttacccctaccgttaaagttaccctagggttaaaaccttacggg

SEQ ID NO: 23452 - DNA, 845 bp, Homo sapiens
  misc_feature: GYAE6OF01AUCCD.24.35.D02.1.454.CMB.1.raw
  modified_base (334)..(334): a, c, t, g, unknown or other
  misc_feature (334)..(334): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagtaattgtgttgacacagtcctccgaggcctaccctgttcttttcgcctaccggaggggagacgacgccccacccgtctcctcggcgacgggccacggccggtagttagttagtaagtacgtaggtcgtaggtaccaacaacgaaacgtcggccgacggctacccgacggctacctcgatactntcgtgtcgtcctaccaacggtacggtccaacggtccggacccggtcccccgtacggtacggtaccgacgggttcgggacgttacggggtccggtacggtacgggtaaccgtaggtaccttaccgtacttacccgtaccctaccggttacgaaccgggtctaccgtaccgtacggtaccgtccgtaaacggttacgtttaccgttttacggttaccggtttttaactacggtttacgtacgtacgtaccgtaccgggttccgttccgtacccgtaccgggtccgttaccggtttacccgggttaccggggacggggttaaccgtacgggttacggtacggggtaacggtaacgggtaacgggttacggtaacggttcgggtaccggtacggtacccgtaaccgtacccggttacgttacccggtttcccggttaccgttacccgttacccgtttcccccgggttacccctaccgttaacccgttccgtaaacgtaaccgttttaaacggggg

SEQ ID NO: 23453 - DNA, 681 bp, Homo sapiens
  misc_feature: GYAE6OF01BM0PH.24.35.D02.1.454.CMB.1.raw
  modified_base (358)..(358): a, c, t, g, unknown or other
  misc_feature (358)..(358): n is a, c, g, or t
  modified_base (592)..(592): a, c, t, g, unknown or other
  misc_feature (592)..(592): n is a, c, g, or t
tcagactactatgtcacgaccggtgctcgatttagcacacgataggttggggttggggaggaactgctcagttagaccagagggaaccagtggaagcccagctcacgcttctcttcctctgctacgtctgctccagacgaccacggtagtaaattgtgttacgactactacgtctccgaaggtcctacccgttgttcctttcggtacctaccggaaggggacacgaccgcccctaacccttctccgtggacgacgggcctaagggccggtaagttacggttaaggtaacgttaccgttagggcctacggtaaaccaacgacgtaaccgtggaccgaacgtcctccgaggtcctacctnacttcagtcgtactcgtaccaccgaacgtcggtcctaccgttcggccctcccgacgttacgttacgacggtcggacgtacggtcggggtacaccggatacggtacttccgactccgtacgaccgtcgacgtcgtacgccgtagccgtacgtagtacgttcgtttcggacgtttacgcgtacgtcgaacgtcgacgtccgtccgcgtcgacctcgttacggtcgggcgggtacgngggtcgaaggtacgcgtacgacgtcggacgtcgacgcgtaactcgtctcgttacgtcacgttccaccgtactatagactaacgtgtacg

SEQ ID NO: 23454 - DNA, 791 bp, Homo sapiens
  misc_feature: GYAE6OF01EOZ13.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaattgtgttgacacagtctccaggcacctgttctttgtctccgaggggagagacgccaccctctccgtgcgagggccaggccggtagttacgttagtaagttacgttaggctacggtaaccaaacgacgtaaaccgtggaccacggcctacccgaggtcccttcctccgtactactcgcttcgttccctaccgaccgaccgggtccccgtgggtccgtaccccgacgtcccgtagggtttccggtgggtcgggttgggtacgtcggggtaacaggttactttcgaccttcgtaaccaccgtagtccgacggtcccgtaccctaccgtagtacctaggtaacgtttattttcgtactttacttttacttcgttacgttaacctaactacgttagttacggttacgtacgttaccggtacccttaccgttaaccgtttaacggttttccgggaaccggtaacgggtaaacccgtaacggtacgggaacgttaacgttaaaccgtaaaccggtacgttacgggtaccggtcgtaccgtaacctaccgttacgttccgttcgtttacccttaccgtacccgtttaccccgttccccggtaccttaaccgttaccgtaaacggttaacgtaacggtttaaacggg

SEQ ID NO: 23455 - DNA, 739 bp, Homo sapiens
  misc_feature: GYAE6OF01A3F65.24.35.D02.1.454.CMB.1.raw
  modified_base (206)..(206): a, c, t, g, unknown or other
  misc_feature (206)..(206): n is a, c, g, or t
tcagactactatgtcacgaccggtgctcgatttagcacacgatagttgggtttgggggaggaacctgctcagttaggacccagagggaaccatggaagccccagctcagcttctcttcctcctgctactctggctcccagacgaccaccggagaaattgtcgttagaccacagtctccaggccaccctgtctttgctacgaggganagacgcctacctctcctgcagggccagccggatgttagtaagttacttaggctacggtacaacgagtaaaccgtggaccgacggcctaccaggcctcctcactctactgatcgtacctcgtaacgacggttccacgtcggaccgtccccgacgtggtttacgaaggtcggaccgtaggttcgggtacctagggaccctaggtaccttcgtaccttcgaccgtaacccgtgacggacgtacgtccggtacgtacgtacccgttaaggtaacgtttacgtttggtaccggttttactacgttacgtaccgtacgtcgaacggttccccggttaccgccggttaccggcccggttaacgtttacccgggtttacccgggggaccgggggtaccgtagggggtaccggaagggtacgggaacgtaacggggaccttacgggcggtaaccgtacgacccgtaacgtcgtcgttacgttaccgtcgtacccttccggtaccccgtactacttaccggtaagtaacccgttacgtaacgg

SEQ ID NO: 23456 - DNA, 791 bp, Homo sapiens
  misc_feature: GYAE6OF01ES9BA.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctcccagacgaccgaccggaagtaaattgtgttagacactagtcctccacggcctacccgtgttcttttcgtccgtaccggaggggagacgacgcccacccttcgtcctcgcgacgggccaggtccggtagttagttaagtacgttacgttacggcgtacggtaaccaacacgtaaccgtggacccgaacggtcctacccgacggtccctcctactacttctacgtgtacttcgtacctaccgaacggtacgggtcctacggtccggcccgtccccgtacgtacgttcgaggtcggacgtagggtcggtggtacggactacgtcttctacgtcctaccgccgtacgacgtcgtaacggtcgtacgcggtaccgtaagtaacgttttcgtttacggtacgttttactacgtcgtacaacggccgttaaccggttcccgtcccggacccgttcgggtaccccggttaaacggtttacccggggtcccggggggaccgggggttaacggacgggggtagggaaaccggtacgggtaaggtaacccggtgggtaccgggtcgccgttaacggacccttacgtccgtttaggtcccgtttacctccgttaccctccccgttacccgttaccgtattaccggaaacgtaactttcgtaacgggg

SEQ ID NO: 23457 - DNA, 818 bp, Homo sapiens
  misc_feature: GYAE6OF01CMD7Y.24.35.D02.1.454.CMB.1.raw
  modified_base (209)..(209): a, c, t, g, unknown or other
  misc_feature (209)..(209): n is a, c, g, or t
  modified_base (548)..(548): a, c, t, g, unknown or other
  misc_feature (548)..(548): n is a, c, g, or t
tcagactactatgtcacgaccggtgctcgatttagcacacgatagttgggtttgggggaggaactgctcagttaggacccagagggaaccatggaagccccagctcagcttctcttcctcctgctactcgtggcctccagacgaccacggagtaaattgtgttgacactagtcctccgaggccacccgtgtctttgtctacgagggganacgacgccctacctcgtcctgcgacgggccaggccggtagttagttaagtaacgtacgttaggcttaggtaaccaaagaacggtaaccgtcggaccgaacggtcctacccgaggtcctcctactatctagtgtactcgtcctaccgaacgtcgggtccaacgtccgggtcccgtaccccgacgtaacgggttccgagggtcggaccggtagggtcgggttaccgacggggtactaacggttaccttaccgacttcccgtaccgtaccggtacgacgaccgtaacggtcctaacgggacgtaccgttaggtaaacgtttgtttttaccggaccgttttanaacccgttgaccgtaacggccgttacgggtcccgttacggaccgttcgggtaccccggttacggttttaaccggggtttcccgggggggaacccggggggtaaccgtaaggggggggttacgaaaccggggggtaacgggtaacgggttaaaccgtaacgggttcgggttacggaccggttaccgaaccggtacttacggttcgttacggttacttaccggtacttcccccttacggaccctacttaccgaataaccggttattaccggg

SEQ ID NO: 23458 - DNA, 646 bp, Homo sapiens
  misc_feature: GYAE6OF01EUUWJ.24.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (397)..(397): a, c, t, g, unknown or other
  misc_feature (397)..(397): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccacctctcctgcagggccagccggagtgttagtaagtacttaggctggtaccaanagaaacctggccaggcctcccaggcctcctcatctagtgatcgtacctaccgaactaggggtccacgtcggcccgtccccgcctaggttcaggtggcaggtggtctgggaacagacttcactccgtaccacccgtnacgcacgccgtagacgccgtaggtaacgttattttcgtacggttttaacctactcggtctacgcgaggttcccggtttacccgccgtacgggtcccgtaccgtttaaccggtttccggggacgggggccgtagggggtcggagggacggagacggacgtgggtgtcgtggacccacgtagtccgttacgtcgttccacgttccccttccccggtactacgttaccgtacgtaaaccgtagtttaacggg

SEQ ID NO: 23459 - DNA, 736 bp, Homo sapiens
  misc_feature: GYAE6OF01B3KNG.24.35.D02.1.454.CMB.1.raw
  modified_base (201)..(201): a, c, t, g, unknown or other
  misc_feature (201)..(201): n is a, c, g, or t
  modified_base (266)..(266): a, c, t, g, unknown or other
  misc_feature (266)..(266): n is a, c, g, or t
  modified_base (322)..(322): a, c, t, g, unknown or other
  misc_feature (322)..(322): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccgagggganagagcccaccctctcctgcagggccaggccggagtgttaagtaagtacttaggctaggtaccaanacgaacctggccaggcctcccgaggcctcctcatctatgtatcgtcctaccaacgngggtccacgtcgggcccgtccccgcgtaggttcgaggtggaccgtagggttcgggtacgtggggaactaggtaccttccgacttccgtccaacccggtcaacgccaacggtccctaaggacgtaccgttaggtaacgttacgtttttcggaccggtttttaactacgttcgtacacgtccgtacggtccggtttacccgccgttacggcccgttacggtttaaccgggtttccgggggaccgggggtaccgtaagggggtcgggaacggtacggggaacggtaaccggtaacgttgggccggcgtcggaccctaaccgtacgtttccggttagttaccccgtttacgtaccgtttccccgttacccccggtaacttacgtttaccccggtaagtaaacccgttaggttaacggg

SEQ ID NO: 23460 - DNA, 738 bp, Homo sapiens
  misc_feature: GYAE6OF01EZXWX.24.35.D02.1.454.CMB.1.raw
  modified_base (208)..(208): a, c, t, g, unknown or other
  misc_feature (208)..(208): n is a, c, g, or t
  modified_base (403)..(403): a, c, t, g, unknown or other
  misc_feature (403)..(403): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccgggagaaattgtgttgacacagtcctccaggccaccctgttcctttgtctccgagggganaggacgcccaccctctcctgcgagggccagccggagtgttaagtaagtacgttaggcttacggtaccaacgagaaaccgtggacccaggcctcccgaggtcctccctcctctatcgactcgtcctccgaccgacgggtcccctggtccgtacccacgccgtagggtttcgttcgggcgggttggtcgtcgggacngtacttcacgtctaccactactccgagtcccggtccctaccgagttcgtagtaagttcttttcgtaccttacttttactttcgttcgtactaaaccgtacttagttcggtacgtaccgttcggtacccgttacccgttaccgttacgttttcgggaccggtaacggggtaacctaaccgggtacggtaacgtaactaaccgtaaaaccggtacgtacggtacggtaccgtacggtaccctacccttacgttaccgttaccgtttcccttaccgttacccgttacccgttacccccgtaccttacttaccgttaacgaaaccgttaggttaaccgg

SEQ ID NO: 23461 - DNA, 1035 bp, Homo sapiens
  misc_feature: GYAE6OF01CU0SY.24.35.D02.1.454.CMB.1.raw
  modified_base (210)..(210): a, c, t, g, unknown or other
  misc_feature (210)..(210): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggaagaaattgtgttgaacacagtctaccgaggccaccctgttcgtttgtcgtaccgagggganacggacgacccaccctcgtccgagcgacggccgacggtccggagttagttaaggtaacgtacgttaggacttaggtaaccaacgaacggtaaaacgtcggaccgaacggtcctaccgaggtccttacctactacgttacgtaagtagaacgttcgtacaccgtaaacgtacggggtacctacggtccggtaaccccgtccccggtaccgtaacgggtttacgtaacggtacgggtacggttaacggggttcggggttacgtaaggggaaccttaacgggtaccttacctaccgtttacccgtaccgtaacccgtacgaacgaccgtaacggtaacccgtaagggtaccctaacgggttaacggttaaacgtttacggttttaccgggttttaacggtttaaaccgtaaccggtttcgtaaccgtaacggtacccgttaccggggttacccggttttaccccgggacccggttaccgggggtaacccccggtttaacgggttttaaccccggggggttttaacccggggggacccggggggggtaaaacccggttaccggggggttaaggggggtaaaaaccgggtacgggggtaaaacccggggtaacgggttaaaccgggtttcgggggtaccgggtaaccggtttaaaccggtaaccccggttaaatttacccggggttttaaccgttttaccgggttttaaccccggtttaaccccgttaacccgttttacccccccggttaaccccggtaccccttttaaaaacgggtttacccggtttaaaaacccgttaaacggttttaaacccggttaaaaacggggg

SEQ ID NO: 23462 - DNA, 704 bp, Homo sapiens
  misc_feature: GYAE6OF01C3Z79.24.35.D02.1.454.CMB.1.raw
  modified_base (202)..(202): a, c, t, g, unknown or other
  misc_feature (202)..(202): n is a, c, g, or t
  modified_base (268)..(268): a, c, t, g, unknown or other
  misc_feature (268)..(268): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgccaccctctcctgcagggccaggccggagttgttagtaagtacgttaggctaggaaccaanacgaaacctggccaggcctccaggtcctcctcattcatgatgtacctaccaagcggtcacgtcggcccgtccccgctaggttcaggtcggacgaggtgggtactgggaacctagtaccttcactcctaccgaccgtcagtccacgtccgtaagacgtcctaggtaagttcgtttttacggaccggtttttacacgtttcgtacgtacggtaccgacggttcccgtttccccggcgttacgggtcccgttacgttaaccgggtttccggggggacgggggtaaccgtagggggtacggaagggtacgggaacggtaccgtaacgggttggtcgggtaccctaggaccctaacgtacgttccgttacgttccctttcgtacctttccccggttaccccgtaccttattacccggtaacgtaaacttcggtttaacggg

SEQ ID NO: 23463 - DNA, 823 bp, Homo sapiens
  misc_feature: GYAE6OF01EDJD3.24.35.D02.1.454.CMB.1.raw
  modified_base (208)..(208): a, c, t, g, unknown or other
  misc_feature (208)..(208): n is a, c, g, or t
tcagactactatgtcacgaccggtgctcgatttagcacacgatagttgggtttgggggaggaactgctcagttaggacccagagggaaccatggaacgccccagctcagcttctcttcctcctgctactctggcctcccagacgaccaccggagaattgtgttgacacagtctcaggcctacccttgttctttgtcctcggagggganagaccgcctacccttctccgtgcgagggacccgaggaccggtaggttacgtttaagtaacggtttaaccgttagggccttacggtaaacccaaacgaacgtaaaccgtcggaccgaacgggtccctacccggacggtaccttaccttactacttactaacgttcggtacttaccgtacctaacccggtaacggttacggggtaccctaaccggtccgggtacccccggttccccggtacgttaacggttacgtacgggtcgggtaccgtagggttcgggtaccgggtacggacctacggttaccttaccgacctttccgtaccgtaccggtcgtaaccggtactaaccggtaccgtaaggtacccgttacccgtaaggttaacggttttacgttttacgggtttaaccggtttaacttaacggttctaacggtacgtccgtaacgttcccggttacccgacgtccggtaccggtttacgtaccgggttcgggggacgggtacggtagggagaacgggaggtaaccgtaggtagtcgtggccgtacgacgtaaccgtgttcgttcgttactcctaccggttccctccgtacctagtaccgtaacgtatggttaacg

SEQ ID NO: 23464 - DNA, 686 bp, Homo sapiens
  misc_feature: GYAE6OF01C1OGH.24.35.D02.1.454.CMB.1.raw
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (281)..(281): a, c, t, g, unknown or other
  misc_feature (281)..(281): n is a, c, g, or t
  modified_base (410)..(410): a, c, t, g, unknown or other
  misc_feature (410)..(410): n is a, c, g, or t
tcagactactatgtcacgaccggtgctcgatttagcacacgatagttgggtttgggggaggaactgctcagttaggacccagagggaaccagtggaagccccagctcagcttctcttcctcctgctactctggcctccagagaccaccggagaaattgtgttgacactagtcctaccaaggcctacccgtgtccgtttgccaccgagggganacgacgtccacctctccngcgagggtccaggccggtaagtgttagtaagtcgttaggctaggaaccaanacgaaacctggaccacggcctaccgagctccacagtcctatagacttcgtaccaccgtaaacgtcggtccaacgtccgggaccttccccgagtacggttaccaggttcggacgtacgggttaccgggtntacgggaacttaggtacctataccgtactaccgacgtacaagtcccgagtacccgtagacgtactagtaacgttcgtttacgacggtttacagttcgacgtagtcgacggttccgttcgccgtcgtacgtaccgttaaggtccggggacggacgtagggcgtaacggacgacggtacgtagttggcgtaccgtgaccaaccgtgttccttaagggcctttaacgcccgttccccgttaccaacccttattaccgaacgtaaacgttgttaaaccgg

SEQ ID NO: 23465 - DNA, 932 bp, Homo sapiens
  misc_feature: GYAE6OF01AMFSX.24.35.D02.1.454.CMB.1.raw
tcagactactatgtcacgaccggtgctcgatttagcacacgatagtttggggtttgggggaggaactgctcagttaggacccagagggaaccatggaagccccagctcagcttctcttcctcctgctactctggcctcccagacgaccaccggagtaaattgtgttgacacagtctccaggccacccttgtctttgtcctccggaggggagagacgcccaccctctcctgcgacgggccaggccggtagttaggttagtaacggttacgttagggccttacggtaacccaaagtaacggaaaacccgtcgggacccgaacgggtcctaccccgaacgggtcccttcccgtactaacttcttaacgttggtaacttccgttacctaacccgtaaacggtacggggttacctaaccggttccgggtccccggttacccccggtacggttaccgggtttccgtaacgggtcggtacggtagggttcgggtacgttaggaacggtaaccgtacggttaccttaccgtaacccgttccgttaaccctacccgggttacaaccggtaccgaacgggtaccccgtaagggtacccgttacccggtttaaggtaaaccggtttttacggtttttacccgggttaaccgtttttaaccgttaccggttcggttaaccgtaacggttccgtaccggtttcccgggttaccccgttcccgggttacccggggtacccgtttaccggttttaccccgggggttacggggggtacccgggggtaaccggggtagggggttaaccgggtaaggggtacccgggtaacgggtaaccggttaacggtcgggttccgggaccttcccgggaacttacccgttcgttccgttaccggtttacttcccgtactttcccggtaccctcttacgttaccgtacgtattacggg

SEQ ID NO: 23466 - DNA, 738 bp, Homo sapiens
  misc_feature: GYAE6OF01BH2PE.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccagcaccctgtctttgtctcgaggggagagcgccaccctctccgtgccgagggccaggccggagttgttaggtaagtacgttaggctaggtaaccaaacaacgaaaccgtgaccgacggcctcccgaggcctcctcactctatgatcgtcctaccgaacgagggtccacgtcggcccgtccccgaccgtaggttcaggtggcgtagggtgggtccgtaggacgagtaccgttcactcccgtacacccgtcacgcgtagcccgtagacgcctagtaacgtttgtttacgtcgtttaactcgtacgtcagtcgacgttccggttcccgtcgtccggtcccgttacggtttaccgggttccgggggacgggggtaaccgtaggggggtacggacgggtacgggacggtaacggtacggtcgggtcggtccgtcggaccgaacccggttaggtttcccccggttagttcccgttttacccggtaccctttttacccccgggaccccccggtttccgtttaaacgtttaccccggttaaacgttaacccggttaagttttaaacccggggg

SEQ ID NO: 23467 - DNA, 969 bp, Homo sapiens
  misc_feature: GYAE6OF01DGHU2.24.35.D02.1.454.CMB.1.raw
tcagactactatgtcacgaccggtgctcgatttagcacacgatagttggggtttgggggaggaactgctcagttaggacccagagggaaccatggaagccccagctcagcttctcttcctcctgctactctggctcccagatgccaccggagactattgtgttagacacagtctccacgcccacccttgtcctttgtcctaccgaaggggaaacacgcctaccctctcctgaccgacggggcctaggtcgaactaagttaggttaaggtaagtttcgttacggtccttaggtactaccaaaactaacgaaaacgtgtacgggtacccgaaccgggtccccgttcccccgggtaccttaccccctacgttaaccttccgtttaagtacggtaacgttccgtacctaaccgttacccgtaaaacggttaccgggggaaccctacggttacgggtaccctaaacgttacccccggaaaggttacccggttaacgggtttaccggacggggttacgggaaccggttagggggttacggggttacggttaccgggggaaaccttaaccgggttaaaccttttcccgtaaaacccggttccccttaaccgaacccgtaccgttaccggtaagtacccgggttaagggttaacggtaacgggtaaccgttacccggttaaagggttaaaccgttttaagtttttaccggttaacttttaacggttttttaaacgggttaccccgtttaggttaccccggtaaccggtccgttaaaccccgggttaaccgtaacccgttaacccgggtttccccggtaacccgtttacccgggttttacccccgggtccggtaacccgggtacccacggttaaccggtacgtaacccgtaaccgttacccggaaacggttacgtcgggttacgaccccgtcgaccccttaacgttcccttacgttacccctttgtacccttaccccg

SEQ ID NO: 23468 - DNA, 786 bp, Homo sapiens
  misc_feature: GYAE6OF01EX8N4.24.35.D02.1.454.CMB.1.raw
  modified_base (725)..(725): a, c, t, g, unknown or other
  misc_feature (725)..(725): n is a, c, g, or t
tcagactactatgtcacgaccggtgctcgatttagcacacgatagttgggtttgggggaggaactgctcagttaggacccagagggaaccatggaacgccccagctcagcttctcttcctcctgctactctgcctccagcgaccaaccggataaattgtagttagactacacgtcctccgacgtcctacccgttgttctttcgaccgtcggaaggggagtacgaccgtccctacccttcgtccgtgaccggacgggaccacggccggtaggttagttaacgtaacgttacgttacggacgttacggaaccaaacgaacgtaaccggtcgaccgtaaccgtccgtaccggacgtcccgtacctaccgtactacgtacggtccttacgtcccgtaccgacccggtaccgggtcccgttccgttaccgacggtaccgttacggggtttcggttggtcggggttcggtacgtacggggacttaggtacgttcccacgttcacttaccgactacggcggtcccgtactacgtaccgttagttacgtacgtttatttccgttactttacttttacgtcgttaccgttactaacgttcgtaacgttcggtaccgtcggttacggtccctttacgtaccgttcggttaccgtaccgggtaactaacggtacgacggtaactacggtaaacgttacaggttcggacttaccgagtacccttacgcttttccgtntacccgttcgtacccgttccgtaaccgtcttaccgtaactaactaacgttggtaacctagg

SEQ ID NO: 23469 - DNA, 795 bp, Homo sapiens
  misc_feature: GYAE6OF01CE7ZO.24.35.D02.1.454.CMB.1.raw
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
  modified_base (451)..(451): a, c, t, g, unknown or other
  misc_feature (451)..(451): n is a, c, g, or t
  modified_base (764)..(764): a, c, t, g, unknown or other
  misc_feature (764)..(764): n is a, c, g, or t
tcagactactatgtcacgaccggtgctcgatttagcacacgatagttgggtttgggggaggaactgctcagttaggacccagaggaaccatggaagccccagctcagcttctcttcctctgctactctggctccagagacctacggagaattgtgttagacacagtctcgagccacctgtctttgcctacgagggnagacgacctccctntccgngcacggccacggccggagtacgttaagtaacgtcgttacggacgttacgaacaacacgaacgtcggacgacgtcctacgacgtctccatactctaagtangttcctaccacgtaagcggtaccgagtccgtcccgtaccggcttagggtactacggcgtaccggaggttcggttacgacgggaacctaacggttctaacgcccgttacgtaaccccgtacgaccgtacggtaaacnccggttaaccggtaacgtaccgttaacgttagtaacgtttttacgttcgggtttaacctttacgttccgtaagtcgttaaacgccggttacgtccccggtacgtccggtaaccggttacccgttaaccggtttaaccgggggtccggggaaccggggtaggttaggggaacggtaaccggaggggtaaacctacgggtttaccgtggaaccgttaccgggagttaaccccgtacggttaccggttacgttttaacccggtcttaaccggtttaacccccgttaccgtaaccccggtttccaacccggtttaanaaaacggtttaaacgttcgggttaaacccgg

SEQ ID NO: 23470 - DNA, 818 bp, Homo sapiens
  misc_feature: GYAE6OF01B3MWA.24.35.D02.1.454.CMB.1.raw
  modified_base (113)..(113): a, c, t, g, unknown or other
  misc_feature (113)..(113): n is a, c, g, or t
  modified_base (156)..(156): a, c, t, g, unknown or other
  misc_feature (156)..(156): n is a, c, g, or t
  modified_base (199)..(199): a, c, t, g, unknown or other
  misc_feature (199)..(199): n is a, c, g, or t
  modified_base (545)..(545): a, c, t, g, unknown or other
  misc_feature (545)..(545): n is a, c, g, or t
  modified_base (567)..(567): a, c, t, g, unknown or other
  misc_feature (567)..(567): n is a, c, g, or t
  modified_base (726)..(726): a, c, t, g, unknown or other
  misc_feature (726)..(726): n is a, c, g, or t
  modified_base (806)..(806): a, c, t, g, unknown or other
  misc_feature (806)..(806): n is a, c, g, or t
tcagactactatgtcacgaccggtgctcgatttagcacacgatagttgggtttggggaggaactgctcagttaggacccagagggaaccagtggaacgcccagctcagcttcncttcctcctgctactctggctccagacgaccacggagaattgngttcgacacagtctccaggcacctgttcttgcctcgagggganacgacgcccaccgtctccgtagacgacgggaccaggacccgggtagtttacgggttaacgttaaacggtaccgttttaacgggaccgtttacggggtaaaccccaaagtaaaccggtaaaaccgtgggaaccccgtagggtaccccgtacccggtaacgggtccctaccccttaccgtaaacttaccgttagtacggttaacgttcggtaccctaaaccggaaacggttcggggtaccttaccgggtccgggtacccccgtacccgtacggtacggtttacgacgggttaccgacggttacgggttcgggtacgtacggactacgtactccgtactctacgtaccngtacgcctagtaccaggtaccncgtttagaagtttaccgttttacgggacgtttttaccgagttacggtacccgaagtcccgtacgttaccggtcccgtaccgtcgtaccgtacggttaccggtacggggacggggtacgtacggggaacggtggacgtaacggtacgtaagcgggttacncggtacctccgtaaccgttcttccgttggttaccctgttacccctaccgggttcccaagttaccttagggacttaaacgngtttaaaccggg

SEQ ID NO: 23471 - DNA, 1035 bp, Homo sapiens
  misc_feature: GYAE6OF01EB8SC.24.35.D02.1.454.CMB.1.raw
tcagactactatgtcacgaccggtgctcgatttagcacacgatagttgggtttgggggaggaactgctcagttaggacccagagggaaccagtggaagccccagctcagcttctcttcctcctgctactctggctccagagaccgacggagaattgtgtgacacacgtctcacggccacccttgttctttcgtccgtccggaggggagagacgccctaccctcctccgtgcgagggccgaggccggtagtgttaagtagttacgttaggcgttacggtaaccaaacaacggtaaaccgtcggaccgacggacctacccgacggtcccttacccgttactaacgttaccttaagttgtacgtttccgtacctaacccggaaacggtaccgggggttaacctaccggggttacccgggtcccccgggttaccccccggtaccggtttaacggggttccgtacggggttcggggtaccgggtaagggtttccggggggttaacggttacgggggtaaccgtaaccggtttaaccgtttaccctaacccggttcccttaaccccgggtaacccgtaccgaacggtacccgtaaaccggtaacccggtaacggaacccggttaccgttaagggttaaacggtttttaacggtttttaccggggtttaaccggtttttaacccgtttacggtttacggtaacccgtacggtacccgttaaccccggggtttccccggtttacccgggtccccggttacccgggttaaccccgggtttaacccggttttaacccgggggggtttcccgggggggaacccgggggggtaacccgggggtagggggttaacgggggaacgggggtaacgggtaaaccggggtaaaccggttaacccgggttgggggtacccgggcgttacccgggtacccgttaaaccgttcgggttttcccggtttaccgtttcccggtttaaccttaccccgtttacccgtaccccgttacccttacgttaccgtaacgttaaccggttaaggttacccggg

SEQ ID NO: 23472 - DNA, 636 bp, Homo sapiens
  misc_feature: GYAE6OF01AVK18.24.35.D02.1.454.CMB.1.raw
  modified_base (381)..(381): a, c, t, g, unknown or other
  misc_feature (381)..(381): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggaaagagccaccctctcctgcagggccagtgacaatgttaggaagttgtagcctggtatcaacacaaacagtggccaggcctcccggctcctcctctatgctgtcctccaccacgggcccctggtcgtcccgacgcctaggtttcgtggcggtgggtcgtgggacagatttcgactctccacntcctagccgtcctcagtctagaacgtatttcgtctacgttttattcttgtaccaactacttagtcggtgtaccgtcggtcccttacccgttacttaccgttttacgggaccgtaacggggtaaccctaaacggtcgggtaacgacgttaacgaaacggtaacctaggtcggtaccgtacgtacccgaaccgtaccgtcttacgttcttaccgactttccccttacccgcccttaactccttacgtaacgttaacg

SEQ ID NO: 23473 - DNA, 904 bp, Homo sapiens
  misc_feature: GYAE6OF01EO1PG.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctcccagacgaccacggaagaattgtgttgacacacgtcctccgaggccacccttgttctttcgtccgtaccggaggggtacgaggacgcccctacccgttcctccgtgaccggacgggccagggacccgggtagtttaggtttaaggtaacgtttacggttaggtacgttacggaaccaaaccgtaacggtaaaccgtcggacccgtacgggtacccgtacccgaacggtccctacctactaattaccgttactgtaacgttccgtacccgtaccgtaacgggtacgggttaccgaccggttaccggtccccggtaccccggtaccgttaacgggttccgtacgggtcggtacgttacggggttcgggtacgttacgggaactaccgggttacttacccgaccgtttccgtacccgtaccgtacgacgtaccgacgtaccgtacgacgtccgtaaggttacgtttacgtttaggtccgtttactacggtagtacgtacgcctcgggtttaccgtcccggtacgtccggtaaccgtttcccggtttaacggggttccgggggggaaccgggttacggaagggggttacgggaaacggttagggggaaccgtaaccgggtttacggtacggggttcggaccgtcccgttaaaccccgtagtttaccggtttccccgttttaaggttaccccgttagtttaccccctttacccccggggttaaccctaccggtttacgaaccggttaaacttaacggtttggtttaacccggg

SEQ ID NO: 23474 - DNA, 752 bp, Homo sapiens
  misc_feature: GYAE6OF01DJIS6.24.35.D02.1.454.CMB.1.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (306)..(306): a, c, t, g, unknown or other
  misc_feature (306)..(306): n is a, c, g, or t
tcagactactatgtcacgaccggtgctcgatttagcacacgatagttgggtttggggggaggaactgctcagttaggacccagacggaaccatggaagccccagcgcagcttctcttcctcctgctactctggctccagataccactggagaagtagtcatgacgcagtctccagcccacctgtctgtgtcnccgaagggaancgccacctctccgngcgagggccagtgagtaatcgtggcagactaactgaccgtggtaccagctaagaaccgtggaccacggctacccgaggacctcctcctntacgttgaccgttgtacccgtacccgaccggtacgggccccttgggtacccgtacccgacgtaccgttagggttccgttgggggtccgttcggggtactggggaactacggttaactttccgacctttacgtaccgacctagtaccgtaggcccggtacctcccggtaagttacgttaacgtaaaggtttactttttacggtactttaacgttttaactttccgttacgtaccgtaaacgtacgttaacgttcggtaaccgttaccgtcgggttacccgttaccgttaaccgtacggttttcccgggaaccggtaacggggtaaaccctaaacggtacgggtaaacggtaacgtaaaccgaaaacggtaacggtttcggtacggtacttcggaacctaaccgtacttacgtcgtttaccttacgtacttaccccgttccgtaaccc

SEQ ID NO: 23475 - DNA, 792 bp, Homo sapiens
  misc_feature: GYAE6OF01DD1L9.24.35.D02.1.454.CMB.1.raw
  modified_base (421)..(421): a, c, t, g, unknown or other
  misc_feature (421)..(421): n is a, c, g, or t
  modified_base (496)..(496): a, c, t, g, unknown or other
  misc_feature (496)..(496): n is a, c, g, or t
  modified_base (557)..(557): a, c, t, g, unknown or other
  misc_feature (557)..(557): n is a, c, g, or t
  modified_base (599)..(599): a, c, t, g, unknown or other
  misc_feature (599)..(599): n is a, c, g, or t
  modified_base (702)..(702): a, c, t, g, unknown or other
  misc_feature (702)..(702): n is a, c, g, or t
  modified_base (761)..(761): a, c, t, g, unknown or other
  misc_feature (761)..(761): n is a, c, g, or t
  modified_base (771)..(771): a, c, t, g, unknown or other
  misc_feature (771)..(771): n is a, c, g, or t
  modified_base (780)..(780): a, c, t, g, unknown or other
  misc_feature (780)..(780): n is a, c, g, or t
tcagactactatgtcacgaccggtgctcgatttagcacacgataggttggggtttgggggaggaactgctcagttaggacccagagggaaccagtggaacgccccagctcagccttctcttcctcctgctactcgtggcctccagacgacccgaaccgggaagtaaatttggtgttacgaacacgtacggtcctaccgaggccctacccgttggtttcctttcggtaccgtaccgggaagggggacgaacggtaccgcccctaacccctccgttcccgtagggccgaacggggcccgacggggtccgggtaaggtttaggtttaaacggttaaacggttacggtttacgggccgttaacgggtaaaccaacgtaaacggtaaaccgtcggaccgacggccctacccgacggtcctccgtanacttgtacgtgtacgtccgtcctaaccgaacggtagggtccaccggtccggacccgtccccgacggtagttacgngggtcgtacggtacgggtgggtaccgtggaactcgtcgtacaccgtcaaccgtcagcgganacgctagcgctagtaagtttcgttcgtactcgtagtcgacgngaccgtcggtcccgttcgcccggtccgacggtttaacccgttacggggtccggggaaccgggggtgaagggtacgggacggtaacggggtactaaaccggggngttgaccgggtacgtacgacccgtagtcgttaccggtcttacttaccggtcctacccgntacccggttnaccgttaanaaacgtggtacg

SEQ ID NO: 23476 - DNA, 779 bp, Homo sapiens
  misc_feature: GYAE6OF01BYCKU.24.35.D02.1.454.CMB.1.raw
  modified_base (200)..(200): a, c, t, g, unknown or other
  misc_feature (200)..(200): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaagttgtgttgacacagtctcaggcaccctgtctttgtctcgagggganagacgccaccctctccgtgccgaggggccaggccgggtagttggtttaaaggtaacgttacgtttacgggcgttacgggtaacccaaacgaacggtaaaacccgttcgggacccgaaacgggcccttaccccgaaggggtcccttcccgttaccgtaacttccttaagtcggtaacgttcgtacccttaacccgaaacgtacggggttccacggtcggtcccgtccccgacgtacggttcgaggttcggcgtacgggtggtacgtcgggactacggtaacctttcaccgtcctacctaccggtcaaacggtccgagttaacccgtaggacgtccggtaagtacggtttagttttacgtacggttttaactacgttcgtactacgtcgacgttcccggttaccgcggttccgacctaacgtttacggttccggggcgggggaaccgtaggggtagggacggtaagggacgtaacggaacgttgggcggacgtacgccgtaacgttcgtacgttcgtttacctccgtacctttacccggttccctacccgttatacccgttagaaaccgttgttaaacggg

SEQ ID NO: 23477 - DNA, 912 bp, Homo sapiens
  misc_feature: GYAE6OF01EAZDW.24.35.D02.1.454.CMB.1.raw
tcagactactatgtcacgaccggtgctcgatttagcacacgatagttgggtttggggggaggaactgctcagttaggacccagagggaaccagtggaacgccccagctcagtcttctcttcctcctgctctctcggcctcccagagacccgaccggaagtaatttgtgttcgacacgacgtctccgaggccctacccgttggtttccttttcgtccgtaccggagggggagtaacgaccgtcccctaccccttcgtcccgtggacccggtacggggacccgaacgggccgggttaaggtttaggtttaacggttaacggttacgttacgggtccgttaacgggtaaacccaaacgtaaccggtaaacccggtcggacccgtaaccgggaccccttacccgggtaagtccccttacctacgagtttaccttaagtctacgttcgttacccgtaaaccgtaacgggttcgggttaccctacggtcccggtacccccgttaacccccgtacgttaacgggtttcgacggttcgggtaccgtagggttcgggtacggttacggaaccgttaccgtacctttcgacccgtccgttacccgaccgacgtacggccgtaaccggtaccgtaggtaccgtacgtaggtttaaacgttttcgttttaccgggtacgttttacctacgttcgaccgtcgtccgtaccggttcccgtaccggtccgttacgggtcccttttaacggggtccgggttacccgggggacggggtaggtacgggacggtaacgggagtacccgggaagtaccgggtggtaccggacgtcggttaccctaacgggttccttcggtttacttacccggtttcctccccgttaccctcccgtataacccgttaccgtaaagtaccgtttgtaaacccgg

SEQ ID NO: 23478 - DNA, 820 bp, Homo sapiens
  misc_feature: GYAE6OF01AMP6I.24.35.D02.1.454.CMB.1.raw
  modified_base (207)..(207): a, c, t, g, unknown or other
  misc_feature (207)..(207): n is a, c, g, or t
  modified_base (362)..(362): a, c, t, g, unknown or other
  misc_feature (362)..(362): n is a, c, g, or t
tcagactactatgtcacgaccggtgctcgattttagcacacgatagttgggtttgggggaggaactgctcagttaggacccagagggaaccatggaagccccagctcagcttctcttcctcctgctactctggcctcccagagaccaccggagaaattgtgttgacacagtctccaggccaccctgttctttgtctccgaggggagngacgcccaccctctcctgcgagggccaggccggagttgttagtaacgtacgttaggctcggtaccaacaagaaacctggccacggcctcccgaggctccctcgatctatgattcgctaccaacgcgggtcacgtcggccgtccccgctaggttcngggtcggcgacggttgggtcgtacgggaaccgtacggtacctttccgacctttccgtacccgaacccggtttacgacgtacccgtaccggacccgtttaaggaccggtaccccgttaaggtaaccggtttacggtttttttaccgggaccggttttttacaaacccggtttgttacccgaacgttacccggacggtttccccgggtttacccggtacccggttcgggttaaccccggttaccgtttaacccggggttttccgggggggaccggggggtaacccttaggggggtacgggaagggtaccgggaaggtaaccggttaccggttagggtaccggccgttaaccgggacctaccgtacgggtttcccttcggtttaccctttacgaccccggtttttcccctaccccccgggttcaacgtttccctaaacgggaaacctttacggttaacggg

SEQ ID NO: 23479 - DNA, 707 bp, Homo sapiens
  misc_feature: GYAE6OF01BWNIE.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtcctccaggcaccctgtctttgtctccgagggganagacgcccaccctctcctgcagggccaggccggtagtgttaagtaagtacttaggctacggtaaccaagaacgaacctggacccaggcctcccgaggtcctcctacatcgtatcgattcgtccaccgaacgtggtaccacggtcggccgtccccgcgtaggttcaggtcggacgtagggttcggtcgtagggacctagtaccttcgacttcctaccgaccgtcgaacgcacggtacctaggacgtaccgtaggtaacgttacgttttggtaccgttttacgtacgtcgtacgacgccgtacgtcccgttccgccggttcggacccgtaccggtttaaccgggttccgggggtaccgggggtaacccgtaggggggtacgaacgggtacgggtaacggtaacgggtaaccgttgggtcggacccgtgacccgtacgtcttcgttcttaccgttccgaccttccccgtccccgtacttacgttaccgtacgtaactcggttaacgg

SEQ ID NO: 23480 - DNA, 767 bp, Homo sapiens
  misc_feature: GYAE6OF01B9A1X.24.35.D02.1.454.CMB.1.raw
  modified_base (204)..(204): a, c, t, g, unknown or other
  misc_feature (204)..(204): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccggagaaattgtgttgacacagtctccaggccaccctgtctttgtctccgagggganagacgcccaccctctcctgcgagggccagtcagagtgtagcagcagctacttacgcctggtaccagcaacgaaaccgtggcctggcctccccgaggcctccctcatctagtggtcgccgtacccaccgacgggaccctacgtcggaccgtccggacggtacgtacgggttcaggtcggacgaggttggtcgtttacgggacctagtaccttaccgtacttccgttaccacgttccgaacttaccggaaccaacggtaaccgttacggggaaccggtaccccgtaaaggttacgttttcggacctaagggtttagtttaactttaccgttacggttacgtacggtttaccgtttcgggtttaccggttccccttacctttaccccggtttaccctttacgtttaccgtttaacccgttttaacccggtttttccgggtacccggttaccggggtttacccgacggggttcccgttaggggtacgttaaccggttacggaaacgggtaccgttaaacggttcgggtccggttaccgtcggtacccgtacccgtaacgtttcccgg

SEQ ID NO: 23481 - DNA, 669 bp, Homo sapiens
  misc_feature: GYAE6OF01DOR1R.24.35.D02.1.454.CMB.1.raw
  modified_base (202)..(202): a, c, t, g, unknown or other
  misc_feature (202)..(202): n is a, c, g, or t
  modified_base (440)..(440): a, c, t, g, unknown or other
  misc_feature (440)..(440): n is a, c, g, or t
  modified_base (621)..(621): a, c, t, g, unknown or other
  misc_feature (621)..(621): n is a, c, g, or t
  modified_base (644)..(644): a, c, t, g, unknown or other
  misc_feature (644)..(644): n is a, c, g, or t
  modified_base (659)..(659): a, c, t, g, unknown or other
  misc_feature (659)..(659): n is a, c, g, or t
  modified_base (662)..(662): a, c, t, g, unknown or other
  misc_feature (662)..(662): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagacgaccacggagaaattgtgttgacacagtctccaggccaccctgtctttgctccgagggganagacgcccaccctctcctggccacgggccctagccggagttgttaagtaagtacttaggctaggtaccaacgagaaacctggaccctaggcctacccgaggtcccttccgtacacgttctaagtgtacttcgtacctaccgaaacgtacgggttaccacggttcggcccgttccccgcgtaaggttcccaaggttcgacgtacggtgggtacctgggaccaggtacccttcaccttcncaccggtactaacggctaacgaccttaaggaccgtaccgtaggtaagtacgttttcggactttaacgttttatttccgtacttacctaaacgtcttaacgtggtacgtacgtccgtccctacgtaccgttacgtttccggaaccgtacgggaacctaacgtacggactaagtacaaacgtntaggcgactcgacctcattcgtntctctacttctaccnctntcgtacg

SEQ ID NO: 23482 - DNA, 787 bp, Homo sapiens
  misc_feature: GYAE6OF01D6ZML.24.35.D02.1.454.CMB.1.raw
  modified_base (200)..(200): a, c, t, g, unknown or other
  misc_feature (200)..(200): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccacggagaattgtgttgacacagtctccaggcaccctgtctttgtctccgagggganagcgcccaccctctccgtcgcgacggccacggccggtagttagttaagtaacgttacgtacggtcgtacggtaaccaaacgaacgtaaaccgtcggccgacggtcccgtacccgacggtcccttcctactacttcgtatacgtcgttcggtacctaaccgaacggtacgggtacctacgggtccggtcccgtccccggcggttacggtacgacggtcggtacggtacgggttcgggtacggtacggactacggtaccttccacgttccgtaccgtaccgtcacgtccgacgtaccgtaacgacgtccgtaaggttaacgttttaccgtttcgggttaccgttttaactacggtcgtaacgtagtacccgtcggttcccgttacccgtccggtaccggttcccggttaacgttttaccgggggtccggggggtaaccggggtacgggttacggggtaacgggacgggtaacggtaaccggtacggtacggttggaacggtctacggacctacgtacgttcgtttacgtacttcccttaccgttcccgtaccccgtattacggttaccgtaaacgttacgtgttaacgg

SEQ ID NO: 23483 - DNA, 875 bp, Homo sapiens
  misc_feature: GYAE6OF01C8GR1.24.35.D02.1.454.CMB.1.raw
  modified_base (806)..(806): a, c, t, g, unknown or other
  misc_feature (806)..(806): n is a, c, g, or t
tcagactactatgtcacgaccggtgctcgatttagcacacgatagttgggtttggggaggaactgctcagttagacccagaggaaccatggaagccccagctcagcttctcttcctcctgctactctggctcccagacgaccaccggaagaaacttgtgttgacacagtctccaggcacctgtctttgtctccgaggggacagacgtcccacccttctcctcggcgaacgggccaggcccgggtagtacgtttaacgtaaaacgttcctttaagggccttagggtaaacccaacgtaacggtaaaacccgttgggacccaacgggtccctaccccggaacgggtcccttacctaccaattaccgttaatcggtaacttcgggttacccctaacccgtaaacgtacggggttccctaaccggttccggggtaccccgtttacccccggacccgttaaggggtttttaccccgaagggtttccggggaaccgtaacgggtttccgggggttaacctaccggggggtaaaccctaaccggttaacccttttaccccgaactttaccccgtacccggtaacccgtttaccgacgttacccgacgtacccttaaaggaccgtacccgtaggtaacgttacggtttttcgaacccgggttttaacacgttcgtacgtaagccgtacggtcccgtacccgtccgtcggtacccgtacgttaaccggtttcggggacgggggtaacctaggggtacggaagtacggacgacccggtaagttgaccggtacgtacgaccctaacgtcgttccgtnttaacgttcccaaacgtttccccgttaacccgtaccttacgtaccgtaacgtaacttaggttaaaccgg

SEQ ID NO: 23484 - DNA, 1026 bp, Homo sapiens
  misc_feature: GYAE6OF01EMFNY.24.35.D02.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctcgagggganagcgcctaccctntccgtgcgacgggccaggccggagttgttaagtaagttaccgttaggcttacgggtaacccaaacgaagaaacccgtggacccaacgggtcctaccccgaggcccttacccccgattcctaagtacggtaattccggttacctaacccgaaacggtacggggtttacccaaccggttaccggggtcccccggttacccccggaccggttaacgggtttcccgaagggttaccgggaccgttaacgggggttccggggttaccggtacggggggtaaacctacggttaaccctttacccgtaacccgttaccgtaccccggtaacccggttacgaaccgggtaccgaacgggtaccccgttaaaggggaccggtacccgtttaaggggttaaaacggtttacggtttttttacccggggtaacggtttttaaccccgttacgttacccggttaaccggaacggtaccggttaacccgggttccccggtttaccccgggcccggtttaccgggtaccccggttaacccgggtttttaaacccgggggtttccccgggggggaacgggggggttaaccccggttaaggggggggtaaccggtaagggggtaaccggggtaacgggttaacccggttaaccggttggggttacccgggttcggtaacccggaccccttaaaccggtaccggttttacggtccggtttttacccttacccggttaaccccttttcccccgggttaccccggtaacccttacggtttaaccccgtttaaagggaaaccgtttaaccgggtttaaacgggttaacccggg

SEQ ID NO: 23485 - DNA, 702 bp, Homo sapiens
  misc_feature: GYAE6OF01C6GKR.24.35.D02.1.454.CMB.1.raw
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
  modified_base (657)..(657): a, c, t, g, unknown or other
  misc_feature (657)..(657): n is a, c, g, or t
tcagactactatgtcacgaccggtgctcgatttagcacacgatagttgggtttgggggaggaactgctcagttaggacccagagggaaccatggaagccccagctcagcttctcttcctcctgccttactctggcctcccagacgaacccgaccggagtaaattgtgttgacacagtctccgaggccacccttgttctttgtctccgagggganagacgcccacctctccgngcacgggccaggccggtagttagttaagtaagtacgttaggctacggtaaaccaagacggaaaccgtggacccgaggtccctacccgacggtccttacccgtccttactatcgtccttcgtcctaccccgaacccgtacggggtcccccttggtccgtacccgaggtccgttacgggtttcgggttcgggcgggttcgggtcgtacgggactagttactttccgactcctccgaactcgtcgacggtcccgccttcgacggttcttaggaacgttttctttacgtactttacgttttatttccgtacgtactaactacttagttggtactacgtccgtccttcgttacgttcgtttacgggccgtaacgggaaacctaacggtaggaacgtatacgaaacgttacgtgtacggtctacgcctacncgttcttcgttctctccttcctctacctatccgaatatgttacgg

SEQ ID NO: 23486 - DNA, 792 bp, Homo sapiens
  misc_feature: GYAE6OF01EI9D3.24.35.D02.1.454.CMB.1.raw
  modified_base (150)..(150): a, c, t, g, unknown or other
  misc_feature (150)..(150): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccacgganaaattgtgttgacacagtctcaggcacctgtctttgctccgaggggagagacgcccaccctctcctgcgacgggccaggccggtagttgttaagtaacgttacgttaggctacggtaaccaaacgaacgtaaacccgtgggacccaagggtccctaccccgaggtcccttaccctacgtacttaccttagtcgtattcgtacctaccgaaacgtacggggtccacgttccgggacccgtccccgacgtacgggttacaggtcggaccgtagggttcgggtacgacgggtaaccacggttaaccttccacgtttccctaccgtacccgtacgaccgccgtaacggtaccgtaacggacgtacccttaagggtaaacgtttacggtttttacgggtaacccgtttttaacgtacgttacggtcgtaaccggtactccggggttaccccgttccggtcccggtttaaccgggacccgttacggtttaaacccggggttccggggggaacggggggtaccgtaagggggggtagtaccggggaaggtaacgggtacgtacggtaggtcgggcctacggaccctaacgtgttccgtgttaccctcgtacttcccgtcccgtactactactacgtaactggttaacgg

SEQ ID NO: 23487 - DNA, 710 bp, Homo sapiens
  misc_feature: GYAE6OF01B98GQ.24.35.D02.1.454.CMB.1.raw
  modified_base (199)..(199): a, c, t, g, unknown or other
  misc_feature (199)..(199): n is a, c, g, or t
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcacctgtctttgctccagggganagagccacctctcctgcagggccaggccggagtgttagtaagtacttaggctagggaaccaanagaaacctggccaaggctcccaggcctcctnatcatgatgctccaagnggtcacgtggcctcccgctaggttcaggtcggacaggtcgggtctacgggacaggtacttcgaacttctaccgaccgttnacggcaaggtccctaaggacgtacctaggtaacgttagttttacggtacggttttaacgtacgttaggtacgtaacgtccgacgtccggtttacccgccgtacgggtcccgtaaccgtttaaccgggtttccgggggaccgggggggtaaccgtagggggttacgggaagggtaacggggtaaccggtaacggtaacggttcggtacgggtacgtcggaccgtaacccgtaagttcccgttagttacccgtttacgtaacccgtttacccgttcccccgtaacgtaaccgttaccgtaacggtaaactacggttaaacgg

SEQ ID NO: 23488 - DNA, 723 bp, Homo sapiens
  misc_feature: GYAE6OF01CQ6YI.24.35.D02.1.454.CMB.1.raw
  modified_base (705)..(705): a, c, t, g, unknown or other
  misc_feature (705)..(705): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccggagaaattgtgttgacacagtctccaggccacccttgttctttgtcctccgaggggagagacgcccaccctctccgtgccgagggccaggccggtagttagttagtaagtacgttaggctaggtaaccaacgtaacgaaacctggaccaggtccctaccgaggtcctacctacattctatgatcgtccgtaccaagcgggtacacgtcggcccgttccccgcgtaggttcgacggttggacgtagggtcgggtctacggggtaactacggttacccttccgaacctttccgtaacccgtaccgttaccacggtacctaccggtacccgttaaggaaccggtccgttaaggtaaacgttttacgtttttacggacggttttactacggtcgtacgaacgtcgacgttccgtccgtccgtcggtaccgtacgttaaccgggttcggggaccggggtaacgtaggggtaggacgggagggtacgaacgtacggtggtacgcgtcgaccgtaccgtacgtcgttacttccgttactccgttcccttacccgattaccgtntaaacgtagtagttacgg

SEQ ID NO: 23489 - DNA, 870 bp, Homo sapiens
  misc_feature: GYAE6OF01DW94J.24.35.D02.1.454.CMB.1.raw
  modified_base (267)..(267): a, c, t, g, unknown or other
  misc_feature (267)..(267): n is a, c, g, or t
  modified_base (463)..(463): a, c, t, g, unknown or other
  misc_feature (463)..(463): n is a, c, g, or t
tcagactactatgtcacgaccggtgctcgatttagcacacgataggttggggtttgggggaggaactgctcagttacggacccagagggaaccatggaacgccccagctcagtcttctcttcctcctgctctcgtggcctccgagacgacccgacggaagtaattgtgttacgaccacgacgtcctaccgacggccctacccgttgttccgtttcggtccgtaccgggaaggggacgacggtacccgtcccctacccttccgtccgnggccggaccggggccacgggtccggtagttaggttaacggttaacgttacggttcggacgttacggaaaccaaacgaaccggtaccgcggtaccgaccggtccgtaccgtacggtccctaccgtactacttcgtacgtacgtacgttccgtaccgtacgtacggacggtcctaccggtcccggtcccgtacccggngttaccggtcgtacgggtcggtacggtcgggttacgggtacggtacggtacggtaccgttacctccgtaactcccgaccgtacgcgtacaccggtactaacggtcgaccggtacgttaagttaacgtttccggttacgtttacggttaactcggtacgtacggacgtcggttaccggtcccgtccggtccggtaacggttccccgttaacggggttaccgggggtacccgggggagggggtcgtaaggggtacgggacggttaaacgggaccgtaacggtggtacgggtacgtacggtacccgtacgttaccgtttcccggttactttccggttacccgtcgttttacccccgccgttaccccggatttaacccgggttacgaaccgtttaaggtaccgggtttacg

SEQ ID NO: 23490 - DNA, 824 bp, Homo sapiens
  misc_feature: GYAE6OF01BJ1PR.24.35.D02.1.454.CMB.1.raw
  modified_base (207)..(207): a, c, t, g, unknown or other
  misc_feature (207)..(207): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagacgaccaccggaagtaaattgtgttgacacagtctccaggccaccctgtctttgtcctccgagggganacgacgcccacccgtctccgtacgccgagggccacggccggattaggttaagtaacgttacgttaggactacgggtaaaccaacgaaacgtaaccgtggacccaaggccctcccgaaggtccctaccgttactacttaccgttagtagtaccgttcgtacctaaccggtaaaccgtacggggtacctaaccggtccgggtaccccggttaccccccggacgttaacgggtttccgacggggtacgggtaccgttacggggttcggggttcgtacggggtaacctaaccggtacctttaccgactttacccgtaaccgtcccgttaacgaccggtactaccggacccgttaacggaccgttaccgttaacgggttaacggtttacgttttaccgggttaccggttttaacgtacgtttacgtacgtacgtaactccgggttaccgttcccggtacgtccgtcgtaccgttacggtaccggggcgggtaacggtacgggtacggagtaacgggacgtacggtaacggttcgacggtccgtagacccggtacttacgtccgttacgtacttcgtaccttccccgttaccacttaccgagttaacgtacgtaaggttaacg

SEQ ID NO: 23491 - DNA, 853 bp, Homo sapiens
  misc_feature: GYAE6OF01D3205.24.35.D02.1.454.CMB.1.raw
tcagactactatgtcacgaccggtgctcgattttagcacacgatagttggggtttggggaggaactgctcagttaggacccagaggaccatggaagccccagctcagcttctcttcctcctgctactctggctcccagacgaccaccggagaaattgtgttgacacgagtctccaggcaccctgtctttgcctccgaggggacgagacgcccaacccgttctccgtggacgaaggggcccaaggcccggtaagttcgttaagtaagttaccgttaagggccttagggttaaacccaaacgtaacggaaacccttagggacccgaaggtccgttccccgaagggtaccttaccgtactaacttccgttaactcgacttcggttaccttaccgaaacgtacgggtaccaccgtcgggtacccttccccggacctaagggtttccaaggttcggaccgtaggttcggggtaccgttaggggaacctaacgggtaccttaccgaccgttccctaccgaccggttacgaggtacctagacccgtttaggaacgtccgttaacggaacgttacgttttacggtacggttttaactaacgttcggtaccgtacgtacgtaacgttccggtttacccgtccgttacgggtccctaacgtttaaccggttcggggacgggggtaacccgtaggggtacgggtaacgggtaacgggtaacggtaacggaaccggttggttaacgggtcgttacggaccgtaacccgttaacgtccggttacgttacgtttccgtaacgttccccgttacccccggtaaccttaaccgttccgttaaaccggtaaccgttaaggttaaacccgg

SEQ ID NO: 23492 - DNA, 690 bp, Homo sapiens
  misc_feature: GYAE6OF01DRY9I.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccgaggcacctgttctttgtctccgagggganagacgccaccctctcctcgcgagggccacggccggtagtgttagtaagtacttaggctacggtaaccaacgacgaaaccgtggaccgacggcctacccgaggtccttcctctactctagtcgattcgtacctaccgaacggtacgggtcacggttcgggcccgtccccgacgtaggttcaggtcggcgtagggtcggtacgtcgggaactacggtaaccttcacctcgtaccgaccggtacacgtcgacgtaccgtaggacgtcgttaagtaagtttcgttttacgtacggtttactacgtcgtacgtagcgtacgtccgttcccgcgtcggtccgtacgttacgggttccggggacggggacgtgggtacggagtagggacgacgtacgtggtacgtcgtcgacccgtagtacgttccgttagttcttccgtaccgtttccctaccccggtacttacttaccgtaaacgtaccttaggttaaccgg

SEQ ID NO: 23493 - DNA, 925 bp, Homo sapiens
  misc_feature: GYAE6OF01BPQZD.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaattgtgttgacacagtctcagccacctgtcttgctccgaggggagacgacgcccaccgtctaccgtgcgacgggccaaggccgggagttacggttaacggtaagttaccgtttaagggccgttagggtaaacccaaccgtaacggaaaacccgttcgggacccgtaacgggacccttccccgaagggtcccttaccctacgtaacttaccttaacgtgtaacgttcgttaccctacccgaaacggtacggggtacctaacggtccgggtccccgtacccccggtaccttaaggggtttaccccaagggtttccgggaccttaacgggggtttcggggtaaccggtacggggaaacctacgggtaaccctttaccgaccggtttacccgtaccgtaacccggtcgtaacggtaccggacgtaaccgttaagggaccggttacccgtaagggttaacgttttacggttttacgggttaaccggttttaacccttaggttacgtaccgaacggttaccgttacccgggttacccggttcccgtcccgttaccgggtacccggttacgtttaacccgggggttcggggggacccggggggtaaacctgggggtaaccggtaacgggtaagggaaccgggttaaccgtaaggggttccgtacgggccgtaaccgtacccgaaacttaccggttccgttaacggttccctttaagaccgttttcccccgttacccgaacgttacctaaccgggttaaccggtaaattccgggtaaacgg

SEQ ID NO: 23494 - DNA, 721 bp, Homo sapiens
  misc_feature: GYAE6OF01BGWML.24.35.D02.1.454.CMB.1.raw
  modified_base (166)..(166): a, c, t, g, unknown or other
  misc_feature (166)..(166): n is a, c, g, or t
  modified_base (225)..(225): a, c, t, g, unknown or other
  misc_feature (225)..(225): n is a, c, g, or t
  modified_base (668)..(668): a, c, t, g, unknown or other
  misc_feature (668)..(668): n is a, c, g, or t
tcagactactatgtcacgaccggtgctcgatttagcacacgatagttggggtttgggggaggaactgctcagttaggaccagagggaaccatggaacgccccagctcagcttctcttacctcctgctactctggctccgagagaccacggataattgttgttgacncagttctcgacggcctaccgtgttcttcgctacgagggagacgacgcctaccgtctcgngcgacggcacggcggtagttgttaagtaacgtcgtagcgtacggtaccaacgtacgaacgtcgacgacgtcctaccgacgtctcctactatctagtagacttcgtaccgtaccgaacggttaccggcctaccgtaccgggccggtaccccggcggtacggttacggtagggtccgtacggtacggttcgggtacgtacgggaactagtacccgtactcgttacccgtacgtacctagtacgacgtcgtaaccgtacgtacggtacgtagtaacgtttcgtttcgtaccggtttatacgttcgtatacgacgtcgtaccgtccgttacggccgtaccgtaggtttaaccggcggggtacgggtaacggtagggtaggaacggacgtaacggtacgtaggtacgcggaccgtactaccgaccgttgtaccggtatttacccggtnttacccgttcccggaaccctcggtaacctaagacccgtaggttacgtaaccgg

SEQ ID NO: 23495 - DNA, 639 bp, Homo sapiens
  misc_feature: GYAE6OF01ARKPJ.24.35.D02.1.454.CMB.1.raw
  modified_base (371)..(371): a, c, t, g, unknown or other
  misc_feature (371)..(371): n is a, c, g, or t
  modified_base (583)..(583): a, c, t, g, unknown or other
  misc_feature (583)..(583): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagccatcaccggaggaattgtgttgacgcagtctccaggcacccgtgtcctttgtcctccaggggtaaacgagccacccctctcctgcagggccagtgagaatgtggcagcacttagcctggtaccagcagaacctgccaggctccaggctcctcctctatgctgcctccaccgacggcccctgggtctcccgaggccgtagggttcgttcggcgggttcgggtcgtgggacngtactttcacgttctacacctatccgagtccgcctccgagtctaggaagtcttttgcttactttactttcttccgtacaactactagttcggtcgtacgtcggtcctaccgtaacttccgttttcggacccggaaggggtaacccaaacggttgggaacgtacgtaacgaaaaccgtacgtacggttcggaccgttacgtacccacccgttnttacccgttcggtttaccttacccacgtttcccttacccccgtctaacgttaccgg

SEQ ID NO: 23496 - DNA, 702 bp, Homo sapiens
  misc_feature: GYAE6OF01DFDCX.24.35.D02.1.454.CMB.1.raw
  modified_base (155)..(155): a, c, t, g, unknown or other
  misc_feature (155)..(155): n is a, c, g, or t
  modified_base (275)..(275): a, c, t, g, unknown or other
  misc_feature (275)..(275): n is a, c, g, or t
  modified_base (495)..(495): a, c, t, g, unknown or other
  misc_feature (495)..(495): n is a, c, g, or t
  modified_base (518)..(518): a, c, t, g, unknown or other
  misc_feature (518)..(518): n is a, c, g, or t
  modified_base (598)..(598): a, c, t, g, unknown or other
  misc_feature (598)..(598): n is a, c, g, or t
tcagactactatgtcacgaccggtgctcgatttagcacacgatagttgggtttgggggaactgctcagttaggacccagacggaaccatggaacgccccagcgcagtcttcctcttcctcctgctactctggcctccagactaccacgtaggaanaaatggtagatgaccgcacgtctccacgccctaccttgtctgtcgtaccacggaaggggaactaccgccctaccctcgtccgcgaccggacgggaccgtacgtacgaagtaacgttaaanaaggtaacaccgtaaactacgttcgaccgtaggaactaaccaaacgaacggtaaccgcggaaccgaccggtcctccgacgtcctccgtacgtactttcgtagtacgttacaccgtaccgagaccggtacgacctacggtcgtaccgtccgagtccgtagtacgacggtcgtacggtggtcgggtacgtaggactacgtacgtacctacgtaccactaacncctacgacgtacgtcgttaccgngtaccgtagtacgttagtactttagtcgttaactttagttactacgcgacctaggactacgacgaacgttcgaccgtacnccgggtcctaccggttacggaccgggtaccgaggtaacggacggtagtaccggataaccggacgtaacggtgacggtaccgtacgaaccgcctacgtacgtccg

SEQ ID NO: 23497 - DNA, 852 bp, Homo sapiens
  misc_feature: GYAE6OF01A2Q3R.24.35.D02.1.454.CMB.1.raw
  modified_base (170)..(170): a, c, t, g, unknown or other
  misc_feature (170)..(170): n is a, c, g, or t
  modified_base (761)..(761): a, c, t, g, unknown or other
  misc_feature (761)..(761): n is a, c, g, or t
  modified_base (770)..(770): a, c, t, g, unknown or other
  misc_feature (770)..(770): n is a, c, g, or t
  modified_base (829)..(829): a, c, t, g, unknown or other
  misc_feature (829)..(829): n is a, c, g, or t
tcagactactatgtcacgaccggtgctcgatttagcacacgatagttgggtttgggggaggaactgctcagttaggacccagacgggaaccatggaacgccccagctcagcttctcttcctccctgctactctggcctcccagacgaccacggagaaattgtgttcgacncgagttccaccacggccacccgttgttctttcgtaccgtccggaaggggacgacgccgccctacccctcctccgtcgccggtacggccgacgggtccggtagttacggttaaacggttaagttaccgttacggcgttaccggtaaaccaacggtaacgaaaccgtcggaccgacgggtccaaccccggtggtcctaccctagacttcgtacgttagtcgtaccgtcctaaccggaaacgttacgggtccctaacgggtcccggtacccccggtacccggtacccgttaggtaccgtacgggtaccggtacgtaaccgggggtttcggtccggtaaacgggtaccctaccggttaaccttccggtaaaccttcccgggttaccgacccggtacgtacgaacccggttctacccgtacgacgtaccggttaagtacgtttacggtttaccgttaaccggtttcctaacggttagtacccggacgttaaccggtccgtacccggttccgaacgtttcccggtaccgttaacggtccgggttccggggaacgggtcggtagggtaccggaaagtcccgggtaagacccggttagngggttaccnccggttacgcgaaccttccgttacgtccctacggttactcccgtacctcccgtaacgtnttacccgaattaacccgaggttg

SEQ ID NO: 23498 - DNA, 730 bp, Homo sapiens
  misc_feature: GYAE6OF01B31YM.24.35.D02.1.454.CMB.1.raw
  modified_base (132)..(132): a, c, t, g, unknown or other
  misc_feature (132)..(132): n is a, c, g, or t
  modified_base (167)..(167): a, c, t, g, unknown or other
  misc_feature (167)..(167): n is a, c, g, or t
  modified_base (173)..(173): a, c, t, g, unknown or other
  misc_feature (173)..(173): n is a, c, g, or t
  modified_base (216)..(216): a, c, t, g, unknown or other
  misc_feature (216)..(216): n is a, c, g, or t
  modified_base (460)..(460): a, c, t, g, unknown or other
  misc_feature (460)..(460): n is a, c, g, or t
  modified_base (503)..(503): a, c, t, g, unknown or other
  misc_feature (503)..(503): n is a, c, g, or t
  modified_base (544)..(544): a, c, t, g, unknown or other
  misc_feature (544)..(544): n is a, c, g, or t
  modified_base (560)..(560): a, c, t, g, unknown or other
  misc_feature (560)..(560): n is a, c, g, or t
tcagactactatgtcacgaccggtgctcgatttagcacacgatagttgggtttgggggaggaactgctcagttaggacccagagggaaccatggaacgccccagctcagccttctcttcctcctgctactcnggctccagacgaccaccggaagtaaattgtgttanacaacngtctccgaggcctaccttgtctttcggacctccggaagggganacgacgtcccaccctacgccgtgcgacgggccagggccggaagttaggttaagtaaacgtacgttaacggcgttaacggaaacctaacggaaacgaaaccgtcggaccgaacggtcctacccgaagtccttaccatactacgtataggacgtttcgacctaaccgaacggtggttaccgaccgtcggaccccgtacccgtaagtcgttacggaggttccgagtcgggtacggtcgacggtaacnttaccgtcacgtaccgtccaacgtacgacacgtacggtaacgngaaccgttcgagttaacgttcggttttaacgacggtttacncgttcgtaagacgtcncggtaccttcggaccgtcgtaccgtacggttaacgggtcgggacgggaacggtgggacgaaagggtagggacgtaacgacgtacggcgtcgaactctaaccgttgacttccggtacttaccggcctttaccgtcccgtattacggacctaaaggtaccgtattaaccggg

SEQ ID NO: 23499 - DNA, 681 bp, Homo sapiens
  misc_feature: GYAE6OF01B5K08.24.35.D02.1.454.CMB.1.raw
  modified_base (275)..(275): a, c, t, g, unknown or other
  misc_feature (275)..(275): n is a, c, g, or t
  modified_base (403)..(403): a, c, t, g, unknown or other
  misc_feature (403)..(403): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtctttgtctccgaggggagagacgcccaccctctccgtgcacgggccaggccggtagttgttaagtaagtacttaggctagggtaaccaanaacgaaacctggaccacggcctcccgaggcctcctcatctatgatcgtctaccgaacgcggtcacgtcggccgtccccgctaggttcaggtcggcgaggtcgggtcgtggacaggtacttcacttccncaccgtcagcacgccgtagacgcctagtaacgttagttttacggtacggttttaactacgtcgtacgacgtaccgacggtccgttcccggtccgtcggtacccggttaccgtttaaccgggttccggggaccggggggtacgtagggggtacgggagggtacgggaacggtacggtaacgtgggtacggtcgtacgccaacgtacgttccgttcgttacttccgtaccttccccgttaccccgtactacgttaccgtacgtaaaccgtaggttaacgg

SEQ ID NO: 23500 - DNA, 757 bp, Homo sapiens
  misc_feature: GYAE6OF01EPXOK.24.35.D02.1.454.CMB.1.raw
  modified_base (151)..(151): a, c, t, g, unknown or other
  misc_feature (151)..(151): n is a, c, g, or t
  modified_base (170)..(170): a, c, t, g, unknown or other
  misc_feature (170)..(170): n is a, c, g, or t
  modified_base (204)..(204): a, c, t, g, unknown or other
  misc_feature (204)..(204): n is a, c, g, or t
tcagactactatgtcacgaccggtgctcgatttagcacacgatagttgggtttgggggaggaactgctcagttaggacccagacggaaccatggaagccccagcgcagcttctcttcctcctgctactctggctcccagataccactgganaaatgtgatgacgcagtcnccagcccacctgtctgtgtctccgaaggggaaancgcccaccctctcctgaccgagggccaagtccaagtaagtaataaagaacgtccaacttacgttacgccgttaggtactacgaaacgaacgaaaccctggacccaggcctaccccgacggtcctccctcgtaatcgttagtaggtactacgtccgaggccgacgggtcccacgtcggtcgtacccgaggtccgtaggttcgaggtcggacgtaggtcgggtcgtagggactaggtacgtcctacgtcctaccaccgtactacgacgtctacgtccgtacgtacgtagtacgtaagtaacgtttagttttcgtacgtttactttttacgttccgtacgttaaccttaacgtacgtttacggttcgggttacgtaccggttaccgttaccccgttaccgttacgttacccggtttaccggaacccggttaaaccggggtaaacccgtaaaggttcggggtaaacccttaaggtaaacccgttaaaacgggtaaccggttacgggtaccggttaccgtaccgtaacccgtacccgttaacgttcccgtttaaccgg

SEQ ID NO: 23501 - DNA, 804 bp, Homo sapiens
  misc_feature: GYAE6OF01EBZWV.24.35.D02.1.454.CMB.1.raw
  modified_base (220)..(220): a, c, t, g, unknown or other
  misc_feature (220)..(220): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagacgaccaccggagaaattgtgttgacacagtctccaggcaccctgtctttgtctccgaggggagagcgcccaccctctccngcgaggccaggccggagttgttaagtaagtacgttaggctcggtaaccaacgacgaaacccgttggaccaacggccctacccgaggtcccttcctacaacttccgtatcgtaacgttcgtacctacccgaaacggtacggggttaccaaccggttccgggaccccggttccccccggaccgttaagggttccgaagggttcgggaccggttcgggttcgggtcgtaacgggacctacgtacccttccgaactttcccgtaccgacccgttcaacggccgtaacgtacccgtaggaccgttccgtaaggtaaacgtttcgtttttacgggacccgtttttaaactacgttcggacgtacggtccgtaaccgggttccgttccccgaccggttccggtacccggttacccgtttaacggggttcccgggggaccggggtaacgtacggggggtagaacggggtaaggtaccgtaaccgggtacgttcgggtcggtacctacggtacccgtacgttacgttcgttaccgttccttaccgtaccgttcccctaccggtactacttacccggattaaccgtggtaaccg

SEQ ID NO: 23502 - DNA, 819 bp, Homo sapiens
  misc_feature: GYAE6OF01D7I9P.24.35.D02.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
tcagactactatgtcacgaccggtgctcgatttagcacacgatagttgggttggggaggaactgctcagttaggacccagagggaaccatggaagccccagcctcagcttctcttcctcctgctactctggcctccgagacgaccacggaagaattgtagttgacacagtctccaggcacctgtcttgtctcgagggganagacnccaccctntccagcagggccaggtccgagtgttagtaagtacgttaggccttaggtaccaaacgagaaaaccctggaccaaggcctacccgaggtcctccctacgactctatgacttcgtctccaacgtagggtccacgttcggaccgtccccgactagtacttcaggtcggcaggttcggtactaggaacgaactaggtactttaccgaactccgtacccgtacccgtcaaacggtcctaacggacccttaagaccgtacccgtaaggtaaacgttacgttttacggtaacccggtttttaaactaacgttcggttaacccgaaggtaccgttaacgttcccggtttacccggtccgttacgggtaccccggttaaccgtttaacccggggttttaccgggggaacccgggggggtaacccgttaggggggttaaccgggtaacgggtaaacgggggttaaccggaaaccggttaaaccggttacgggttaaccgggtacgttaaccgggaccgtaaaccccgtaagttaacccgttacgggttaccctttaacggtaccctttaccccggttaccccgaacccgttaatttcccggaaaggttaaaacccgg

SEQ ID NO: 23503 - DNA, 987 bp, Homo sapiens
  misc_feature: GYAE6OF01B0YKR.24.35.D02.1.454.CMB.1.raw
tcagactactatgtcacgaccggtgctcgatttagcacacgatagttgggtttgggggaggaactgctcagttaggacccagagggaaccatggaaaccccagcgcagcttctcttcctcctgctactctggctcccagcctatcgaccggaggaattgtgttgacgcacgtctccgaggccaccgttgttcgtttgtcctccggaggggtagacggacgccctaccctcgttccgtcggacgaccggggcctaacggttacgaaggtaggttcgttaacgaccgaggacgaacgtaccgttaaccgtttacggaccccggttacggtaaacccgacggtaacccgtaaaaccgggttaaaacccgttacggggaaccccgtaacgggtccccgttaaccccggaacgggttccccttaccccgttcccgttacttaccggtcggttccgttccgtacccgtacccgtacccgggtacccgggtcccgttcgggttccgtaccccgtacggtccggttacgggttttcgggtcgggggttccgggttcggggtaccggtaggggtaaccgttaacgtttacgtttacccgacctttccgacccgtaccggtacgtaccggaccggttcccgtacccgttaccgtaccggttacgttaacggttacgtttaacgttttcggttaactttacgtttttaccgtttacgttacgttaacccgtaacgttaaccgtttaggttaccggttaccggttaccggttaccgggttacccctttaccggtttacccgtttacgggtttaacccggggtacccggggttaaaccgggttaacccggtaacggttaacgggaaccgttaaaccggtaaacccggtaaaacggttaccggttacgggtacccggtacggtacccgttaccgtaaccgtaccgtttacgttacccgttacgtttacccgtaacccgtttccccgtaccccgttaacccg

SEQ ID NO: 23504 - DNA, 769 bp, Homo sapiens
  misc_feature: GYAE6OF01AWJRS.24.35.D02.1.454.CMB.1.raw
  modified_base (620)..(620): a, c, t, g, unknown or other
  misc_feature (620)..(620): n is a, c, g, or t
tcagactactatgtcacgaccggtgctcgatttagcacacgatagttgggtttgggggaggaactgctcagttaggacccaggaggaaccataggaaaccccagcgcagcttcctcttcctcctgctactctggctcccagccatcaccggaggaattggtgttgacgcagtcctccgacggccacccgtgtctttgtcctccgaggggtagagacgcccaccctcgtcctgcgacgggccagtcaagagtgtacgcgagctagactacttacgccttaggtaaccacgacgtaacgaaacccgtcgggacccgtccgggtacctccccggaacggtcccctaccccggttactaaccgttaccgttaacgttacgggtccgtaccccggttacccgaacccgaccggggtccccaaggtccgggaccggttccggaccgggtaacgtaccgggtttccaacggtcggtcgtacgggttaggtaccggtttaggaaccgttacgtaccctttcgaaaccttcgtaactacgtaccgtagtaccgaccgtacggacgttacggaccgttaacccggtaagttacgtttagacggttagtacgtttacgttacgtcggtacncgtttacgtttcgtttacccggttacctccgttaccttcttagttacgttaccttacgtttaccggccgtcggttaccggcgtcggtagtacgtaacgtacgtaacgtaccgtaagttcgtacggtacgtaccgtctaacgtcgttccg

SEQ ID NO: 23505 - DNA, 799 bp, Homo sapiens
  misc_feature: GYAE6OF01BWUVD.24.35.D02.1.454.CMB.1.raw
  modified_base (159)..(159): a, c, t, g, unknown or other
  misc_feature (159)..(159): n is a, c, g, or t
  modified_base (172)..(172): a, c, t, g, unknown or other
  misc_feature (172)..(172): n is a, c, g, or t
  modified_base (219)..(219): a, c, t, g, unknown or other
  misc_feature (219)..(219): n is a, c, g, or t
  modified_base (331)..(331): a, c, t, g, unknown or other
  misc_feature (331)..(331): n is a, c, g, or t
tcagactactatgtcacgaccggtgctcgatttagcacacgatagttgggtttgggggaggaactgctcagttaggacccaggagggaaccagtaggaacgccccagctcgagtcttctcttctctgctactcgtgctccagagaccacggagaattgngtgacactagtcncgagcctaccgtgtctttgctcggaggagagagcccacctctcccgngaccgaggaccacgcggtagttagttaacgtaacgtacggtacgtacgtaggtaaacccaagtaacgtaaaaccgtcggaccgtacggaccttaccgacggtaccttcctanacttacgttactagtacgtacgttaccaaccgtaacgtacggtaccgtaccgttccggtaccccgtacccggacgtagggttacgacgggttcggaactcgggttacggtccgagggacctaggtaccttcgaaccgttccacggttaacccgagaccgaaacgggtactacgttaggaaccttagtacggttaagttaccgtttggttaaccggtttacgttacgtcgtaacgtacggtacgtaccgttaaccgttcccgtaccggttaccgggtacccgtaaccggttacccggggtttaccggggaacggggggtaaccgtaccggggttaacgggacgggaacggaaccggtaggtaaccggaggttccgggacgtacgacgtacccgtacgtcgttacgttaccgttccgtacctttccccgggtaacctactaacgttaccgtaacgtagtaacgttaacgg

SEQ ID NO: 23506 - DNA, 767 bp, Homo sapiens
  misc_feature: GYAE6OF01BYC9A.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccacggagaattgtgttgacacagtctccaggccaccctgttctttcgtcctccgaggggagagacgccaccctctccgtgccgaggccaggccggtagtgttagtaacgtacgttaggctacggtaaccaacgaacgaaaccgtggaccgtacggtcctacccgaggtcctaccgtactactctaagtcgtagtcgtacctaccgaacggtacgggtaccacgtccggtacccgtccccgtacgtacgggttacacgggtcggacgtacggggttcgggtcggttacgggaactacggtacttaccgtaccgtccgtaccgtaaccgtcgaacggtcctaacggtacctaggtaccgtaccgtaagttaacgtttacgttttcggtaacgtttaccgtacgtcgtacgtacgtaccggtacggttcccgttccggtccggtacccggttacccgttaaccggtttaaccggggttccgggggaccgggggtaaccgtagggggtacggaagggtacggtacggaaccggtaggttggccggtcgtaccgacgtacttcggttcttacgttcctacgtacccgttcccgtacccgcttacgtacgtaccgtaaagtcgtttacgg

SEQ ID NO: 23507 - DNA, 708 bp, Homo sapiens
  misc_feature: GYAE6OF01AEWJ5.24.35.D02.1.454.CMB.1.raw
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccaccctctcctgccacgggccagccggagtgttaagtaagtacgttaggctggtaaccaacacgaaaccgtggcccaggcctcccgaggcctcctnactctatgatcgtcctaccaacgngggtccacgtcggcccgtccccgcgtaggttcaggtcggcgtaggtcgggtccgtagggactagtaccttccacgtctccgaccgtcacgtccacgccgtagaccgaccgttaggtaacgttcgtttttcgggtaccggttttacctacggttcgtaaccgagtccgtacggttcccgtttacccggccgttcggtaccccgttacgtttacgggttccgggggggacggggtaccgtaggggggtacgggaaggtagggaacggtaccgggtacgtcgggtgggtccacggtacccaccgtagttccgtcgttacccttcgtacccgttccccgttccccggaacttacgttaccgtaacgtaaccttggttaaccgg

SEQ ID NO: 23508 - DNA, 627 bp, Homo sapiens
  misc_feature: GYAE6OF01EH4VE.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagccaccctctcctgcagggccagccggagtgttagtaagtacttaggctggtaaccaacagaacctggccaggctcccgagctcctcatctatgattcgtctccaacgtgggtccacgtcggccgtccccgctaggtcagtggcaggtcggtcgtggacagtacttcgactctcgaccgtcagcagcctagacgtccgtagtaagtacgttttgtacggttttactactgtcagcacggtccgtttccgccgtcggtacccgtacgttaaccggtttcggggaccgggggtaaccgtagggggtcgggaagggtaacgggaggtaacgtaacggtaggttcgggcgtacggtaccgaccttacgtcgtttgttccttcgtaccttcccgttcccgaccttactcgtacaaacgtgttaacgg

SEQ ID NO: 23509 - DNA, 863 bp, Homo sapiens
  misc_feature: GYAE6OF01CD5YO.24.35.D02.1.454.CMB.1.raw
  modified_base (198)..(198): a, c, t, g, unknown or other
  misc_feature (198)..(198): n is a, c, g, or t
tcagactactatgtcacgaccggtgctcgatttagcacacgatagttgggtttgggggaggaactgctcagttaggacccagagggaaccatggaagccccagctcagcttctcttctcctgctactctgctccagagaccaccggagaattgtgttgacacagtctccgaggcaccctgttctttgtctcgaggganagacgccacctctctgcgaggccaggccggtagttgttaagtaagtacgttaggtcttacggaaccaagacgaaaccgtggaccaaggcctacgaacggccttacctacacgttactacgttagtacgttcgtacctaccgaacggtacggtccgtaaccgtcggacccgtcccggcgtacgttcgacggtcggcgtacgggtcggttacgacggtacgagttaaccgttcaccgttacgtacccgtaccgtcgaaacgtcctaacgccgtacggtacgtcctaaagggtaacgttttacgggtttttacgtaaccgggtttttactaccggtacttaacgacggttaaccggttacccgtccggggttttaaccccgtccggggtttaccccggtacccgggtttacccggttttaaacccgggggttttccggggggggaacccgggggggtaacccggtaaagggggggtttaccgggaaacgggggggtaaacggttaaccgggtaaaccccgggtttaaggggttccggttacgggtacccgggttaacccgtaccccgttaacgtttccgttacccggtttaccctttacggtttcccttaaccccgttttcccgtaccccttaccgacgttaccgtaaaccttagtttaaccggtaag

SEQ ID NO: 23510 - DNA, 880 bp, Homo sapiens
  misc_feature: GYAE6OF01CXII5.24.35.D02.1.454.CMB.1.raw
  modified_base (127)..(127): a, c, t, g, unknown or other
  misc_feature (127)..(127): n is a, c, g, or t
  modified_base (227)..(227): a, c, t, g, unknown or other
  misc_feature (227)..(227): n is a, c, g, or t
  modified_base (819)..(819): a, c, t, g, unknown or other
  misc_feature (819)..(819): n is a, c, g, or t
tcagactactatgtcacgaccggtgctcgatttagcacacgatagttgggttgggggaggaactgctcagttaggacccagagggaaccatggaagccccagctcagcttctcttcctcctgctacnctggctcccagagacccaccggaataaattgtgttgacacagtctaccagccctaccctgtctgtcgtactccgaaggggaaagcaccctaccctctccngacgaacgggcctaaggtgaagtaacgttggttcggacaaggacctaaaccgttaggccgttacgggaaccagaccgaaagtaaacccgtggacccgaagggcccttacccgaggtccccttaccgtcctaccgtatcggcttcgtccctacccgaccgtaccggggtcccttgggtaccctaccacggtacccgtagggttttcgggtcgggacgggttcggtcggttacgggactaggttacctttacacccttccacctaactacgtaccgaaggtaccccggtcccgaaacgttcggttacctaagggtaaacgtttacgttttacggtacccccttaaattttttttacgggtaacctttacggtaacccttaaacgtaccgtttaaacggtttcggggtaccttaacccgggtttaacggtccccccgtttaaccgggtttaacgtttttaaaccccgggggtttccgggaaaccccggttaacccggggggtaaaaccctaaagggtttcggaaacggtaacccctttaaccgaaaaacgggtacccgtttagggttcggaacgttaccggacccttaaacccgngttttacccgtgtttacccttacggaacccgtttcccctacccgggtaactcggttaaacc

SEQ ID NO: 23511 - DNA, 762 bp, Homo sapiens
  misc_feature: GYAE6OF01D56YZ.24.35.D02.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagacgacccaccggaagtaattgtgttgacacagtctccaggcctaccctgtctttgtctcgagggganagacgcccaccctctcctgcgagggccaggccggagtgtancagcagtctactgcctggacagcaagaacctgcctgcctccaggctcnctatctagtcggtcgaccgtaccaccgacgggtcctaacggtcgggccgttacggccggtaacgtagggttccagggtcggacgtacggttggtccgtttagggactagtaccgtttcaccgttactcgtaactcgtaacgttccgaacgtaacggtaccgtacggggtaaccggtaccccgggttaaagtttacgtttacggaacgttaacggtttacgtttaactttacggttcgttaccgtaacggtttcgtttacgggttttccgttaccccggtttcctttacccgttaccgtttaacgttacgtttaacccgtttaccggtttttaccgggacccggtttaacgggttcccgttagggtaccggttaacggtacggttaaaccgttacggtaaccgggtacggtaaaccgttgggttacccggtcttaccggaccttacccggttagttccgtttacccgg

SEQ ID NO: 23512 - DNA, 838 bp, Homo sapiens
  misc_feature: GYAE6OF01AF2DE.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccggagaaattgtgttgacacagtctccaggcaccctgtcttgtctccgaggggagagacgcccaccctctccgtgcgacggccaggccggagttcgttaagtaagttaccgttaggcttacggtaaccaaacgaacgtaaacccgtggacccgagggtcccttaccccgaagggtcccttacccgtactacgttaccgttagtacggtaacgtttcggtaccttaacccgaaacggtacggggttaccaaccggttccgggtccccgttcccccggaccgttacgggtttccgaagggttcggacgtagggtcgggtacgtacggggactacgtaccttcgaaccttcgtacccgaccgttacacggaccaacgtccgttaaacggcgtaaccgttacggtaagtttacgttttcggtaaccggttttactacgtcgtacacgtccgtacgggtcccgtttcccgaccggtcgggtcccgttaacggttacccgggtttcgggggacccgggggttaacggtacgggggtacgggtaacggtaacgggtaccggtaaccggttaacgggtgggtaccgggtaccgttacggccccttaacgtaccgtttccgttcgttttaccctccgttaaccccgtttcccgtaccccgttactaaccgttccgtaaacgaaacgttagttaaaccggg

SEQ ID NO: 23513 - DNA, 771 bp, Homo sapiens
  misc_feature: GYAE6OF01BD4JT.24.35.D02.1.454.CMB.1.raw
  modified_base (208)..(208): a, c, t, g, unknown or other
  misc_feature (208)..(208): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttcgacacagtcctccgaggccacccttgttctttgtctccgaggggagngacgccaccctctccgtgcgaggccaggccggtagttagttagtaacgttacgttagggcttcggtaaccaaacgacgaaacccgttcggacccgaacggccctacccgacggccttccctcacttctatcggtattcgtacctacctaacgtacgggtcctacggtccggtacccggtcccccgacgtacgggttacgtacggtcggtaccgtaggggtcgggttacggtcgggaagtaccggttacttccggtacctcctaccgtaccgtaccgacgtccgtacgacccgtaagaccgttaccgtagtaagtttcgttttaccgttacggttttaccgtacgttcgtacgacgtacgtaccgtccgttcccgaccgttccggtaccgtaccggtttaccgggtccggggaccgggggtacggaggggtacgggaacgggtagggaacgtaaccggttaaggtcgggtcggtaccgttcgggaccaccttacggttcccgttggtcctttccgtaccctcgtttcccccgtataccttacgtaacgtaacgtagttaccggg

SEQ ID NO: 23514 - DNA, 738 bp, Homo sapiens
  misc_feature: GYAE6OF01EJZ1W.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctccagagaccacggagaaattgtgttgacacagtctccaggccaccctgttctttgtctccgaggggagagacgcccacccttcctccgtgccgacgggccctaggtacgacaagttggttaaggagttttgttacgccgtaggttatacaaaccgactaaaccagtcggcctaacgggcccttacccccgggcttcccactactcgtaatcggatcggtccacgtacctaaaggttacgggaccctagtacggacctaccacccgtaacgtaacgtacggttacgtacggtcggtacggtacgggtcgggtacggtacgggtaacgtaaccgttaccgttacctaccttaccgtaccctaccgtacgtacgtacgtacgtacgtagtacgtacgtacgtagttaacgttacgtttacgtacgttacgtttacgtttacgtacgtacgacgtaccgtaccgtacgtaaccgtaaccgtaccggtacccgttaccgttaccggtaccgtaccggtacgacgtacgtaccgtaccgtaaccgtaccgtaacgtacgtacggtcgtccgtaccgtaccgtaccgttactaccttcttccgttccgtcc

SEQ ID NO: 23515 - DNA, 804 bp, Homo sapiens
  misc_feature: GYAE6OF01ER75E.24.35.D02.1.454.CMB.1.raw
  modified_base (205)..(205): a, c, t, g, unknown or other
  misc_feature (205)..(205): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccgaggccaccctgttctttgtctccgagggganagacgccctaccctctcctgaccgacgggccaggccggtaggttacgtttaagtaacgttacgttacggccgttacggtaacccaaacgaacgtaaacccgtgggacccgacggtcccgtcccgaacggcccttccctacaacttcttaatgtaacgttcgtaccctaccgaacggtacggggttccaccggttccgggaccccgtccccggaccgttaggttaccgtacggtcggtaccgtagggttcgggtacgtacgggacctaagtaccgttcgacctcctaccggtaacccgtcgacgacctaacggacctaaggaccgtccgtagtaacggtttacgttttacggtacgtttacctacgtagtaccgtacgtccgcggttacccgttcccggtccgtccggtacccgtaccggtttaacccggggttaccgggggccggggtaacggtagggaggggacggtaacggacggtaaccggtacggtacgggacggtaccgtacggacctacgttacggtctttacgggtacctttcgtacccgttcccgtaccccgtacgttacgttaacccgtagtaaccgttaggttaaccgg

SEQ ID NO: 23516 - DNA, 921 bp, Homo sapiens
  misc_feature: GYAE6OF01BFEQ8.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctcggctcccagagaccaccggagtaaattgtgttgaacactacgtcctccgaggcctacccttgttctttcgtacctccggaaggggagacgtacgccctaccctctccgtacgcgacgggccgaacggtccgggtagttaggttaagttaaacgttaccgttacggtacgttacggtaaacccgaaaacgtaaacggtaaacccgtacggacccgtaccgggtacccctaccccggaacggtccccttacccctcctaacttacttaacgttcgtaacgtttccggttaccccttaaaccccggtaaacgggtacccgggtttaacccggtaacccgggttcccgggtaccccccgggttacccccggtaacccggttaccgggttttaccggtaaccggttaccggggtaccgggttacggggtttaccgggggtaccggtttaaccgggggaaccgttaaccggtttacccttacccttacccgttccgttaacccgtaccgttacccggaacgtccgaccgtacccgtaacggacgtaccggtaagttacggtttacgttttaccggtacggttttaacgtctacggttcaacgggtcgtacgggtcccttccggtccgttcggtaccgttaccggttaccggggtccggggacggggtaccggtaggggtaccggaaggtgggtaacggaccgtaaggttgtacggcgttcgcgtaccttggtccgttattccgtttacgccttaccccggtctaccctagtaaccgtacggtgttacgtaaccggg

SEQ ID NO: 23517 - DNA, 871 bp, Homo sapiens
  misc_feature: GYAE6OF01CT7HF.24.35.D02.1.454.CMB.1.raw
tcagactactatgtcacgaccggtgctcgatttagcacacgatagttgggtttgggggaggaactgctcgagttaggacccagacgggaaccatggaacgccccagctcagcttctcttcctcctgctactcgtggcctccagacgaccaaccggaagtaaattggtgttacgacacgtacgtcctccgaggcctacccgtgttccttcgttaccgaccggaaggggacgaacggaccgaccccgtaccccttcgtcccgtggaccggtaccggggtaccaccgggtaccggtaggttagttaaacggtaaacggtttaaccgtacgggttacctaaccgggtaacccaaacgaaaccggtaaaaccgtccgggtaacccgacgggtaccccgtacccggaaccggtcccttacccgtacctacttccgtaagtgtactaccgtaccgtaccggaacgtcggtaccaccggtccgggtacccgtacccggacgtcgttacgacgggtccggtacggtacgggtcgggtcgtacgggaataacccgttactacctaccggtacctaccggaccgtaccgacgccgtaaaccggtccggtaacgacggttaacccgtagggttaaacctttacggttttcgggacccgttttaacggtacgttccgtaagttacccggacgttaccggttcccgggtacccggtaccgtccggttacccgtaccgggttaacgggtttcccggggggacgggttacggagggttaccggaagggtacggacgggaacgttagccggtggtacggtcaaccgtcctaagtcccttaggttccctacgacccttccgttaccgacttgaaccttacgattcgtgg

SEQ ID NO: 23518 - DNA, 776 bp, Homo sapiens
  misc_feature: GYAE6OF01EFCCI.24.35.D02.1.454.CMB.1.raw
  modified_base (251)..(251): a, c, t, g, unknown or other
  misc_feature (251)..(251): n is a, c, g, or t
  modified_base (761)..(761): a, c, t, g, unknown or other
  misc_feature (761)..(761): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagacgaccgaccggagtaaattgtgttgacacagtctccagccaccctgtctttgtctccgagggagagacgcccaccctctccgtgcgacggccagtcgagtagttgttacgngacgcgacgtaccttaccgttacgccgttacggtaacccaggtacgtaaacgaaacccgttcgggtccgttcggtcccgtaccccgtaacggtcccttacccgttactaacgtttaccgttaaggttccgggtccgtcccggtaccccgtaacccggacgggtccccgtacggtccggtccgggttaccggaccggtaaccgtagggtttaccgaacgggttggtaccgtacgggttcggttcggtttaacgggacctacggttaccttaccgacctttctacgtaactccgacgtacgaaccgacggtacgtacggaaccgtaacccgttaagttcgtttacgacgttagttacgttacgttcgttacgtcgtacgtttcgtttaccgtttccgtcccgttcttcccgttcttacgttaccgttactttacgttcggtaccgttaccggttaccgtagggtaccgtaggacgttagacgtaacggtaccgtagttcggtcgtaccgtanacctcgcgtttaccg

SEQ ID NO: 23519 - DNA, 742 bp, Homo sapiens
  misc_feature: GYAE6OF01AWZQN.24.35.D02.1.454.CMB.1.raw
  modified_base (201)..(201): a, c, t, g, unknown or other
  misc_feature (201)..(201): n is a, c, g, or t
  modified_base (391)..(391): a, c, t, g, unknown or other
  misc_feature (391)..(391): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttcactccgagggganagacgcccacctctcctgcgagggccacggccggtagtgttaacgtaagttaccttagggcttaggtaaccaagaacgaaaccgtgacccgagggcctcccgacgggtcctcctacgactactagtcgtattcgtccgtaccaagtacgggtctaccggtcgggaccctcccccggtagtacgggtttcncggtcggacgtacgggtcgggttccgtaggggaccgtaacgttacccgttacgactttcccgtaccgtacccggttcaacgccgtacgcccgtaagtaccgtacgttacgtaacgtttacgtttacggttaccggtttaacgttacgttcgtacgtacgacgtacgttcccggtttaccgccgttcgggtcccgtaccggtttacggtccggggacggggtacggtagggtacgggaacgggtacggacggtaacggtaacgtggtcggtaccgtagccgtaccgtagttccgtacggtttccttacgtacttcccgtcccgtctacgtacgtacttaacgtacgttacgg

SEQ ID NO: 23520 - DNA, 837 bp, Homo sapiens
  misc_feature: GYAE6OF01EWCK1.24.35.D02.1.454.CMB.1.raw
  modified_base (206)..(206): a, c, t, g, unknown or other
  misc_feature (206)..(206): n is a, c, g, or t
  modified_base (528)..(528): a, c, t, g, unknown or other
  misc_feature (528)..(528): n is a, c, g, or t
tcagactactatgtcacgaccggtgctcgatttagcacacgatagttgggttgggggaggaactgctcagttaggacccagagggaaccatggaagccccagctcagcttctcttcctcctgctactctggctcccagacgaccaccggagaaattgtgttgacacagtcctccaggctaccctgttctttgtcctccgagggganaggacgccaccctctcctgcaggccaggcggagttgttagtaagtacgttagcgtacggtaaccaacgaagtaaaccgtcggaccgacggtacctacccgacggtccctacctacgacttactacgttggtacgttccgtacctacccggtaacggtaaccgggggttacctaaccgggttccccggggtccccggtaccccccggtaccggttacgggtttacgtaacggggtccgggacggttaggggttccggggtacgggttaacgggtaccgtaacggtacccttaccgtaaccttcccgggtaaccgtccccgtanaaccggcgtaaccggtccgtacgtaccggtctaaggaacggttttccgttttacggggttacgttttaacctcgttacggtccgacggtaccgttcggtcccggttaccggtcccgtacgggtccccgttcgggtttaaccggggttccggggtaaccgggggggaccgtaacggggggtaggacgggaacggtacggaaccgttacgggtcggttcggacgtacctacccgaacccgttacgtcctacggttcctaccgttccctcccgttccaaccgttcgtacgtaaccggtaaatacggttacgg

SEQ ID NO: 23521 - DNA, 837 bp, Homo sapiens
  misc_feature: GYAE6OF01DREUH.24.35.D02.1.454.CMB.1.raw
tcagactactatgtcacgaccggtgctcgatttagcacacgatagttgggtttgggggaggaactgctcagttaggacccagagggaaccatggaacgccccagctcagcctttctccttcctcctgtcctactctggcctccgaggacgacccgaccgggaagtaaattggaagttcgaaccactacgttcctaccgaggcctcccgttgttccttttacgtccgtccgggaagggggacgtacggaccgtcccctaacccccgttcgtcccgtcgaccgggacccggggtccgtaaacgggcccgggttaggtttaacgggtttaagtaaacggtttccgttaggtccgttaacggtaaacccaagaacggtaaacccgttcggaccgacggtccctacccggacgtccttcccgtactagtctagtcgtacgttccgtacctacgaaccggtacggtccgaccgggtccggtacccggtcccgcggttaccgtacgtacgggccggtagtcgggtcggttacgcggtaaccgtcgtactcctacgtccgtaccgccgtacgacgtccgacgtacgttacggtacgtaccgttacgttaagtttcgtttccggttacggtttactacggttccgacgtacgtaccggttcggtccgttaccccggtcgtacggtcccgttaacgttacccgggggtcggggaccggggtaacgggtcggggtagggacggtaacgggtacgaacggtgtacggcggtaactccggaacctcttacgttgtacccttcgttacctccgttacccgtcgtacctcgttacacgtaacgtcgttaacg

SEQ ID NO: 23522 - DNA, 902 bp, Homo sapiens
  misc_feature: GYAE6OF01AYQKR.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccggagaaattgtgttgacacagtctccgaggccaccctgttctttgtctccgaggggagagacgccaccctctccgtgcgacggccacggccggtagttacgttagtaacgttacgttaggctacggtaaccaaacgacgtaaaccgtcggaccgacggcctcccgacggcctacccgttcacttaccgtacgttgtacgttcgtacctaccgaacgtacgggtacctaccggtcgggtccccggtcccccggtaccgtacgggttaccgtaagggtcggtaccggtacgggttcgggttacgtacgggaccgtaacgtacttcccgtacgtcccgtaccgtaccgtacgacgacgtacgtacccgtacgaccgtacccttaaggtaacgtttaccgttttacgggttacccgttttaacgtaccgttacgggttacaaccgggtccgtaaccgggttccccggttttcccgggtaccccgttacccggggttccccggtttaaacccggttttaacccgggggttacccgggggggtacccgggggttaaaccccgggtaagggggggtcccggtaaaacgggggacccggggttaaccggtaaaccgggttaccggtttacggggtaccggtccggtaaccggccctaaccggttaacgtttcccgtttaggtccccttttaaccgccgttttaaccccccgttcccggtacttaacccgtagttaaccccgtaaagttaggtttaacccggg

SEQ ID NO: 23523 - DNA, 811 bp, Homo sapiens
  misc_feature: GYAE6OF01B8UWA.24.35.D02.1.454.CMB.1.raw
  modified_base (504)..(504): a, c, t, g, unknown or other
  misc_feature (504)..(504): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgttctttcgtcctcgagggagagacgccaccctcgtccgtacgcgaggcccaggccggtagttaggttacggttaacggtaaccttagggccttaggtaacctaacgacggaaaccttgggaccctaacggtccgtacccgacggtacctacccgttacgaacgttcgtaacttacggaattcggtacctaccgtaacgtacggggtctaacccgggtcggtacccgtccccgtacgtaacgggtttccgaagggttcggacggtacgggttcggtcgttacgggaactacggtactttacacgttacctccggaaccgttnacgacgtcgtaccctagggtacctcgtaggtacgttacgttttacggacggttttaactacgttacgtaacgtcgtactcgggttccgtttaccggtacctccgggttaccttacccggttaacgggtttccgggggaccgggggttaaccgtaacgggggtacgtaacggggaacggtaacgttacccgggtaggttacggtcgggaccgttagacccgaacttacgggtcttacggtttacttccgtaccgtttacccgtaccgttaccggtactttaaccgtacgaaaccgttaacgggttacg

SEQ ID NO: 23524 - DNA, 985 bp, Homo sapiens
  misc_feature: GYAE6OF01ASO1V.24.35.D02.1.454.CMB.1.raw
tcagactactatgtcacgaccggtgctcgatttagcacacgatagttgggtttgggggaggaactgctcagttaggacccagagggaaccatggaacgccccagctcagccttctcttcctcctgctactcgtggcctaccagacgaccgaaccggaagtaagtttcgttggttacgaacactacgttacctccgaggtcctacccgttgtttccttttcggacccgtacggaaggggacgacggtacccacccctacccttcccgttccgacgtccgggaaccgggcccgtaacgggtaccgggtaggtttaaggtttaaacggttaaggtttaacccggtttagggttacctaaccgggtaaccaaaccgtaaaaccggtaacccggtacggtaccccggacccgggttacctaccccgtcggtaccctaccttctaacctttacgttagtacgtccgttaccgaaccccgtttaacgggaaccggttaccggttccggtaccccggttaccggggtaccccccggtacccggtttacgggtaccgggtttaccggaacggggttcggtacccgggtttaggggtaccgggtaacgggtaccggttaaacccgttcccggtttaacccttccgtaccgtttaccccgggaccccgttaccgaacggggaaaccttaccggaccccggtttaacgtaaccggttaaccggttacggtacggttttaacggtttacggtttaaccgggtttacggtttacccggttgtaccggtactaccggtaccgttccggtcccgtacccgggtcccgttaccggtaccgggtttaccgggtcggggtaaccggggggtacggaacgggggtacggacgggaacggttacggaacggacgttcggtacgacgttcgactaccgttacgttacttccggttacttccggtcctccgttccacgttcggtaactagaacgtttgacgttacggg

SEQ ID NO: 23525 - DNA, 793 bp, Homo sapiens
  misc_feature: GYAE6OF01CPY5Q.24.35.D02.1.454.CMB.1.raw
  modified_base (747)..(747): a, c, t, g, unknown or other
  misc_feature (747)..(747): n is a, c, g, or t
tcagactactatgtcacgaccggtgctcgatttagcacacgatagttgggtttgggggaggaactgctcagttaggacccagaggaaccatggaagccccagctcagcttctcttcctcctgctactctggctccagagaccaccggagaaattgtgttagacacagtctccaggccacccttgtcttgtactccgaggggacaagcgaccccacccgttctccgtggaccgacggggcccaaggccgggtagttaggttaagttaaacggtcgtttaacgggccttacgggaaccccaaagacggtaaaacccgtcgggacccgtacgggtcccgtacccgacggtcccttaccctaccttacgttaccttaacgttcggttaaacttcggtttacccctaaccccgtaaaacggtacccgggtttacccgaaccccgggttaccgtcccccgggtttaacccccgcccggtttaacggttaccggttaacggtccggtacgggacgggttacgggttcggtacgggaactaacgttcgttaacccgtccttacgtacccgtcggttaccacggtacctaacggtccgttaggacgtacgtacgtaagttacgtttcgtacgtttacacgttcgtacgacgcttaccgtcgttcgtccgtacgtaccgtcgtaccggtcgggcggggtacgagggtacgaggacgtagacggtatggacgtctcgactccacgttcgttacgttcnccgttaccgtcccttcccgactacttaccgagtacgttagtaccgg

SEQ ID NO: 23526 - DNA, 802 bp, Homo sapiens
  misc_feature: GYAE6OF01DPCLG.24.35.D02.1.454.CMB.1.raw
  modified_base (236)..(236): a, c, t, g, unknown or other
  misc_feature (236)..(236): n is a, c, g, or t
  modified_base (789)..(789): a, c, t, g, unknown or other
  misc_feature (789)..(789): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagacgacccaccggagactattgtgttagacacagtcctccagcccacccgtgttcttttcgtacctccggaaggggaaacgcgccctaccctctccngacgacgggccagtcgaactaagttggttcggcacggacctaaacgttagccgttacggaaccacgacaaacggtaaacccgtcggacccgacggtccctacccgaacggtcccttcccgtccttctacgtcggtcttccgtcccgtaccgacccggaccgggtccccgttcgggtccgtaccccgacggtcccgttacgggttccgggtttgggtccgggttcggggttcggtacggggtaaccgtaaggttcctttaccgtaccttccgtaccaacccgtacgtcggaccggtcccggtaccctaccgttacgtacgttaacgtaacgtttagttttacgtactttacttttttacgttcgttacgtacctaacgttactacgttggtactacgttcgtacccgttacgtacgtttaccgttcggaaccgggtacggtaaccgttaacggaggtaacgtacgtaaacgtaaaaccgtgttacggtacggtacgtcgtacccgtactccgttccgttacgtttacccttccttaaccgttccccgttacccncgttcgttaacgg

SEQ ID NO: 23527 - DNA, 1010 bp, Homo sapiens
  misc_feature: GYAE6OF01B80PK.24.35.D02.1.454.CMB.1.raw
  modified_base (221)..(221): a, c, t, g, unknown or other
  misc_feature (221)..(221): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagacgaccgaaccggaagtaaagttgtgttagacacgagtcctaccgaggccacccgttgttcctttcgtcctccgagggganaggacgccctaccctctcctcgcgacggccacggccggtagtagttaagtacgttacgttaggccgtacggtaaccaaacgaacgtaaaccgtcggaccgacggtccctacccgacggtcccttccctacgtacttacctaagttggacgtttcgtacccgtaaccgtaaaaccgggtcggttaccaacccggttccgggtacccccgtcccccgggtacgttacgggttcgacgggttacggaccggttaggggttcgggtccggttaacggaccgttaacggtacccttaccgtaccgttcccgttaaccgaccggtacgtaaccgcccggtaacgtaccgtacgggtaacttaccggtaagggtaagtttaccggttttttaccggtacccgggtttttaaactcggttaaacgtccccgtaaaggttccgtacccggtttcccccgggtttaccggccccgggtttaaacccgggtcccggttttaaaccggggttttaccccgggggttaccccggggggtaaccggggggtaacggttaaagggggggtcgggtaaagggtaaccgggggtaacccggttaaacggttacccggggtttgggggtacccggttaaccggtaacccggtaacccgtaaacccgggtttcccgtttaccgggtttaaccccggttttccttttaaccccggggttaaccccttttttccccccgggaaccccgttaccccgttacggttttaaccggaaaacccccggttttaaagttacccgggtttaaacggg

SEQ ID NO: 23528 - DNA, 727 bp, Homo sapiens
  misc_feature: GYAE6OF01E39K1.24.35.D02.1.454.CMB.1.raw
  modified_base (205)..(205): a, c, t, g, unknown or other
  misc_feature (205)..(205): n is a, c, g, or t
  modified_base (345)..(345): a, c, t, g, unknown or other
  misc_feature (345)..(345): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccggagaaattgtgttgacacagtcctccaggccaccctgtctttgtctccgagggganagacgcccaccctctcctgcgacggccaggccggtagtgttaacgtaagtacgttaggctacggtacccaacgaacgaaaccgtcggccgacggcctacccgaggcctcctcacttctagtgattcgtcctaccgaacgnggtccacgtcggccctcccgctacgtcaggtgcgtaggtggtccgtaggtacacgtactacgctaccgcgaccgtcgacgccgtacgtacccgtagtaccgtacgttaggaacgttttacgtttccgggtttaacccgttttaccgtaactttacggtaccgtacgtacccgtcggttaccgttccccggtacccggttaccggtaccccgtttaaccgggtttaaccgggtttccggggggaccgggggttaccggtaaggggtacggacgggaacgggtacgaacggtaccgttgggtccggtcgtcgaccgtactcgttcgttcgttaccttacgtaccttcccgtacccgtcctacgtcgtaaccgtataggtttacg

SEQ ID NO: 23529 - DNA, 880 bp, Homo sapiens
  misc_feature: GYAE6OF01ETFMN.24.35.D02.1.454.CMB.1.raw
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
tcagactactatgtcacgaccggtgctcgatttagcacacgatagttgggtttgggggaggaactgctcagttaggacccagagggaaccatggaacgccccagctcagcttctcttcctcctgctactctgcctccagacgaccgacggataattgtgttagacactacgttctccgaggcctacccgttgttctttcgccgtaccggaaggggaaacnccgaccctacccttcgtaccggngccgacgggcctaggtacgaagtacgttcggttagacgtacgtaccgaacgtttcgaccgttcgaacgagaccgaaacggtaccgtcggaccgacggtccctaccgacggtcccttcctaccgttacgtacgtccgtacgtccgttacccgtacccgacccgggtaccggttccccggtggtaccccgtaccgacggttaccgggttacgggttttcggggtacgggttccggggtttacggtcggtaacgggtacggttaacgttaccgtttaccgtaccgtaccgtaccctaaaccgtacgtttcccgaccggttaccccgtccttaaccggtacggttaacctttaagggtaacttttaccggtttactaaccgttttaacgtttttcttaccggtactaaccgttaaacgtacgtttacggttacggtacccgttacggttacccgttacccggttaacgtttaccgttaccgggtttaccgaacgggttaaacggtacctaaggttagaaccgtacgaaacgtaccggtagttaccggaacgttcctaccggttactacgttacgttccgttacggttacccctttaccgtcccttaccccgtacccgttaccttaagtccggttaaaaccg

SEQ ID NO: 23530 - DNA, 790 bp, Homo sapiens
  misc_feature: GYAE6OF01BF45W.24.35.D02.1.454.CMB.1.raw
  modified_base (241)..(241): a, c, t, g, unknown or other
  misc_feature (241)..(241): n is a, c, g, or t
  modified_base (733)..(733): a, c, t, g, unknown or other
  misc_feature (733)..(733): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctccagagaccgacggagtaaattgtgttgacactagtcctccgaggccacccttgttctttgtcctcgaggggagacgacgccctaccctctccgtgcgacgggccngggccggtagttagttaagtaagtcgttaggcgtaggtaaccaagaacgaaccgtggccacgtccgtacccgacggtcctcctcacttctacgtgtacttccgtacctaccgaacggtacggtccgacggtccggtacccggtccccgtacgttacggtccgtaggtcggtacgtcggggttacggtcggtacgggtaacctacggtacttaccgtacttcccgttaacccggaccgttacgaccggactaccgggtcccgaaaggtacccgttaccggtaagggtttaacggttttacgtttaccgggtttaaccgttttaaccgtacgttacgtaacgtacgccggtaccgttccggttccccggtaccgtcgggtaaccctacgggttttacccgggggttcccgggggacggggtacggtacggggtaggagggtacgggaaccgttgggtaacgtggtccgtcgtcgtaacctacttcggttccttnttaccgttaccgttacctccccggtcctaactacgtcgtaaacgtatgttaaccggg

SEQ ID NO: 23531 - DNA, 808 bp, Homo sapiens
  misc_feature: GYAE6OF01DCHSJ.24.35.D02.1.454.CMB.1.raw
  modified_base (130)..(130): a, c, t, g, unknown or other
  misc_feature (130)..(130): n is a, c, g, or t
  modified_base (159)..(159): a, c, t, g, unknown or other
  misc_feature (159)..(159): n is a, c, g, or t
  modified_base (403)..(403): a, c, t, g, unknown or other
  misc_feature (403)..(403): n is a, c, g, or t
  modified_base (515)..(515): a, c, t, g, unknown or other
  misc_feature (515)..(515): n is a, c, g, or t
  modified_base (791)..(791): a, c, t, g, unknown or other
  misc_feature (791)..(791): n is a, c, g, or t
tcagactactatgtcacgaccggtgctcgatttagcacacgataggttgggtttgggggaggaactgctcagttaggacccagaggaaccatggaagccccagctcagcttctcttcctcctgctactcnggcctccagagacccgacggagaattgtnttacgacactagtctccaggtcctacccgttgttcgttcgtctacccggaaaggggaaaacgccgcccctacccgttcctccgtaggcccggagggaccgtagtagggtaaagtaaggttcgttacggaccgaggtaaccctttaaacgttaccggcccggttacggtaaccgaagtaaccgaaaccggttaaaccgcgggtacccgaccggttccctacccgtacggtccctcccgttacctntagtccgtccgtcctccgtaacccacccggtaccggtcccgtcgacccgcctaccggccggtttacgggttcgtaccggggtcggtgggtcgtacggacgtaagtcttaccnccgttctacgactaacgcgcggtacccgtccgtaccgtacgtacgtagtacgtttacggttacttacttttacgtttaacgtttccttaacggaaccttttacgaccgttagttccggtacgttacccggtccgttaccccttacggttaaccttcgggttaaccgggaacgtaacccgggtaactacgggttagaacgtagtaaccgtaaccgtacgcggtagccgtaggtaccctatcgtttccggattacccgtcctacccgttccgttaccncttaaaccgtctaacgg

SEQ ID NO: 23532 - DNA, 892 bp, Homo sapiens
  misc_feature: GYAE6OF01ETY0H.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctaccgaggcctacccttgttctttgtcctccggaaggggagacgcgccccaccctctccgtgccgacgggtccaggccgggtagttcgttaaggtaacgttaccgttaggtcgttacggtaacccaaacgacggtaaacccgtcggaccaacgggtccctacccgacggtccctccctactacgttacgtagtagtacgttcgtaccctaacccgtaaacgggtacgggtacctaccggttcccggggtccccggtaccccccgtacggttaacgggttaccggtaacgggtccgggtaccgtaggggttccggggtaccgtacggggtaaccgttacggttacccgtttaccgtaccgtttacccgtacccgtaacccggtcgacgtacccgaacggttaccccggtaaggtacccggtaccggtttaaggtaacctttttcggtttaccgggttacgttttaaccgtacggttacgtaccgtacggttcccgtaaccgggttcccccgttaacccggttggtaccccgttttacggtaacccggggtttccgggggggaacccgggtagggtaacggggttacgggaacgtaacgggggtctaaacccgggttagtcggtacggccgtacgtaccctaggtacttcccgttcgttccgttacctaaccgtttccccgtccgtaaactccgtttacgaacgtaaccggttagtggttaccg

SEQ ID NO: 23533 - DNA, 974 bp, Homo sapiens
  misc_feature: GYAE6OF01BU2AU.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctccagagaccaccggagaaattgtgttgacacagtctccaggccacccttgtctttgctccgagggganagacgcccaccctcgtccctgacgacgggccaggccggtagttgttaagtaagttacgttaggcgttacggtaaccaaacgtaacgtaaacccgtcggacccgaacgggtcccgttccccgaagggtccccttaccctacctaacttaccgttaacgttacgtaactttcccggttaccctaacccgtaaaccgggtacggggttcccaaccggtttccggggaccccggttccccccggaccgttaacgggtttcccgaagggttcggaccgttaacggggttcggggtccgttaggggaacctaacgttaccctttaccgtacgttcccgtaacccgtacccggtactaacggtacccggtaacgtacccgtaacgggtaccgtaccgttaaggttaaacgttttccggttttttacgggttaccgggttttttaacccttacgggttacgttacccggtaacggttacccggtaccggggtttcccccggtttaccccgggtcccggttcccgggtaacccccgggtttaacccggttttttaacccggggggttcccggggggggaacccgggggggttaacggttaacgggggggttacgggaaacggggttacggggaaaccggtaaccgggtaacggttggggtaccggtcgtacccggtaaccgtaccgttcgtttcccggttcgtttaacccgttcctacccgtttcccccgttaacccggtacctaacgttacccgtaaacggtaccttagggttaaccgg

SEQ ID NO: 23534 - DNA, 1052 bp, Homo sapiens
  misc_feature: GYAE6OF01BG536.24.35.D02.1.454.CMB.1.raw
tcagactactatgtcacgaccggtgctcgatttagcacacgatagttggggtttgggggaggaactgctcagttaggacccagagggaaccatggaacgccccagctcagccttctcttccctcctgctactctggcctcccagacgacccacggaagtaattggtgttgacgctacgtcctccgacggtcctacccgttcgtttctttcggtccgtaccggagggggtagacgacgccccgtaccccttccgtccgtcggaccggtacggggtacccgtaacggtaccggaaaggttagggtttacggttaccggaccggtacggtaccggtaacgttacccgtttaaccgttaccggtacccgttacgggtaacccgagtaccgtaaaccggtaaacccgttcgggtcccgtccgggtcccgttacccggtaccggtccccttaccccgtaccgttacgtttaccggttacgggttccgggtacccggtaccccgtaacccggtaaccccgggtaccggggtacccgttaccgggttcccggggtaacccggttacccggggtaccgggtaaccggttacggggtaccggtaacgggtcggggtacggttacgggggttaccgggtttaccggtttacggggtaaccgttacgttaccccgttaccttaaccgttcctaaccgtacgtttacccgaacccgtaccggtaaaccggtaccggttaaccggggtacccggtaaaccgggtaccccgttttaacgggttaacgttttacgggacggttttacggtttaaccggtttacgtttacggttaccgggttaccgttacggttttcccggttttaccggtttccccgtttccccgttccccgtttaccgtttacccttaccggtttaccgttttaccgggttaccgggtttccggttaacccgggttcggttaccgggtaccgttacgggtacggtaacgttacccgttacggaacggtttaaccccgtgggttaccggtcgtacccgtaaccggtcccttaacgggtcctttaccgg

SEQ ID NO: 23535 - DNA, 777 bp, Homo sapiens
  misc_feature: GYAE6OF01AHTA4.24.35.D02.1.454.CMB.1.raw
  modified_base (212)..(212): a, c, t, g, unknown or other
  misc_feature (212)..(212): n is a, c, g, or t
tcagactactatgtcacgaccggtgctcgatttagcacacgatagttgggtttgggggaggaactgctcagttaggacccagagggaaccatggaagccccagcgcagcttctcttcctcctgctactctggcctcccagataccacgtggaagaagtagtcatcgacgcagtcctccagcccacctgtctgtctcgaccgaggggtaaacncgcccaccctcgtcctgcgagggccagtgagtagtgtcgacagactaaccttagccgtaggtaacccagtacaacggtaaccgttcggaccacggacctccgacggtcctaccctcccgtactacgtcgacctcgtcccgtacccgaccggaccgggtcccgttacggtcgtacccccggacgtccgggttacgggttttccggttaccgggggtcgggttacggggtaccgttcggggaacgttaccggttactttccgtaaccgttcccgtaccttaccgtaacgtcccgtaccgggtccgtcccgttaccgtaacgtaccgtaaggttaacgtttgttttacgacctttagttttaacgttccgtaccgttaacctaaaccgttacgtttaggtaccgtacgttaccgtaccggtttcccttaaccggttacctttaccggtttacggacccggttaacgggaccgtaaccgtaggaacgtacgtaacgaaacgtcgttacggtcggtactcgtaccgtacctagttccgttacttactaccttacccggtcctccggtacc

SEQ ID NO: 23536 - DNA, 850 bp, Homo sapiens
  misc_feature: GYAE6OF01DRDMW.24.35.D02.1.454.CMB.1.raw
  modified_base (232)..(232): a, c, t, g, unknown or other
  misc_feature (232)..(232): n is a, c, g, or t
tcagactactatgtcacgaccggtgctcgatttagcacacgatagttgggtttgggggaggaactgctcagttaggacccagagggaaccatggaacgccccagctcagcttctcttcctcctgctactctggctcccagagaccaccggaataaattgtgttcgacacgacgtcctccgaggccacccttgtctttgtactccgagggtagacgacgcccaccctctccgngccgaggtccacggccggtagttggttaagtaacgttacgttacggcttacggtaacccaaacgtaccgaaaccgtcggacccgaacgggtccctacccggtacggtacccttcccgtactacttaccgtaagtacggtacctttacggttacccttaacccgaacgggttaccgggttaccctaaccgggttcccgggtaccccgtacccccggtaccgtacggttaccggtacgggttcggaaccgttcgggttcgggtaccgtacgggtactacggttacctaccgtacttccgtaccgtaccgtacaccgcgacgtaccgtagccgtaccgtaagtagtttcgtttaccgtaccggttttactggttcgacggtacgtacccgtacgggtttcccgttaccgtcccgggttccggaacccggttttcggtttaacccgggttacccgggggacgggggtaccgtagggggttaccggaacggtacggggtaaccgaccgttaagggtggttaaccgccggtaacgacccgttacttacgttccggttaagtcccgtttacctaccggttcccttacccgactagttacccgtaacgtacgtaacggtttaccgg

SEQ ID NO: 23537 - DNA, 877 bp, Homo sapiens
  misc_feature: GYAE6OF01BIYN5.24.35.D02.1.454.CMB.1.raw
  modified_base (223)..(223): a, c, t, g, unknown or other
  misc_feature (223)..(223): n is a, c, g, or t
tcagactactatgtcacgaccggtgctcgatttagcacacgatagttgggtttgggggaggaactgctcagttaggacccagagggaaccatggaacgccccagctcagcttctcttcctcctgctactctggctcccagagaccaccggagtaaacttgtcgtgacactagtcctaccacggcctacccgttgttcgtttcgtaccgtccggaggggtacgngaaccgtccctaccctccgttccgtgaccggacggacccgacgggtccggtaaggttacgtttaaaggtaacggtttaacgttcgggtaccgttacggtaaacccaaacgtaaaccggaaaacccggttcggccgacggtccctcccgacggtccttcccgtatactacgtacgtcgtacgttctaccttaaccgaacggtaccggttacaccggttcccggaccccgtccccggtaccggtacggtttccgacggtacggtccggtagggttacgggtcggtacggtaaccgtacgtcgttaccgacctccttaccgaccgcgtacgaccgtacgtccgaacgtacgacgttaggtaacgttttaccgtttaggtttccggtttactacgttagtaccggtacgtccggaccgttccgttccccgacgggtccgttaacccggtttcggtttaaccggggtccgggggaaccggggtaccggtttaggggcggaaacgggttaccgggtacgtaaccggtcggtacggtacgaccggttacctaaccggtaacgttcgtaccggtttcgttaccccggttacttccccgggtttaacccgtcccgtaaccgttcggttaaaccccgaacgttaaacggtttcccggttaacgg

SEQ ID NO: 23538 - DNA, 902 bp, Homo sapiens
  misc_feature: GYAE6OF01EZCA8.24.35.D02.1.454.CMB.1.raw
tcagactactatgtcacgaccggtgctcgatttagcacacgatagttgggtttgggggaggaactgctcagttaggacccagagggaccatggaagccccagctcagcttctcttcctcctgctactctggctcccagagaccaccggagaattgtgttgacacagtctccaggccaccctgttctttgtcctcgaggggagagacgcccaccctctaccgtcgcgacgggccctaggccggtagttggttaagttaaggtaacgttcggaccgtaggtaaaccaaccgtaagtaaaacccgtcggaccgacggtacctacccgacggtacccttcccgtcctaaacttcctaacgtaggtacgttacggttacccctttaccgtaaaaccggacggggtttaccgaccgttccgggtaacccgttcccccccggtaagtacccgggtttaccggtaagggttacggtccggtacggttaacggggtccgttaacggggaccgtaacggttaacctttaccgaacctttccgtaaccccgtaccgttaccgaacgacgaaccgtaccgtaacggtacgtacccgttaaggtaaacgtttacggtttttcgaacccgggttttaactacccgtttacgtaacccgttacgggacctacccgggtttccgttaaccggtccccggttacgggttccccggaacccgttttaaccgggtttacccgggggacccgggggtacccggggaaggggttacgggacggggaaccggtaacggtacccggtaaagtcggttcgggtaaaccttcggaacccttacggtaacgtttccgttaccgttccgttaccgttacctcccgtttcccggaaccttgtacccgttaacaccgtttagttaaccggg

SEQ ID NO: 23539 - DNA, 675 bp, Homo sapiens
  misc_feature: GYAE6OF01C5KXC.24.35.D02.1.454.CMB.1.raw
  modified_base (162)..(162): a, c, t, g, unknown or other
  misc_feature (162)..(162): n is a, c, g, or t
  modified_base (199)..(199): a, c, t, g, unknown or other
  misc_feature (199)..(199): n is a, c, g, or t
  modified_base (568)..(568): a, c, t, g, unknown or other
  misc_feature (568)..(568): n is a, c, g, or t
  modified_base (587)..(587): a, c, t, g, unknown or other
  misc_feature (587)..(587): n is a, c, g, or t
  modified_base (624)..(624): a, c, t, g, unknown or other
  misc_feature (624)..(624): n is a, c, g, or t
  modified_base (649)..(649): a, c, t, g, unknown or other
  misc_feature (649)..(649): n is a, c, g, or t
  modified_base (657)..(657): a, c, t, g, unknown or other
  misc_feature (657)..(657): n is a, c, g, or t
  modified_base (667)..(667): a, c, t, g, unknown or other
  misc_feature (667)..(667): n is a, c, g, or t
tcagactactatgtcacgaccggtgctcgatttagcacacgatagttgggttggggaggaactgctcagttaggaccagaggaccatggaaaccccagcgcagcttctcttcctcctgctactctgctccagccatcgacggagtattgtgtgacgcagtcnccaggcctacccgttgtcctttgtctccggagggganacgaccgccctaccctcgtccgtgaccggacggaccctagttccaaggttacggtacgttacggccgaggtactacggtaccttaacgttaccggccgttacggttaccaaggtcctaacggtaaacccgtggtacccgtaggtacccgtcccgaagtccccttacgtactacttaccgttagtcggtaacgtcccgtaccaccggaggtccctacggtcgggacgtccggaggttacctgggttccaggttcggactacggttcggtcgttacgggactacggtctacgtacctcgttcgacgtcgtacgtcgaacgcgtacgtacggaacctccgtaagttcgttacgacgttagttcttacgtcgngtctacgtgttgtcctacncttactcgtagtcgttattcgttacgacgtcggtacngtcgtagactaggactagaccgtgnggtaaccncggattaccngtccgtag

SEQ ID NO: 23540 - DNA, 996 bp, Homo sapiens
  misc_feature: GYAE6OF01C1F4Q.24.35.D02.1.454.CMB.1.raw
tcagactactatgtcacgaccggtgctcgatttagcacacgatagttgggtttgggggaggaactgctcagttaggacccaggaagggaaccatggaacgccccagctcagcttctcttcctcctgcctactctggcctccagactacccgacgtaggagaaagttacgtcatacggacgcacgtcctccacgccctaccctgtctgtcgtactaccggaagggaacacgcccaccctctccgtgccgacgggtccaggtagtaacgtagttggtacggactacgtaacctaacgttccggaccgttacggtacccgaacggtaaccgaaacgggttaaaacccgcggaaccgtaacccgggtccccgtaccccggaacggttcccccttccctacccgttaccgttacgtccggttccgttccggtacccccgtacccggaacccccggggtaccggggtcccccggtttaccgggtttacccccggtaccccgtaccgggttacccggggttttaccggggtttcggggttaccggggggttcccggggtttgggttacccgggggttaaagggtacccgttaaacggttttcttttacccggtaccctttaccggtaaccccttaccgaacggttccggacccgggttcccccgttacctacggttaccgtaccgtttaaggttaacgttttacgtttaccgtttactttttaaccggttttactttaccgggttacgtaaccctttaaaacgtcggtttacgggtttacggttaacccggtacccggtttccggtttaccccccgtttaaaccgttaaccgggttttccgttaaccggggtaaccggggaaccggttaaacccgtagggtaccggttaactaacccggttaaaacgtaacccgggttggtaaccggtcgtccgtacggtaacccttacttccgttacgtttaccccgttcttaacccgtttccggtccccttaacggtaccg

SEQ ID NO: 23541 - DNA, 814 bp, Homo sapiens
  misc_feature: GYAE6OF01EQZQM.24.35.D02.1.454.CMB.1.raw
tcagactactatgtcacgaccggtgctcgatttagcacacgatagttgggtttgggggaggaactgctcagttaggacccagagggaaccatggaacgccccagctcagcttctcttcctcctgctactctggctcccagacgaccaccggagaattgtgtgacacagtctccaggccaccctgttctttgtctccgaggggagagacgcccaccctctccgtgcgacgggccgacggccggagttgttaagtaacgttacgttaggtctacgggtaacaacgaacgtaaaccgtggacccagggccctacccgaacggccttaccctactactacttaagtcgtaactttccggtacctacccggtaacggtacggggtacctaccggtccgggtaccccgtacccccggtacgtaacgggtttcccgtagggtacggccggtagggttcggggtacgtacgggactaacgtaccgttactaccgttcccgtaccacccgtactacggccgtaacgtcccgtaagtaccgtcgttaagtaacggtttacgtttcgttaaccgggttttactacgttacgtactacggtaccgtaccgggttcccgttacccgtcccggttaccggtcccgttacgggtttacccgggttcgggggaccggggttacgggagggggtacggagggtaacgggtacgtaacggtacgggtggtacgggtccgtacgaccgtaccttacgtcgttaccgtttctacccttagttcccccggtaccccgtacgttacctaccggttaactacgttaaggttaccggg

SEQ ID NO: 23542 - DNA, 660 bp, Homo sapiens
  misc_feature: GYAE6OF01EPBSR.24.35.D02.1.454.CMB.1.raw
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (266)..(266): a, c, t, g, unknown or other
  misc_feature (266)..(266): n is a, c, g, or t
  modified_base (390)..(390): a, c, t, g, unknown or other
  misc_feature (390)..(390): n is a, c, g, or t
tcagactactatgtcacgaccggtgctcgatttagcacacgatagttgggtttgggggaggaactgctcagttaggacccagagggaaccatggaagccccagcgcagccttctcttcctcctgctactctggcctcccagccatcaccgggagaattgtgttgacgcagtctccaggccacctgtctttgtctcgaggggnagngcccaccctctcctgcacgggccagtcagagtgttacgcagcagtctacttgcctggaccngtacacgtaaacctggccaggtcctcccgaggcctccctctctatcgctcgtcctccgaccgacggtcccctggtactcccgacgtccgtacggttcggtggccgggttggtcgtacgggtacncgttacgtttaccacgtcctaccgacctacgtccgaccggtccgtccctaccgtacgttaccgtaggtaacgtttatttaccgttacttaactttttacgtttccgttacgttaacctaaacttcgttagttcggttacgtacgttcggtacccgttccgtaccgttacgtttccgggaccgtaacgggaaccgtacgtaggtactacgtaaccgtaacggagtcgtacggactgactacgtctcgttcgtactttcgcttccggtaccc

SEQ ID NO: 23543 - DNA, 243 bp, Homo sapiens
  misc_feature: GYAE6OF02GBGI0.24.35.D02.1.454.CMB.1.raw
  modified_base (241)..(243): a, c, t, g, unknown or other
  misc_feature (241)..(243): n is a, c, g, or t
tcagactactatgtcacgaccggtgctcgatttagcacacgatagttgggtttgggggaagaggaagactgacggtcctcccaggagttcaggtgctgggcaccttgggcacgggggaggtgtgtcacaagatttgggctctgggcaccgtgggcatggggaggtgtgtcacaagatttgggctgcctggtcaaggactacttccacatagtagtctgagcgggctggcaaggcgcatagnnn

SEQ ID NO: 23544 - DNA, 533 bp, Homo sapiens
  misc_feature: GYAE6OF02G370D.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggccgtccccgcaggttcagtggcagtgggtctgggacagacttcactctcaccgtcagcagcctagagcctgaagattttgcggtttactactgtcagcagtcgttccgcctcggccgctaactttcgggcggggaccagggtggagaggagacgaacgtggtggctgcaccagtcgtgtcttcacttccttcccgctactctacgactatacg

SEQ ID NO: 23545 - DNA, 220 bp, Homo sapiens
  misc_feature: GYAE6OF02HND1T.24.35.D02.1.454.CMB.1.raw
  modified_base (218)..(220): a, c, t, g, unknown or other
  misc_feature (218)..(220): n is a, c, g, or t
tcagactactatgtcacgaccggtgctcgatttagcacacgatagttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnn

SEQ ID NO: 23546 - DNA, 546 bp, Homo sapiens
  misc_feature: GYAE6OF02GLUSZ.24.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccacctctcctgcagggccagccggagtgttagtaagtacttaggctggtaccaanagaaacctggccaggctcccaggctcctcatctatgatgtctccaacgngggtcacgtggccgtccccgctaggttcaggtggcaggtgggtctgggacagacttcacttctcaccgtcagcagcctagacgcctgaagtatttgcggtttactactgtacagcagtcgttccgcctggccgcgttaacgtttccgggacgggggtaccgaggggtggaggaggaggacgaacgtggtggcgtgcacgagtctgttctctactcctcccgcatcgtcgactatag

SEQ ID NO: 23547 - DNA, 534 bp, Homo sapiens
  misc_feature: GYAE6OF02ITB64.24.35.D02.1.454.CMB.1.raw
  modified_base (263)..(263): a, c, t, g, unknown or other
  misc_feature (263)..(263): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacngaaacctggccaggctcccaggctcctcatctatgatgtctccaacagggtcactggcgtccccgcaggttcagtggcagtgggtctgggacagacttcactctcaccgtcagcagcctagagcctgaagtattttgcggttttactactgtcagcagtcgttccgcctggccgcttaacgttcggcgggggaccagggtggagagggagacgaacgtggtggctgcacgacgtctgtcttcacttccttcccgctactctcgtacatacg

SEQ ID NO: 23548 - DNA, 531 bp, Homo sapiens
  misc_feature: GYAE6OF02IKG8A.24.35.D02.1.454.CMB.1.raw
  modified_base (310)..(310): a, c, t, g, unknown or other
  misc_feature (310)..(310): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacngggtcactggcctccccgcaggttcagtggcagtgggctgggacagacttcactctcaccgtcagcagcctagagcctgaagtattttggcggttttactacttgtcagcagcgttccgcctcggccgctaacgtttcgggcgggggaccgagggtggagaggagacgaacgtgtggctgcacagtctgtcttcattccttcccgctactctagacatacg

SEQ ID NO: 23549 - DNA, 545 bp, Homo sapiens
  misc_feature: GYAE6OF02HK8HL.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacagggtcacgtggctccccgcaggttcagtggcaggtgggtctgggacagacttcactctcaccgtcagcagcctagcgcctgagtatttgcggtttactactgtcagcagtcgttccgcctcggccgcttaacgtttcgggcgggggaccgtaggggtcggagaggagacgaacgtggtcggctgcaccgagtcgtgttcttctacttccgttcccgccattcctagactagtacg

SEQ ID NO: 23550 - DNA, 519 bp, Homo sapiens
  misc_feature: GYAE6OF02IYFXZ.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccagccaccctgtctttgtctccaggggaangccaccctctcctgcagggccagtgacaatgttaggaagttgttagcctggtatcaacacaaacatggccaggcctccccggctcctcatctatgatgcatccaatagggccacgtggcatccccagacaggttcaggtggcagtgggtctgggacagacttcactctcacatcagcagtgtagagcctaggaagtattttgacttagtttattacttgtcagcaccgtgacacgtcgccctacgtttccgcccgtgggaccagactgaccatccaacgtacgtgtcggctgccacatctgtcttcacttcctcccg

SEQ ID NO: 23551 - DNA, 536 bp, Homo sapiens
  misc_feature: GYAE6OF02GPDV6.24.35.D02.1.454.CMB.1.raw
  modified_base (372)..(372): a, c, t, g, unknown or other
  misc_feature (372)..(372): n is a, c, g, or t
  modified_base (496)..(496): a, c, t, g, unknown or other
  misc_feature (496)..(496): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctccaggctcctcatctatgatgtctccaacaggtcactggcgtccccgcaggttcagtggcagtgggtctgggacagacttcactctcaccgtnagcagcctagagcctgaagtattttgcggtttactactgtcagcagcgttccgcctggcccgtctaacgtttcgggcgggggaccaggggtcggaggaggagacgaacgtggtaggctgcacgngtctgtcttcacttccttcccgctatcctagactagtacg

SEQ ID NO: 23552 - DNA, 527 bp, Homo sapiens
  misc_feature: GYAE6OF02FVQC5.24.35.D02.1.454.CMB.1.raw
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagatttcactctcaccatcagcggcctccagtctgaagtatttgctactttattctgtcaacactatggtgactggccttccgtactacgttttggcctaggggaccaaacgtggaagactacaacgaactggtggctgcaccatctgttccttcacttccttcccgtcc

SEQ ID NO: 23553 - DNA, 530 bp, Homo sapiens
  misc_feature: GYAE6OF02JJ078.24.35.D02.1.454.CMB.1.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
tcagactactatgtcacgaccggtgctcgatttagcacacgatagttgggtttgggggaggaactgctcagttaggacccagagggaaccatggaagacccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacagggtcactggcgtccccgcaggttcagtggcagtgggtctgggacngacttcactctcaccgtcagcagccctagagcctgaagtattttgcggtttactactgtcagcagtcgttccgctggccgcttaacgtttcgggcgggggaccaggggtggaggaggagacgaacgtggtggctgcacatcgtgtcttcatccttcccgcatctgactagtacg

SEQ ID NO: 23554 - DNA, 533 bp, Homo sapiens
  misc_feature: GYAE6OF02HC0CQ.24.35.D02.1.454.CMB.1.raw
  modified_base (201)..(201): a, c, t, g, unknown or other
  misc_feature (201)..(201): n is a, c, g, or t
  modified_base (528)..(528): a, c, t, g, unknown or other
  misc_feature (528)..(528): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacagggtcactggcctccccgcaggttcagtggcagtgggtctgggacagacttcactctcaccgtcagcagcctagagcctgaagtattttgcggtttactactgtcagcagcgttcgcctggccgctaacctttcgggcggggaccgagggtggagagggagacgaacgtggtggctggcaccagtctgtcttcattccttcccgcctatctacgactntaacg

SEQ ID NO: 23555 - DNA, 580 bp, Homo sapiens
  misc_feature: GYAE6OF02HSQ0H.24.35.D02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctntcctgcagggccagccggagtgttagtaagtacttaggctggtaccaacagaaacctggccaggctcccaggctcctcatctatgatgtctccaacagggtcactggcgtccccgcaggttcagtggcaggtggtctgggacagacttcacttctcaccgtcagcagcctagcgcctgaagtattttgcgtttactacttgtcagcagtcgttccgcctcggccgtcttacgtttccgggcgggggtaccgaggggtggaggagggacgaacggtaacgtggtcgggctcggacaccgtacgtcgttacgttccttcgtaacttcccgtttccccggcctacgttccgtacggtaactagttaacgg

SEQ ID NO: 23556 - DNA, 648 bp, Homo sapiens
  misc_feature: GYAE6OF02J3NQN.24.35.D02.1.454.CMB.1.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
  modified_base (397)..(397): a, c, t, g, unknown or other
  misc_feature (397)..(397): n is a, c, g, or t
  modified_base (421)..(421): a, c, t, g, unknown or other
  misc_feature (421)..(421): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccgagggganagacgcccaccctctcctgccagggccagccggagttgttagtaagtcttaggctggtaccaanacgaaacctggccaggcctcccgaggctcctcatctatgatcgtcctaccaaacgtagggtccacgtcggccgtccccgctaggttcaggtcggaagttcgggtctgggacagtacttcactctcgaccgtnacgcagcctagcgtcctagaagtntttgcgtttactactgtcagctagtccgttccgcgtcggacccgtcgttaaccggttccggggaccgggggtaacgtaggggtacggaacggtaacgggaacggtaaccggtaacgttcggtacgggtcgttcgacccgtaccgtacgttccgttacgttccttaccgtaaccgtttcccgttacccgaccttacgtccgtaacgtaaccgtagttacggttaacgg

SEQ ID NO: 23557 - DNA, 557 bp, Homo sapiens
  misc_feature: GYAE6OF02FIAAP.24.35.D02.1.454.CMB.1.raw
  modified_base (264)..(264): a, c, t, g, unknown or other
  misc_feature (264)..(264): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaacccaanagaaacctggccaggctcccaggctcctcatctatgatgtctccaacagggtcactggccgtccccgcaggttcagtggcaggtgggtctgggacagacttcactctcaccgtcagcagcctagacgcctgaagtattttggcggttttactactgtcagcagtccgttccgccgtcggccgtcttaacgtttccgggcggggggaccgagggggttgggaggagggacggacgaacgtggtggctggcaccagtctgtcttcattccttcccgcctatctagactattacgg

SEQ ID NO: 23558 - DNA, 515 bp, Homo sapiens
  misc_feature: GYAE6OF02H8GFH.24.35.D02.1.454.CMB.1.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
  modified_base (465)..(465): a, c, t, g, unknown or other
  misc_feature (465)..(465): n is a, c, g, or t
  modified_base (511)..(511): a, c, t, g, unknown or other
  misc_feature (511)..(511): n is a, c, g, or t
tcagactactatgtcacgaccggtgctcgatttagcacacgatagttgggtttgggggaggaactgctcagttaggactcagagggaaccatggaagccccagctcagcttctcttcctcctgctactctggctcccagagaccactggagaaattgtgttgacacagtctccaggcaccctgtctttgtctccagggganagagccaccctctcctgcagggccagccggagtgttagtaagtacttaggctggtaccaacagaaacctggccaggcctcccaggcctcctcatctatgatgtctccaacngggtcactggcctcccgcaggttcagtggcagtggtctgggacagactttcactctcaccgtcagcagccctagagcctgaagtattttgcggtttactactgtcagcagtcgttcgcctgccgctacgttcggcggggcagggtggagaggngacgaactgtggctgcgacatctgtcttcatccttcccgcactctntaac

SEQ ID NO: 23559 - DNA, 524 bp, Homo sapiens
  misc_feature: GYAE6OF02I927E.24.35.D02.1.454.CMB.1.raw
  modified_base (310)..(310): a, c, t, g, unknown or other
  misc_feature (310)..(310): n is a, c, g, or t
  modified_base (374)..(374): a, c, t, g, unknown or other
  misc_feature (374)..(374): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacngggtcactggcgtccccgcaggttcagtggcagtgggtctgggacagacttcactctcaccgtnagcagcctagacgcctgaagtattttgcggtttactacttgtcagcagcgttccgctggccgtctacgttcggcggggacagggtggagaggagacgactgtggctgcacatctgtcttcattccgtcccgctatccgtagactatacgg

SEQ ID NO: 23560 - DNA, 509 bp, Homo sapiens
  misc_feature: GYAE6OF02G3NPS.24.35.D02.1.454.CMB.1.raw
  modified_base (261)..(261): a, c, t, g, unknown or other
  misc_feature (261)..(261): n is a, c, g, or t
  modified_base (353)..(353): a, c, t, g, unknown or other
  misc_feature (353)..(353): n is a, c, g, or t
tcagactactatgtcacgaccggtgctcgatttagcacacgatagttgggtttggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaanagaaacctggccaggctcccaggctcctcatctatgatgtctccaacagggtcactggcgtcccgcaggttcagtggcagtggtctgggacngacttcactctcaccgtcagcagcctagagcctgagtatttgcggtttactactgtcagcagcgttcgcctggccgctaactttcggcggggaccagggtggagaggagacgaactgtgctgcacagtctgtctcatcttccgcatctgacatacg

SEQ ID NO: 23561 - DNA, 544 bp, Homo sapiens
  misc_feature: GYAE6OF02HCS2U.24.35.D02.1.454.CMB.1.raw
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
tcagactactatgtcacgaccggtgctcgatttagcacacgatagttgggtttgggggaggaactgcttagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggccgtccccgcaggttcagtgcaggtggtctgggacagacttcactctcaccgtcagcagcctagngcctgaagtnttttgcggttttactactgtcagcagcgttccgctggccgctaacgttcgggcgggggaccaggggtggaggaggagacgaacgtggtggctgccacgagtcgtgtccttcacttccgttcccgcctacttcgtacgaactatagtacg

SEQ ID NO: 23562 - DNA, 514 bp, Homo sapiens
  misc_feature: GYAE6OF02F7U2Y.24.35.D02.1.454.CMB.1.raw
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtgtccccagccaggttcgttggcggtgggtctgggacagatttcactctcaccatcagcggcctcagtctgaagattttgctactttattctgtctaacactatggtgactggcctcgtactacttttgcctaggggaccaaacgtggaagatacaacgaactgtggctgcaccatctgtcttcatcttccgcc

SEQ ID NO: 23563 - DNA, 535 bp, Homo sapiens
  misc_feature: GYAE6OF02HAJG9.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacagggtcactggccgtccccgcaggttcagtggcaggtggtctgggacagacttcactctcaccgtcagcagcctagacgcctgaagtattttgcggtttactactgtcagcagcgttccgcgtcggccgtctacgtttcgggcgggggaccgagggtggagaggagacgaacgtgtggctgcacgatcgtcgtcttcacttcgttcccgctatctacgactatacg

SEQ ID NO: 23564 - DNA, 536 bp, Homo sapiens
  misc_feature: GYAE6OF02I872P.24.35.D02.1.454.CMB.1.raw
  modified_base (201)..(201): a, c, t, g, unknown or other
  misc_feature (201)..(201): n is a, c, g, or t
  modified_base (485)..(485): a, c, t, g, unknown or other
  misc_feature (485)..(485): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacagggtcactggcgtccccgcaggttcagtggcagtgggtctgggacagacttcactctcaccgtcagcagcctagacgcctgaagtattttgcggtttactactgtcagcagtcgttccgcctggccgtctaacgtttcgggcgggggaccaggggtggagaggagacgaactggnggctgcacagtctgtcttcacttccgttcccgctatctacgaactattacg

SEQ ID NO: 23565 - DNA, 523 bp, Homo sapiens
  misc_feature: GYAE6OF02GULPX.24.35.D02.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacngggtcactggctccccgcaggttcagtggcaggtggtctgggacagacttcactctcaccgtnagcagcctagacgcctgaagtattttgcgtttactactgtcagcagcgttccgcctggccgtctacgtttcgggcgggggaccagggtggagaggagacgaacgtgtggctgcacgagtctgtctcactcttccgctactctagacatag

SEQ ID NO: 23566 - DNA, 533 bp, Homo sapiens
  misc_feature: GYAE6OF02G644Q.24.35.D02.1.454.CMB.1.raw
  modified_base (263)..(263): a, c, t, g, unknown or other
  misc_feature (263)..(263): n is a, c, g, or t
  modified_base (376)..(376): a, c, t, g, unknown or other
  misc_feature (376)..(376): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagcccaccctctcctgcagggccagccggagtgttagtaagtacttaggctggtaccaanagaaacctggccaggctcccaggctcctcatctatgatgtctccaacagggtcactggcgtccccgcaggttcagtggcaggtgggtctgggacagacttcactctcaccgtnagcagcctagagcctgaagtattttgcggtttactactgtcagcagcgttccgcctcggccgctaacgtttcgggcgggggaccagggtggagaggagacgacgtgtggctgcacgatcgtgttctcacttcgttcccgcctatcctgtaccatacg

SEQ ID NO: 23567 - DNA, 499 bp, Homo sapiens
  misc_feature: GYAE6OF02FI8OQ.24.35.D02.1.454.CMB.1.raw
  modified_base (424)..(424): a, c, t, g, unknown or other
  misc_feature (424)..(424): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggaaagagccaccctctcctgcagggccagtgacaatgttaggaagttgttagcctggtatcaacacaaacatggccaggctccccggctcctcatctatgatgcatccaataggccactggcatcccagacaggttcagtgcagtgggtctgggacagacttcactctcaccatcagcagtgtagagcctgaagtattttgctagtttattactgtcagcaccgtnacaactggccctactttcggcctgggaccagactgacatccaacgactgngctgccacntctgtctcntctcccg

SEQ ID NO: 23568 - DNA, 562 bp, Homo sapiens
  misc_feature: GYAE6OF02HEANN.24.35.D02.1.454.CMB.1.raw
  modified_base (198)..(198): a, c, t, g, unknown or other
  misc_feature (198)..(198): n is a, c, g, or t
  modified_base (323)..(323): a, c, t, g, unknown or other
  misc_feature (323)..(323): n is a, c, g, or t
tcagactactatgtcacgaccggtgctcgatttagcacacgatagttgggtttggggaggaactgctcagttaggacccagagggaaccatggaagccccagctcagcttctcttcctcctgctactctggctcccagagaccaccggagaaattgtgttgacacagtctccaggcacctgtctttgctccagggganagagccaccctctcctgcagggccagccggagtgttagtaagtacttaggctggtaaccaacgaggaaacctgggaccagggcctccccgaggcctcctcatcctaagtgattcgtcctccaagngggtccacgtcggccgtccccgctaggttccaggtggctaggtcgggtctgggacaggaccttcgacttcgtacaacctatccagcagttgtagacgctgaagtattttgctagtttattacgtgtacagcacgtgacacgtcgcctacgtttcggcccgtgggacctagacgtggacacgtaccaacgtactgtcgctcgcacctatctgtcttctacttccttcccgctactctacg

SEQ ID NO: 23569 - DNA, 518 bp, Homo sapiens
  misc_feature: GYAE6OF02GQNPF.24.35.D02.1.454.CMB.1.raw
  modified_base (310)..(310): a, c, t, g, unknown or other
  misc_feature (310)..(310): n is a, c, g, or t
  modified_base (475)..(475): a, c, t, g, unknown or other
  misc_feature (475)..(475): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagcccaccctctcctgcagggccagccggagtgttagtaagtacttaggctggtaccaacagaaacctggccaggctcccaggctcctcatctatgatgtctccaanggtcactggctcccgcaggttcagtgcagtggtctggacagacttcactctcaccgtcagcagcctagacgcctgaagtattttgcggtttactactgtcagcagtcgttccgcctgccgcttaacgttcgggcggggaccagggtggagaggagacgaacgtgngctgcacagtctgtcttcacttctcccgcctatctgacatacg

SEQ ID NO: 23570 - DNA, 533 bp, Homo sapiens
  misc_feature: GYAE6OF02HFT28.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggccgtccccgcaggttcagtggcagtgggtctgggacagacttcactctcaccgtcagcagcctagacgcctgaagtattttgcggtttactactgtcagcagtcgttccgcctggccgcttacgtttcgggcgggggaccgaggggtggagagggagacgaacgtggtggctgcacagtctgtcttcactcttcccgctatctagactatacg

SEQ ID NO: 23571 - DNA, 527 bp, Homo sapiens
  misc_feature: GYAE6OF02GUJMK.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (523)..(523): a, c, t, g, unknown or other
  misc_feature (523)..(523): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggctccaggctcctnatctatgatgtctcaacngggtcacgtggcctccccgctaggttcagtgcaggtgggtctggacagacttcactcncaccgtnagcagcctagacgcctgaagtnttttgcgtttactactgtcagcagtcgttccgctcggccgtcttaacgtttcgggcggggaccgagggtggagaggagacgaacgtgtgctgcacagtctgtcttcacttcctcccgctatctgactntacg

SEQ ID NO: 23572 - DNA, 545 bp, Homo sapiens
  misc_feature: GYAE6OF02FV14Y.24.35.D02.1.454.CMB.1.raw
  modified_base (308)..(308): a, c, t, g, unknown or other
  misc_feature (308)..(308): n is a, c, g, or t
tcagactactatgtcacgaccggtgctcgatttagcacacgatagttgggtttggggaggaactgctcagttaggacccagaggaaccatggaagccccagctcagcttctcttcctcctgctactctggctcccagagaccaccggagaaattgtgttgacacagtctccaggcaccctgtctttgtctccaggggagagagccacctctcctgcagggccagccggagtgttagtaagtacttaggctggtaccaacagaaacctggccaggctcccaggcctcctcatctatgatgtctccaacnggtcactggcgtccccgcaggttcagtgcagtggtctggacagacttcactctcaccgtcagcaggcctagacgccctgaagtattttgcggttttactactgtcacgcagtccgttccgccgttcggcccgtcgttaaccgtttccgggcgggggtacccgaggggtggaggaggagacgaacgtgtggctgcacagtctgtctcgacttccttcccgctactctacgtacatacg

SEQ ID NO: 23573 - DNA, 548 bp, Homo sapiens
  misc_feature: GYAE6OF02FR1VP.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggcgtccccgcaggttcagtggcagtgggtctgggacagacttcactctcaccgtcagcagcctagagcctgaagtattttgcggttttactactgtcagcagtcgttccgccgtggcccgtcttaacgtttcgggcgggggtaccgaggggtggagagggagacgaacgtggtggctgcacgagtcgtgttccttcacttccgttcccgcctactctcgaactagtacg

SEQ ID NO: 23574 - DNA, 671 bp, Homo sapiens
  misc_feature: GYAE6OF02JR8K0.24.35.D02.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (259)..(259): a, c, t, g, unknown or other
  misc_feature (259)..(259): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccagggganagagccaccctntcctgcagggccagccggagtgttagaagtcttaggctggaccaacngaaacctggccaggctccaggcctcctcatctangatgtccnccaacgngggtccatcggcctaccccgctaggttcagtggcaggtcgggtctagggacagtacttcacgtctacgaccgtcacgtcaacggccctaagggacgtcccgtaggaaacgtagttttcggtaccggttttaacttacgttgtacgagtctacggtccgttccgccgttcggacccgtaccgttaacggtttccggggacggggggtaccgtacggggtacggtaacggtacgttaccgaaaacgggtacgtacggttacggtaccgtacgaccgtaaccgttacgttccggttacgttccttaccgtaacgttcccgttaccccgtacgttaccgttaccgtacggtaacctagtttaaccgg

SEQ ID NO: 23575 - DNA, 607 bp, Homo sapiens
  misc_feature: GYAE6OF02HSSRO.24.35.D02.1.454.CMB.1.raw
  modified_base (200)..(200): a, c, t, g, unknown or other
  misc_feature (200)..(200): n is a, c, g, or t
  modified_base (310)..(310): a, c, t, g, unknown or other
  misc_feature (310)..(310): n is a, c, g, or t
  modified_base (380)..(380): a, c, t, g, unknown or other
  misc_feature (380)..(380): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggcctcctcatctatgatgtctccaacngggtcacgtggccgtccccgctaggttcagtggctaggtgggtctgggacaggacttcactctcaccgtnagcagcctaagcgcctagaagtattttgcggttttaactacgtgtcagctagtccgttccgccgtcggcccgtacgtaaccgtttccggggacgggggtaccgaggggttcgggaaggacgggacgaacggtaacgtggtcggtcgtacgacctaccgtagtcttacgttctttacctacgttcccttccccggtacctacgttccgtaacggtacctagttaacgg

SEQ ID NO: 23576 - DNA, 529 bp, Homo sapiens
  misc_feature: GYAE6OF02HFZYT.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggctcccaggctcctcatctatgatgtcctccaacngggtcacgtggccgtccccgcaggttcagtggcaggtgggtctgggacagacttcactctcaccgtnagcagtgtagngcctgagtatttgctagtttattactgtcagcaccgtgacacgtcgccctacgttcggcccgtgggaccagtactggactactccaacgaactgtcggctgcactatctgtcttcacttccttcccgctactctagtaac

SEQ ID NO: 23577 - DNA, 535 bp, Homo sapiens
  misc_feature: GYAE6OF02GKXNF.24.35.D02.1.454.CMB.1.raw
  modified_base (374)..(374): a, c, t, g, unknown or other
  misc_feature (374)..(374): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggctccccgcaggttcagtggcaggtgggtctgggacagacttcactctcaccgtnagcagcctagagcctgaagtattttgcggtttactactgtcagcagcgttccgcctggccgtctacgtttcgggcgggggaccaggggtggagagggagacgaacgtggtggcgtgcaccagtctgtcttcacttcttcccgcctactctacgactatacg

SEQ ID NO: 23578 - DNA, 220 bp, Homo sapiens; identical to SEQ ID NO: 23545
  misc_feature: GYAE6OF02I5QU0.24.35.D02.1.454.CMB.1.raw
  modified_base (218)..(220): a, c, t, g, unknown or other
  misc_feature (218)..(220): n is a, c, g, or t

SEQ ID NO: 23579 - DNA, 515 bp, Homo sapiens
  misc_feature: GYAE6OF02HFG09.24.35.D02.1.454.CMB.1.raw
  modified_base (494)..(494): a, c, t, g, unknown or other
  misc_feature (494)..(494): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggctccccgcaggttcagtggcagtgggtctgggacagacttcactctcaccgtcagcagcctagagcctgaagattttgcggtttactactgtcagcagcgttccgcctggccgctaactttcgggcgggggaccagggtggagaggagacgaactgtgctgcacatctgtcttnatcttccgcatctgacatacg

SEQ ID NO: 23580 - DNA, 244 bp, Homo sapiens
  misc_feature: GYAE6OF02GNN4W.24.35.D02.1.454.CMB.1.raw
  modified_base (242)..(244): a, c, t, g, unknown or other
  misc_feature (242)..(244): n is a, c, g, or t
tcagactactatgtcacgaccggtgctcgatttagcacacgatagttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctgcctggtcaaggactacttccacatagtagtctgagcgggctggcaaggcgcatagnnn

SEQ ID NO: 23581 - DNA, 593 bp, Homo sapiens
  misc_feature: GYAE6OF02I8ENH.24.35.D02.1.454.CMB.1.raw
  modified_base (288)..(288): a, c, t, g, unknown or other
  misc_feature (288)..(288): n is a, c, g, or t
  modified_base (386)..(386): a, c, t, g, unknown or other
  misc_feature (386)..(386): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacgcagtctccaggcaccctgtctttgtctccaggggagagagccaccctctcctgcagggccagtcagagtgttagcagcagctacttagcctggtaccagcagaacctggccaggctccccggntcctcatctatgatgccatccaaatacgggccacgtggcctactccccagtacaggttcaggtcggctaggtgggtctagggacagtacttcacgtcncgacatcagcgtagtagtagacgtcctagaacgtattttcgcttagtttacttactgttacagtctaccgtagacgtaaccgtcggtaccctaaccgtttccggacccgtcgggaacccgtacgtaccgtcggaaccgtaccgtaaccgtaaaccgtaaccgttgtaccggtaccgttcgaccctaccgtaacttcgttacgttccg

SEQ ID NO: 23582 - DNA, 513 bp, Homo sapiens
  misc_feature: GYAE6OF02IA0UI.24.35.D02.1.454.CMB.1.raw
  modified_base (201)..(201): a, c, t, g, unknown or other
  misc_feature (201)..(201): n is a, c, g, or t
  modified_base (408)..(408): a, c, t, g, unknown or other
  misc_feature (408)..(408): n is a, c, g, or t
  modified_base (478)..(478): a, c, t, g, unknown or other
  misc_feature (478)..(478): n is a, c, g, or t
tcagactactatgtcacgaccggtgctcgatttagcacacgatagttgggtttgggggaggaactgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggctcctcatctatggtgcgtccaccgaggccactggcgtcgcggacaggttcagtggcagtggctttggacagacttcactctcatcatcgacagactggacgccgaagtatttgctagtnttattactgtcagtcttgtttcgtcccttctcctcctatgtactctttggcctagggttccaggtctggngtatacaacgcgtaacgtgtcggctgctaccatcg

SEQ ID NO: 23583 - DNA, 529 bp, Homo sapiens
  misc_feature: GYAE6OF02GJ2G6.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggctcccaggctcctcatctatgatgtctccaacagggtcactggcgtccccgcaggttcagtggcagtggtctgggacagacttcactctcaccgtcagcagccctagacgcctgaagtattttgcggtttactactgtcagcagcgttccgcctggccgctaacgtttcgggcgggggtaccagggtggagaggagacgaacgtggtggctgcacatctgtcttcacttcttcccgcctatctgactatacg

SEQ ID NO: 23584 - DNA, 611 bp, Homo sapiens
  misc_feature: GYAE6OF02HAVNF.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatcgctgtctccaccgacgggcccctggtcgtcccacggcctaggttcgttggcggttgggtctggggactaggtactttcacttctcacctatcgacgcggccctccacgtcctaggtaacgtattttgcttactttattcttagtactaactacttagtggtctacgtcggtccttccgttaactacgttttcgggaccgtacgggggtaacctaaacggtaggaacgtactaaccgaacggtaactgggtacggtaccgtacggccaaccgtacttccgttacgttcctttactacgttcccttcccgtaccc

SEQ ID NO: 23585 - DNA, 514 bp, Homo sapiens
  misc_feature: GYAE6OF02I5VDX.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgcatccaatagggccactggcatcccagacaggttcagtggcagtggtctgggacagacttcactctcaccatcagcagtgtagagcctgagtatttgctagtttatactgtcagcaccgtgaccacgtcgccctacgtttccggcccgtcgggaccagactggacactaccacgactggtcggctgcaccatctcgtcttcacttcctcccgc

SEQ ID NO: 23586 - DNA, 635 bp, Homo sapiens
  misc_feature: GYAE6OF02G4E6A.24.35.D02.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcagggccagccggagtgttagaagtacttaggctggtaccaanacgaacctggccaggcctcccaggcctcctcatctatgatgtctaccaacgagggtcacgtggccgtccccgctagggttccaggtcggcaggtcgggtcgtgggacaggacttcgactctcaccgtnagccagcctagacgcctagaagtnttttgcgtttactactgtcagtcgacgtccgttccgccgtcggcccgtacgttaacggtttccggggcgggggtaccgtagggggttaggaggacgggaacggacgtaacgttggtacgggtctcggacctaccgtacgttccgttacggttccttaccgtaccgtttcccgtttcccccggaccttaacgttcccgttacggtaaccttagttaacgg

SEQ ID NO: 23587 - DNA, 597 bp, Homo sapiens
  misc_feature: GYAE6OF02IVLRH.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggcctcccaggcctcctcatctatgatgtctccaacgagggtccacgtggccgtccccgctaggttcagtggcaggtgggtctgggacagtcttcactctacaccgtcagcagcctagcgcctagacgtattttgacgtttactacgtgtcagctagtcgttccgccgtggcccgtacgttaaccgtttcggggaccgggggtaccttggggtcggagagggacgtaccggtaacgtggtacggtcgtacgaccaccgtacgttccgtggttccttcgtacttccgttacccgcctacgttccgtacgtaacctagttacgg

SEQ ID NO: 23588 - DNA, 533 bp, Homo sapiens
  misc_feature: GYAE6OF02IOLEO.24.35.D02.1.454.CMB.1.raw
  modified_base (201)..(201): a, c, t, g, unknown or other
  misc_feature (201)..(201): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacagggtcacgtggcgtccccgcaggttcagtggcagtgggctgggacagacttcactctcaccgtnagcagcctagngcctgaagtattttgacggtttactactgtcagcagcgttccgctggccacgtaacgtttcgggcgggggaccagggtcggagaggagacgaacgtgtggctgcaccatcgtgtcttcacttcttcccgctagtctagacattaacgg

SEQ ID NO: 23589 - DNA, 625 bp, Homo sapiens
  misc_feature: GYAE6OF02JV91K.24.35.D02.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (358)..(358): a, c, t, g, unknown or other
  misc_feature (358)..(358): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcagggccagccggagtgttagtaagtacttaggctggtaccaanagaaacctggccaggctcccaggctcctcatctagtggtgccgtccaccgaggccacgtggcgtcgcggacaggttcaggtggcaggtcgggtcngggacaggagttcactctacaccatcagcagtctgacctaacctgaaacgtctttagactaaactttactagttcgactaaacgagtaacgtttaccaaccggtttccccgtactacccggttcgggacgggtaacgggaaccgtaagggtcgggaacgtactaccgaacgaaccggtaacgttggtacggtcgtaggacccgtaactaattccgttacgttccttaccgacgtttcccgttacccgactacgttccgtacggtaac

SEQ ID NO: 23590 - DNA, 551 bp, Homo sapiens
  misc_feature: GYAE6OF02IL5F6.24.35.D02.1.454.CMB.1.raw
  modified_base (311)..(311): a, c, t, g, unknown or other
  misc_feature (311)..(311): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacgngggtcacgtggccgtcccccgcaggttccagtggcaggtggtctgggacagacttcactctcaccgtcagcagcctagacgcctgaagtatttgcgtttactactgtcagcagtcgttccgctggccgtctacgttcgggcgggggaccaggggtggaggaggagacggaactggtacggcgtgcaccgtatcgttcgttcttcacttccgttccccgcctactccgtagtactagtacg

SEQ ID NO: 23591 - DNA, 760 bp, Homo sapiens
  misc_feature: GYAE6OF02JMCX5.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccaccctctcctgcgagggccagccggagtgttagtaagtacttaggctaggtaccaacagaaacctggccaggcctcccgaggcctcctacatcctatgattcgtcctaccgaacgtacgggtcaacgtcgggccgtcccccgcgtacgggtttccaggtcggaccgtagggtcgggttcgtaggggaacctaggttactttccgaaccgtttctacccaacctaagtccgaacggtcccggtacccttacccgaaggtttcccgtaaggtaaacgtttacgttttcgtacctttaacttttactttacgttacgttaacctaactacgttagttacggttacgtaccgttcggtacccttaccgttacgtttaccgttttcgggaccgtaacggggtaaccctaaacggtcgggtaacgtaacgttaaaccgtaaacggtaacgttacggtacggtacgttaccggaccgttaaccgtacgtttccgttacgtttacctttaccgtaccgtttaccccgtttaccccggtaccttacgttacccgtaacg

SEQ ID NO: 23592 - DNA, 647 bp, Homo sapiens
  misc_feature: GYAE6OF02HI771.24.35.D02.1.454.CMB.1.raw
tcagactactatgtcacgaccggtgctcgatttagcacacgatagttgggtttgggggagggaactgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcaagaacctggcctcggctccagcctcctcatctagtggtcgccgtccaccgaggccacgtggccgtcgcgacgtgttcaggtcgcgagtggtcgtttggacagtacttcacttctacatctaactcgtacagtaccgtagggaccgtacccggtaaagttacgttttcgacgtaggttacggtttaactttacgtagttccgaagttcgttacggtttttccggtcccctttccgttacccttaccgttagtttaccgttaacctttacggtttttccgggaccgttaacggggtttcccgaacggttcggtagggtaacgtacgttacgaaacggtaccgtaacgttcggtcggttaccgtggaccctaccgtattaccg

SEQ ID NO: 23593 - DNA, 513 bp, Homo sapiens
  misc_feature: GYAE6OF02IRBXW.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggctccccggctcctcatctatgatgcatccaatagggccatggcatcccagacaggttcagtggcagtgggtctgggacagacttcactctcaccatcagcagtgtagagcctgaagtattttgctagtttattactgtcagtcacgtgacaactcggccctacgtttcggccctgggacctagactaggacactaccgaacgtaactggtacgctgccacctatctcgtcttctac

SEQ ID NO: 23594 - DNA, 527 bp, Homo sapiens
  misc_feature: GYAE6OF02H04YV.24.35.D02.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctccaggctcctnatctatgatgtctcaacngggtcactggcctccccgctaggttcagtggcaggtggtctggacngacttcactctcacgtcagcagcctagacgctagaagtattttgtcgtttactacttgtcagcagtcgttccgctggcctctaacgtttcgggcggggacagggtggagaggagacgacgtgngctgcacngtctgtcttacacttccgttcccgctactctagactagtacg

SEQ ID NO: 23595 - DNA, 606 bp, Homo sapiens
  misc_feature: GYAE6OF02HAWUO.24.35.D02.1.454.CMB.1.raw
  modified_base (200)..(200): a, c, t, g, unknown or other
  misc_feature (200)..(200): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccagggganagagccaccctctcctgcagggccagccggagtgttagaagtacttaggctggtaccaacagaaacctggccaggctccaggctcctcatctatgatgtcctccaacgagggtcacgtcggccgtccccgccgtacggttcaggtggcgtaggtcgggtcgtaaaaagggcagtacttcactctcaccgtcacgcacgcctagacgccgtagaagtattttggtcggtttactactgtacagcacgtccgttccgccgtcggcccgtacgttaaccggtttccgggcgggggtaccgtaggggtcggaggagggacggtacggaacgtggtcggtcgtcgacgaccgtagttcgttcgttccttcgtacgttccgttcccgcctacttcctacgtaactagtacgg

SEQ ID NO: 23596 - DNA, 541 bp, Homo sapiens
  misc_feature: GYAE6OF02I8XCF.24.35.D02.1.454.CMB.1.raw
  modified_base (233)..(233): a, c, t, g, unknown or other
  misc_feature (233)..(233): n is a, c, g, or t
  modified_base (499)..(499): a, c, t, g, unknown or other
  misc_feature (499)..(499): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacgcagtctccaggcaccctgtctttgtctccaggggagagagccaccctctcctgcagggccagtcgagngtgtagctagcagctaactagacctggaccagcacgaacgtgcctgctcccaggtctcctcactccgaatggtcgcgtcgaccgaccgggccacgtgcgtcgcgacgtaggtcaggtcgcgagtcgtactttcggacacgtctagactctctatcatcgactagtacgtcgtacgaccgtagtcttgctagtacgttacgtacgtcgtcgacgtacgttcggttcggtccttcgtcgtcgtagtacgtacgtctttggcgtagtcncgtctgtctctcgagtcgtactcgtcgtcgtcgactacatcg

SEQ ID NO: 23597 - DNA, 554 bp, Homo sapiens
  misc_feature: GYAE6OF02HEQZR.24.35.D02.1.454.CMB.1.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgactacagtctccaggcaccctgtctttgtctccgagggganagagccacctctcctggcagggccagccggagtgttagtaagtacttaggctggtaccaacagaaacctggccaggctcccaggtcctcctcatctatgatgtctccaacgnggtcacgtggccgtccccgacaggttcagtggacagtggtctggacagtacttcactctacacgtcagcagcctagacgaccgtgtaagtacgttttgtcgtttaactacttgtctagacagtcgttccgcgtcggccgtactacgttcgggcggggacagggtgagaggagacgacgtgtcgctgctacgagtcgtgtactactagtccgttcccgctacttcgtagtactagtaacg

SEQ ID NO: 23598 - DNA, 617 bp, Homo sapiens
  misc_feature: GYAE6OF02JI5LJ.24.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (457)..(457): a, c, t, g, unknown or other
  misc_feature (457)..(457): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggcaccctgtctttgctccagggganagagccaccctctcctgcagggccagccggagtgttagaagtacttaggctggtaccaanagaaacctggccaggctcccaggctcctcatctatgatgtctccaacagggtcactggccgttccccgcacggttcagtcggcaggtgggtcctgggacaggtacttcacgtctcgaccgtcagccagccctagacgcctgaacgtagttttcgaccggttttactaccgttgtaccgaggtccagtccggttccncccgtggcccgtcttaaccgtttcgggccgggggtaccaggggttcggaagggagggtaacgaaccgtaggtggacggtgtaccgaccgacctagttcccgttgttcttacgacccgtttcccgtacccctacgtccttacgtacgtactagtttaacgg

SEQ ID NO: 23599 - DNA, 719 bp, Homo sapiens
  misc_feature: GYAE6OF02GF23J.24.35.D02.1.454.CMB.1.raw
tcagactactatgtcacgaccggtgctcgatttagcacacgataggttgggtttgggggaggaactgctcagttaggacccagagggaaccatggaagccccagctcacgcttctcttcctcctgctactctggctccagagaccaccggagaaattgtgttgacacagtctccaggcacctgtctttgtctcgaggggagagagccacctctcctgcgacgggccagccggagtgttagtaagtacttaggctggtaccaacacgaaacctggccaggctcccaggcctcctcagtctatcgatcgtctaccaacgtaggtcacgtgggccgtccccggctaggttcaggtggcaggtgggtctgggacaggtccttcactctcgaccgtcgacgcacgcctagacgtcctaggaagtatttttcgggccggttttaactacgttgtacctaggctacggttccggtttcccgccgttcgggaccccgttacgtttaaacccggttttcgggggggacccgggggggtaccgtaacggggggttcgggtaaacggggtaacggggtaacggtaaaccgggtaaaccgttggggttaccgggaccgttacgggaccgtaaaccccgtaggtttcccggttaggttttacccctttacggtaaccctttcccgtttacccggtaccttaccgttaccctaccgaaacgtacgtttaacgg

SEQ ID NO: 23600 - DNA, 526 bp, Homo sapiens
  misc_feature: GYAE6OF02HZ69O.24.35.D02.1.454.CMB.1.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
  modified_base (474)..(474): a, c, t, g, unknown or other
  misc_feature (474)..(474): n is a, c, g, or t
  modified_base (487)..(487): a, c, t, g, unknown or other
  misc_feature (487)..(487): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctcaggcaccctgtctttgtctccgagggganagagccacctctcctgcagggccagccggagtgttagtaagtacttaggctggtaccaacagaaacctggccaggctcccaggctctcatctatgatgtctccaacgngggtcacgtggccgtccccgcaggttccagttggcagtgggtctgggacagacttcacttctcaccgtcagcagcctagagcctagaagtattttgacgtttactagtgtcagcagtccgttcgctcggccgcgtaacgtttcgggcgggggaccgagggtggagnggagacgaagtgngctgcaccatctgtctcactctccgctatctgacatacg

SEQ ID NO: 23601 - DNA, 562 bp, Homo sapiens
  misc_feature: GYAE6OF02IM846.24.35.D02.1.454.CMB.1.raw
  modified_base (201)..(201): a, c, t, g, unknown or other
  misc_feature (201)..(201): n is a, c, g, or t
  modified_base (355)..(355): a, c, t, g, unknown or other
  misc_feature (355)..(355): n is a, c, g, or t
  modified_base (380)..(380): a, c, t, g, unknown or other
  misc_feature (380)..(380): n is a, c, g, or t
  modified_base (505)..(505): a, c, t, g, unknown or other
  misc_feature (505)..(505): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtcttaggctggtaccaacagaaacctggccaggcctcccaggctcctcatctatgatgtctaccaacagggtcactggccgtccccgcaggttcaggtggctaggtgggtcngggacagtacttcactctcaccgtnagcagcctagcgcctgaagtattttgcgttttacactgtacagcagtccgttccgcgtcggcctcgtaacgtttcggggcgggggtaccgggtggacgaggagacgaacgtggtgcgtcgcaccngttccgtgttaccttcactttcccgttaccgcctagtcctagaacctagttagtacg

SEQ ID NO: 23602 - DNA, 540 bp, Homo sapiens
  misc_feature: GYAE6OF02JDLLS.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagcagcagctacttagcctggtaccagcagaaacctggcctggctcccaggctcctcatctatggtgccgtccaccgagggccacgtggcgtcgcggacaggttcaggtggcaggtcggctttggggacagacttcactctcatcatcgacagacgtggacgaccgtaagtatttgctagttgtaagttactgtcagtcttgtttcgtccctctcctctatcgttactcgtttcgccgtaggttccgaggtcgtggacgtagtacgacggcgtacgtggtcggtctacgctacgactcgttcg

SEQ ID NO: 23603 - DNA, 542 bp, Homo sapiens
  misc_feature: GYAE6OF02ICFGZ.24.35.D02.1.454.CMB.1.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
  modified_base (504)..(504): a, c, t, g, unknown or other
  misc_feature (504)..(504): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtcctccaacngggtccacgtggccgtccccgcaggttcagtggcaggtgggtctgggacagtacttcactctcaccgtcagcagcctagcgcctgaagtatttgcggtttactactgtcagcagtccgttccgccgtcggccgtcttaacgtttcgggcgggggtaccgaggggtggagaggagacgaacgtgtggctgcacngtctgtcttcacttccttcccgcctatctagacatacg

SEQ ID NO: 23604 - DNA, 691 bp, Homo sapiens
  misc_feature: GYAE6OF02J2IQT.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanacgaaacctggccaggcctcccaggctccgtcatctatgatgtctccaacgaggtccacgtcggccgtccccgcgtacggttcacggtcggactaggtcgggtctgggaccaggtaccttcgacttcctacgaccgttcgaagcctagtccctaaggaccgtccgtaggtaagttacgtttttgaccgggtttttactacgttcggttacaaggtctacggtccgtttccggccgttacggacccgtacgttaaccgggtttcggggaccgggggtaccggaaggggttccggagggtaacgggacggaaccggtaacgttcggggtacgtacgttacggccgtaaccgtcggtttaccgttcgttacgtttacccgacgtttccccttcccggtacctacgttccgtaacgtaacgtacgttaaccgg

SEQ ID NO: 23605 - DNA, 579 bp, Homo sapiens
  misc_feature: GYAE6OF02IXXGK.24.35.D02.1.454.CMB.1.raw
  modified_base (262)..(262): a, c, t, g, unknown or other
  misc_feature (262)..(262): n is a, c, g, or t
  modified_base (550)..(550): a, c, t, g, unknown or other
  misc_feature (550)..(550): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccacccctctcctgcagggccagccggagtgttagtaagtcttaggctggtaccaanagaaacctggccaggctcccgaggcctcctcatctatgatgtctccaacgagggtcacgtcggccgtcccccgccgaggttcagtggcaggtgggtctgggacagtacttcactctcaccgtcagcacgcctagcgccgtagaagtagttttgcggttttactacttgtcagtccacgtcgttccgccgttcggcccgtcgttaaccggtttccggggccggggggtaccgtagggggtggaggagggacggaacgtaacgtggtaggcgtgcactagtctgtcttcncgttcctccgctactcgtacgactatacg

SEQ ID NO: 23606 - DNA, 536 bp, Homo sapiens
  misc_feature: GYAE6OF02F3NUT.24.35.D02.1.454.CMB.1.raw
  modified_base (311)..(311): a, c, t, g, unknown or other
  misc_feature (311)..(311): n is a, c, g, or t
  modified_base (532)..(532): a, c, t, g, unknown or other
  misc_feature (532)..(532): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtacccaacagaaacctggccaggctcccaggctcctcatctatgatgtctccaacngggtcactggccgtccccgcaggttcagtggcagtgggtctgggacagacttcactctcaccgtcagcagcctagacgcctgaagtattttgcggtttactactgtcagcagtcgttccgcctggccgcttaacgtttcgggcgggggaccgaggggtggaggaggagacgaacgtggtggctgcaccatctgtcttcacttccttcccgcctatctgacntacg

SEQ ID NO: 23607 - DNA, 528 bp, Homo sapiens
  misc_feature: GYAE6OF02F0TXR.24.35.D02.1.454.CMB.1.raw
  modified_base (310)..(310): a, c, t, g, unknown or other
  misc_feature (310)..(310): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacngggtcactggccgtccccgcaggttcagtggcaggtgggtctgggacaggacttcactctcaccgtcagcagcctagacgcctgaagtattttgcggtttactactgtcagcagtcgttccgcctcggccgctacgtttcgggcgggggccgagggtggagaggagacgaacgtgngcngcacatctgtctcacttctccgctactctacgacatacg

SEQ ID NO: 23608 - DNA, 532 bp, Homo sapiens
  misc_feature: GYAE6OF02GRY4X.24.35.D02.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggcctggctcccaggctcctcatctatggtncgtccaccagggccactggcgtcgcggacaggttcagtggcagtggctttgggacagacttcactctcatcatcgacagactggacgcccgaagtattttgcagtgtattactgtcagtcgttgtttcggtccctcttcctctatgttactacttttggtcctagggttccacggtctggagactcgagcgaacgtggtggctgccactatctgtcttctattccttcccg

SEQ ID NO: 23609 - DNA, 598 bp, Homo sapiens
  misc_feature: GYAE6OF02IST06.24.35.D02.1.454.CMB.1.raw
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (387)..(387): a, c, t, g, unknown or other
  misc_feature (387)..(387): n is a, c, g, or t
tcagactactatgtcacgaccggtgctcgatttagcacacgatagttggggtttagggggaggaactgctcagttaggacccagagggaaccactggaacgccccagccttcagctttctcttcctcctgcgtactctggctcccagagaccaccggagaaattgtcgttgactacagtctcccaggcacccgtgtctttgtcttccaggggacgaggagccaccctctcctgcaggccagccggagtcgttagtaacgtacttaggctggtaccaacagaaacctagccaggctccagctcncatctatgatgtctcacngggtcacgtggccgtccccgctaggttcagtggcaggtggtctggacagacttcactctcaccgtnacgcagcctagacgtcctgacgtattttcgacgtttactattgtcagtcgacgtcgttccgcgttcggccgcgttacgtttcgggcggggacctaggggtggaggtacgggacgaacggtaacgtcggttcggcgttcggaccaccgtacgtcgttccgtccgttccacgttccgttaccccgtcctacgttcctacggaactgttaacgg

SEQ ID NO: 23610 - DNA, 689 bp, Homo sapiens
  misc_feature: GYAE6OF02HS5E3.24.35.D02.1.454.CMB.1.raw
  modified_base (296)..(296): a, c, t, g, unknown or other
  misc_feature (296)..(296): n is a, c, g, or t
  modified_base (438)..(438): a, c, t, g, unknown or other
  misc_feature (438)..(438): n is a, c, g, or t
tcagactactatgtcacgaccggtgctcgatttagcacacgatagttgggggtttgggggaggaactgctcagttaggaccccagaccgggaaccaattcggaaggcccctagcttcgagcttctcttcctcctgactactctggctccacgagaccgaccggtaggaattggtgttgacgtacctaggttctcctaggctaccctgtctttgtctccgaggggacgagacgccgacccgtctcctgggcagggtccacgccggacgtggtaggtaacgtacttagcctggtaccngcagaacctcgccaggctccaggcctcctctctaactgactgtctccaccgacgggccccagggtctccccgaggccgtaggttcggttggtcgggtcgggtcgtgggacaaggattcactctcacatcgaagcggcctcgngtctgaaagtatttacgactactttactttactagtactaactactatacgtacgacttcggaccttccgttaactaccgttttggacctaacggggtaacctaaacgtcgggaacgtaacgtaaaccgaaaacggtaaccgtacgggtacgtacgttacgtaccgtaaccgtaacggttaccgttacgtaaccgttacgtacgttcccgttacccgggtaccttacggttacgttaccgtaacttaacgg

SEQ ID NO: 23611 - DNA, 668 bp, Homo sapiens
  misc_feature: GYAE6OF02GMEU1.24.35.D02.1.454.CMB.1.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
  modified_base (406)..(406): a, c, t, g, unknown or other
  misc_feature (406)..(406): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggnagagccacctctcctgcagggccagccggagtgttagtaagtacttaggctggtaccaacagaaacctggccaggcctcccaggcctcctcatctatgatgtctaccaagnggtcacgtggccgtcccgcaggttcagtcggctaggtcgggtctgggacagacttcactctcaccgtcacgcacgcctagacgtcctagaagtnttttcggacgttttactacgttgtcgagcgtagtccgttccgccgtcggcccgtacgttaaccggtttccgggggaccggggggtaccgtagggggtgggaggaacggggtacgtaaccgggtaacgtgggtacgggcgttacggacccgtaaccgtacgttaccgttaccggtttccgttaccgtaaccgttttccccggtttacccccggtacccgttaaccgtttcccgtaacggtaaaccccgttaggtttaaccggg

SEQ ID NO: 23612 - DNA, 622 bp, Homo sapiens
  misc_feature: GYAE6OF02HABCE.24.35.D02.1.454.CMB.1.raw
  modified_base (207)..(207): a, c, t, g, unknown or other
  misc_feature (207)..(207): n is a, c, g, or t
  modified_base (275)..(275): a, c, t, g, unknown or other
  misc_feature (275)..(275): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagtagaccaccggagaaattgtgttgtacactagtctccaggcaccctgtcctttcgtctcctagggganacgaggaccaccctcctccctgccagggccaggccggagtgttagtaagtcttaggctaggtaccaanagaaacctggaccaggctcccgagctcctcatcctatgatgtctcaacaggtccagtggcctcccgctaggttcacgtggctaggtcggtctggacaggtactcacgtctctaccgtcagtccagcctagacgcctagaacgtctttgcggtttactactgtactagtctacgtcgttaccgtccgtcggcccgtacgttaaccgtttccggggaccgggggaccgtacggggtcggacgggacgggtacggtaccgtaacgtcggtacggtcgtcggacctaccgtaacgttcgtacgttcttcgtacttcccgttacccgtcctattccgtacgtactactacgg

SEQ ID NO: 23613 - DNA, 652 bp, Homo sapiens
  misc_feature: GYAE6OF02HBO4U.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (313)..(313): a, c, t, g, unknown or other
  misc_feature (313)..(313): n is a, c, g, or t
  modified_base (386)..(386): a, c, t, g, unknown or other
  misc_feature (386)..(386): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggaccaggctcccaggctcctcatctatgatgtctaccaacgngggtccacgtggccgtcccccgcgtaggttcaggtcgctaggtgggtctggacagtacttcactctcaccgtnacgcacgctagacgcctagaagtatttcgtacggttttactacgtgtacacgtacgtacgtccgttccgccgttcggccgtacgttaaccggtttccggggacggggggtaccggtaggggttagggaacgggtaacgggtacggaaccggtaacggttcgggtcgggtaccgtcggaccgtaaccgtacgttccgttacgttctttaccgacgtttcccgtttaccccgtcctacgtttacccgtacgtaaaccgtagttaacgg

SEQ ID NO: 23614 - DNA, 537 bp, Homo sapiens
  misc_feature: GYAE6OF02GWVX4.24.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
tcagactactatgtcacgaccggtgctcgatttagcacacgatagttgggtttgggggaggaactgctcagttaggacccagagggaaccatggaagacccagctcagcttctcttcctcctgctactctggctcccagagaccaccggagaaattgtgttgacacagtctccaggcaccctgtctttgtctccagggganagagccaccctctcctgcagggccagccggagtgttagtaagtcttaggctggtaccaanagaaacctggccaggctcccaggctcctcatctatgatgtctccaacagggtcactggccgtccccgcaggttcagtggcaggtggtctgggacagacttcactctcaccgtcagcagcctagacgcctgaagtattttgcggtttactactgtcagcagcgttccgcctcggccgctacgtttcgggcgggggaccgagggtcggagaggagacgaacgtgtggctgcacgatctgtcttctacttccgttcccgcctactctagtactataacg

SEQ ID NO: 23615 - DNA, 602 bp, Homo sapiens
  misc_feature: GYAE6OF02I36HQ.24.35.D02.1.454.CMB.1.raw
  modified_base (199)..(199): a, c, t, g, unknown or other
  misc_feature (199)..(199): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtcttgctccagggganagagccaccctctcctgcagggccagccggagtgttagtaagtacttaggctggtaaccaacagaaacctggccaggctaccaggctcctcatctatgatgtctccaagagggtcacgtggccgtccccgctaggttcaggtcggcaggtcgggtctgggacaggacttcactctacaccgtcagccaggtccctaagacgccgtagaagtagttttcgacggtttaactacgtgtctagcacgtcgttaccgtccgtcggaccgtcgttaacgtttccgggacgggggtaaccgtagggtcggaggaacgggacgacgaacgtcggtgacgtcgacaccgtagttctcgttcgttacacgttccgttacccgtacctacgttaccgtacgaacgtagtacgg

SEQ ID NO: 23616 - DNA, 603 bp, Homo sapiens
  misc_feature: GYAE6OF02HSAFS.24.35.D02.1.454.CMB.1.raw
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagacgccaccctctcctgcagggccagtcgagaatgttgcagcaacttagcctggtaccagcagaacctgcaggctccgaggctcctcatctatggtactactccagccagggcctactcggtcgtcccagcctaggttcaggtcggactaggtcgggtacctggggacaggtacgttccacgttctacaccctatcgacgtactacgttctggactacgtacgtagaagttagtttcgacgttagtttacgttacgtcgtacctagcaacggtcacgtaggtcgtacgtcggtcccgtctaccgtacgtttcgggacgggtacgggtaacgtacgggtacggaacgtacgttaaccgaaacgtacgttacggtacggtacgtacgacccgtaccgtaacg

SEQ ID NO: 23617 - DNA, 527 bp, Homo sapiens
  misc_feature: GYAE6OF02FFTQJ.24.35.D02.1.454.CMB.1.raw
  modified_base (293)..(293): a, c, t, g, unknown or other
  misc_feature (293)..(293): n is a, c, g, or t
  modified_base (360)..(360): a, c, t, g, unknown or other
  misc_feature (360)..(360): n is a, c, g, or t
  modified_base (511)..(511): a, c, t, g, unknown or other
  misc_feature (511)..(511): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccatcctctcctgcagggccagtgagaatgttggcagcaacttagcctggtaccagcagaaacctggccaggctcccaggctcctccnctatgctgtcctccaccagggcccctggtcgtcccagccaggttcgtgggcggtgggtctggggacngtatttcactctcaccatcagcgcctcagtctgagtatttgctactttattctgtctaactactatggtgctggcctcgtactacttttggaccgtagggaccaaacgtggagtatacaaacgactagtggtctgcacctatcgtgtcttnactccttcccgcctac

SEQ ID NO: 23618 - DNA, 544 bp, Homo sapiens
  misc_feature: GYAE6OF02HKDTD.24.35.D02.1.454.CMB.1.raw
  modified_base (310)..(310): a, c, t, g, unknown or other
  misc_feature (310)..(310): n is a, c, g, or t
  modified_base (472)..(472): a, c, t, g, unknown or other
  misc_feature (472)..(472): n is a, c, g, or t
  modified_base (488)..(488): a, c, t, g, unknown or other
  misc_feature (488)..(488): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacngggtcactggcgtcccgccaggttcagtggcaggtgggtctgggacagcttcactctcaccgtcagcagcctagacgcctgaagtattttgcggtttactactgtcagcagtcgttccgccgtcggccgctaacgtttcgggcgggggtacgagggtggagngggagacgaacgtggnggctgcacgtagtctgtcttacacttcttcccgccgtactcgtagaactattacgg

SEQ ID NO: 23619 - DNA, 757 bp, Homo sapiens
  misc_feature: GYAE6OF02G6VY9.24.35.D02.1.454.CMB.1.raw
tcagactactatgtcacgaccggtgctcgattttagcacacgatagttagggtttagggggaagggaactgctacagtttagggaccctagagggaaccactgggaagtccccagtctcagcttctcttcgtcctgctacgtctcggcgtccagagaccacggagaaacttggtcgttcgacacacgtcgtccaggctaccctgtcgtttgtactccgacggggacagacgaccacccgtctaccgtcgcgacgggccaggtccggttaagtcgttaaggtaacgtaacgttaaggactacggttaacctaacgacgtaaaccgtcggaccaacgggactaaccccgaagggccttccgtcctacttacttagtgaacttgtttactccgaactagggtccaaccggtcgggccggtccccgcgtaacggttctagtggcgagtgggtcgtggacacgacttcactttcacctacgtcacgcacgccgtagacgtccctaggaacgtagttttcgacggtttaactacgttgtacgacgttcgtaacgtccggtttcgcctcggggtaccgtcgttaaaccttttcggggaccgggggttaacccgtacggggttacggagggtacgggtacgggaaacccgggtaacgtacgggtcggtacggtgaccgtaacctaacggttaccgttggttaccgttccgtacgttcccgttacccgtccttacgttcccgttacgtaacctacgtttaacccgg

SEQ ID NO: 23620 - DNA, 569 bp, Homo sapiens
  misc_feature: GYAE6OF02I9260.24.35.D02.1.454.CMB.1.raw
  modified_base (263)..(263): a, c, t, g, unknown or other
  misc_feature (263)..(263): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagcccaccctctcctgcagggccagccggagtgttagtaagtacttaggctggtaccaanagaaacctggccaggctcccgaggctcctcatctatgattgtcctaccaacagggtccacgtggccgtccccgcaggttcagtggcaggtgggtctgggacagacttcgactctcacgtcagcagcctagacgctgagtatttgcgtttactactgtcagcagtccgttccgccgtcggccgtactaaccgttcgggaccgggggaccgaggggtcgggaggagggacggacgaacgttggtcggcgtcggaccacgtagtcgtgttctctagttcccttcccgcctatccgtacgactagtacgg

SEQ ID NO: 23621 - DNA, 557 bp, Homo sapiens
  misc_feature: GYAE6OF02F4IQG.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (397)..(397): a, c, t, g, unknown or other
  misc_feature (397)..(397): n is a, c, g, or t
  modified_base (430)..(430): a, c, t, g, unknown or other
  misc_feature (430)..(430): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaacctggccaggctcccaggctcctcctctatgctgtctccaccgagggcccctggtcgtcccagccaggttcgttggcggtgggtctgggacagatttcactctcaccatcagcggcctccagtctgaagtntttgctactttatttctgtcaactactatggtnacttggcctcgtactactttggccgtagggaccaacgtggagatacgaaacgaactggtacgcgtcgctaccacgtctagttccttctacttccgttcccgtcctacttctacgtaactattaacgg

SEQ ID NO: 23622 - DNA, 673 bp, Homo sapiens
  misc_feature: GYAE6OF02GTXPG.24.35.D02.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (382)..(382): a, c, t, g, unknown or other
  misc_feature (382)..(382): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctccncatctatgatcgtctccaangggtcacgtggccgtccccgcaggttccaggtggcaggtgggtctgggacagtacttcactctcaccgtcancagcctagacgcctagaagtattttcgcggttttactacgttgtcagtcctagtccggttccgccgtcgggcccgtacgtttaaccggttttccggggaccgggggggtaacccgtaggggggttacggaacggggtaacggggaacggtaacgggtaaaccggttgggttacgggccgttacgggaccctaaccgtacgtttaccgtacggtttcccgtttaccgtaacgtttccccgtttacccccgaccttaacgttacccgttaacggtaaacctagtttaaccggg

SEQ ID NO: 23623 - DNA, 609 bp, Homo sapiens
  misc_feature: GYAE6OF02JQXAW.24.35.D02.1.454.CMB.1.raw
  modified_base (200)..(200): a, c, t, g, unknown or other
  misc_feature (200)..(200): n is a, c, g, or t
  modified_base (516)..(516): a, c, t, g, unknown or other
  misc_feature (516)..(516): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccagggganagagcccaccctctcctgcagggccagccggagtgttagtaagtacttaggctggtaccaacagaaacctggccaggcctcccaggcctcctcatctatgatcgtcctaccaagcgggtcacgtcggcccgtccccggcctagggttccagggttcggactaggtcggggtctacggggaaccaggtaccttccgacttcgtccgaaccgtcagccaggcctagacgtccgtagaacgttattttcggacggttttacacgttgacagtcacgtcgttccgctcggccgtacgttacgttccgggacggggtaccngggtaggaggaggacgtacgtacgtgtggactcgacacgagtctagttcgttacacgttcccgtacccgtcacttcgtacgtactagttaacg

SEQ ID NO: 23624 - DNA, 658 bp, Homo sapiens
  misc_feature: GYAE6OF02GOEFH.24.35.D02.1.454.CMB.1.raw
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
  modified_base (393)..(393): a, c, t, g, unknown or other
  misc_feature (393)..(393): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagtcaccctctcctgcagggccagccggagtgttagtaagtacttaggctggtaccaacgagaaacctggccaggctcccgaggctcctcatctatgatgtctaccaacagggtcacgtggccgtccccgcaggttcagtggcaggtgggtctggacagtactcactcncacgtcagcacgcctaggacnccgtagaagttacgttttggaccggttttactacgtcggttacaggtccacggtccggtttcccgccgttcgggacccgtacctttaaaccgggtttccgggggtacggggggaacccgtagggggttcgggaacggtaagggtaacgggaaccggtaacgttagggtcgggtcctaggaccctaacgagttccggttacggttccttcgtaccgttccgtttaccccggtccctaagttcccgtaacggtaacctagttaacgg

SEQ ID NO: 23625 - DNA, 660 bp, Homo sapiens
  misc_feature: GYAE6OF02H41MZ.24.35.D02.1.454.CMB.1.raw
  modified_base (202)..(202): a, c, t, g, unknown or other
  misc_feature (202)..(202): n is a, c, g, or t
  modified_base (412)..(412): a, c, t, g, unknown or other
  misc_feature (412)..(412): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggganagagcccaccctctcctgcagggccagccggagtgttagtaagtacttaggctaggtaccaacgagaaacctggccaggcctacccgaggtcctcctcatctatagatcgtacctaccaacgtagggttcacgtcggcccgtcccccgcgtacggttcgaggtcggactaggtcgggtctagggacagtaccttcacttctccgaccgtnacgcacgtccgtaggaccgtccgtaggaaacgtttagttttcggttaccggttttactacgttgtacgagccgtacggtccgttcccggtccgtcggtcccgtacgttaccggtttccgggggccgggggtaccgtaggggtgggaggacgggacggacgaacgtggtagcgtcgcaccgtagtcgttctccgttactaccgttccgttccccgacctaccgttacgtacgtaaccgtagttaaccgg

SEQ ID NO: 23626 - DNA, 601 bp, Homo sapiens
  misc_feature: GYAE6OF02GCHGR.24.35.D02.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcacctgtctttgctcagggnagagccacctctcctgcagggccagccggagtgtagtaagtacttaggctggtaccaanagaacctggaccaggctaccaggctccncatctatgatgtcncaacgnggtcatcggcctcccgctaggtcaggtggcagtcgggtctggacacgtcttcacgtctcgacgtacncgctacgacgtagacgtcgtagtaacgttacgtttcggtacgttttacacgttgactcgtacgcgttccggttaccgccgtcggtacctacggtttaccggtccggggacgggtacgtacggggtgacgggtacgggacgtaccgtgtacggtcggtactcgacgtacgtcgttcgtacgttccttcgaccgtttccgtacctacgtcttacggacgttacgtagttacgg

SEQ ID NO: 23627 - DNA, 765 bp, Homo sapiens
  misc_feature: GYAE6OF02GTK62.24.35.D02.1.454.CMB.1.raw
tcagactactatgtcacgaccggtgctcgatttagcacacgatagttgggtttgggggaggaactgctcagttaggacccagagggaaccatggaaacgcccagctcagcttctcttcctcctgctactctggcctcccagagaccaaccggagaaattgtgttgacacagtctccaggcaccctgtcttgtctccagggagagacgccaccctctcctgcaggccagccggagtagttaagtaacgtacttaggctacggtaaccaacacgaaaccttggaccaggcctacccgaaggccttccctacgactccgtactcggaacttccgtacctaccgaaaacgtcggggttaccaccggttcggggaccccttacccccggaccgtaacggtttccaagggttcggacctaacggttggggtccgtagggtaccaagttccttcaacggttttccgacgtacccggttacgaacgtcccgaagtcccgttaaggaacgtccctagtaacgtacgttttacggttacgtttaacgtaccgttgtacgtagtaccgtacgttccgttccgtaccgtcggtaccgttcgtaacgtttccgggaccggggtaccggtacgggtagggtacggtacgggtaacgtaccggtaacggttcggttacgggaccgtcgggtacccgtaacgtacgttacgttaccgttaccgttaccgtacgttaccgttcccgtacgttacgttaccgtaaccgtaccgtaacttacgg

SEQ ID NO: 23628 - DNA, 559 bp, Homo sapiens
  misc_feature: GYAE6OF02IYFBD.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggaanagccaccctctcctgcagggccagtgagaatgttgcagcaacttagcctggtaccagcagaaacctggccaggcctcccaggcctcctcctctatgctgtcctccaccgacgggcccctggtcgtcccagtcccgtagggttcgtgggcggtgggtcgtgggacagtactttcactctcaccatccagcggcctcgagtctagaacgtatttgcttactttatttctgtactactacttattggtatacgtgtccttcgtactcgtttcggaccgtagggaaccaacgtgagtatacgaaacgacgtgtagctcgctaccatcttcgtcttactacgttcctcccgactactctacg

SEQ ID NO: 23629 - DNA, 546 bp, Homo sapiens
  misc_feature: GYAE6OF02HY7IR.24.35.D02.1.454.CMB.1.raw
  modified_base (201)..(201): a, c, t, g, unknown or other
  misc_feature (201)..(201): n is a, c, g, or t
  modified_base (404)..(404): a, c, t, g, unknown or other
  misc_feature (404)..(404): n is a, c, g, or t
  modified_base (432)..(432): a, c, t, g, unknown or other
  misc_feature (432)..(432): n is a, c, g, or t
  modified_base (496)..(496): a, c, t, g, unknown or other
  misc_feature (496)..(496): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (532)..(532): a, c, t, g, unknown or other
  misc_feature (532)..(532): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacgacggggtcacgtgggccgtccccgaccgtagggttcagtcgggcaggtgggtctgggacagtacttcactctccaccgtcagcacgcctagacnctgagtatttgtacgttactgtgtcagnagcttccgctcggcctcgtacgttcgggcgggggaccaggggtcggaaggaggagacgacgtgnggctgcactgtcncgttntcncttcctccgctactntacgacctagtacg

SEQ ID NO: 23630 - DNA, 640 bp, Homo sapiens
  misc_feature: GYAE6OF02H4JWY.24.35.D02.1.454.CMB.1.raw
  modified_base (225)..(225): a, c, t, g, unknown or other
  misc_feature (225)..(225): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (482)..(482): a, c, t, g, unknown or other
  misc_feature (482)..(482): n is a, c, g, or t
  modified_base (632)..(632): a, c, t, g, unknown or other
  misc_feature (632)..(632): n is a, c, g, or t
tcagactactatgtcacgaccggtgctcgatttagcacacgatagttgggtttgggggaggggaactgctcagttaggacccagagggaaccatggaacgccccagctcaggcttctcttcctcctgctactctggcctcccagagaccaccggagaaattgtggttcgacacagtcctccaggccaccctgtctttcgtctccgaggggagagacgccaccctntccgtgccacgggccaggccggagttgttaggtaacgtacttagggcttagggtaccaacgtagtaaacctggccaggctacccgaggacctcctcatctactcgatgtcctacaacgtagggtcactcggccgtcccgcctaggttcgagtcggctaggtcgggtcncgggactagtactcacnctcgaccgtcacgcncgtacctagacgtccgtagacgttcgttttaggtaccggtttactagtgtacgacgngttacgccgtttccgccgttggcctgtacgttcgggcggggacaggggttgaggtacggacgtaacggacgtgggcggtacgtaggaccgtacccgttagtcgttacgtactccgtaccttccgttcccgcctattccgtacgtaccgtnttaaccgg

SEQ ID NO: 23631 - DNA, 692 bp, Homo sapiens
  misc_feature: GYAE6OF02HLXXK.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtctttgtctccgaggggagagacgcccaccctctcctgcagggccaggccggagtgttagtaagtacttaggctggtaccaacagaaacctggccaggcctccgaggcctcctcatctatgatcgtcctaccgaacgtacgggtcacgtcggcccgtcccccgacgtacggttcaggttcggcgtaggtcgggtcgtacgggactagtaccttcaccttcgtaccgacccgtcacgcacgccgtaaggccgtcctaggaacgtttacgtttttcggaccgtttttaacctcgttcgttacgacggtccgtacggtccggtttcccgtccgttcggtacccgtacgtttaaccgggttccgggggaccgggggtaccggtaggggtacgggaacgggaacgggtaacgacggtaaccggttggacggtcctacggacctaccgtacgtttcggtccttaccgttcgtaccgttcccgttacccgacttacgtccgtagaccttagtacg

SEQ ID NO: 23632 - DNA, 639 bp, Homo sapiens
  misc_feature: GYAE6OF02HM7V3.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (315)..(315): a, c, t, g, unknown or other
  misc_feature (315)..(315): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggcctcccaggcctcctcatctatgattgtcctaccaacngggtcacgtggcccgtcccccgctaggttcaggttcggacgaggtgggtctggggacaggtaccttcactctcaccgtcagcagcctaagcgtccgtagaacgtattttcggacgttttactacgtgtacagcacgtccgttccgccgtcggcccgtacgttaccgtttccgggggaccgggggtaccgagggggtcggaaggacgggaacgtaaccggtaaacgttggcggtccttcggacctaccgtagttccgtcggtttaccttaccgtactttcccgtttaccccgaccgtacttcccgtaaggtaacctagttaacgg

SEQ ID NO: 23633 - DNA, 545 bp, Homo sapiens
  misc_feature: GYAE6OF02HAYWK.24.35.D02.1.454.CMB.1.raw
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
  modified_base (501)..(501): a, c, t, g, unknown or other
  misc_feature (501)..(501): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctcaggcaccctgtctttgtctccaggggagagagccaccctctcctgcagggccagccggagtgttagtaagtcttaggctggtaccaacagaaacctggccaggcctcccaggcctcctcattctatgatgtcctaccaacgtcgggtccacgtcggccgtccccgcgtaggttcaggtggcaggtcgggtcgtggacagtacttcgactctcgacgtcagcacgcctagcnctagagtntttgcgtttactgtntcagcagcanagtgactcgccnctcgtcgttcggcggtaggaccgaggtcgaagactacgaacgagtggtagcgngaccactcgttctgttaccttctaccgttccctcccgcctatcg

SEQ ID NO: 23634 - DNA, 549 bp, Homo sapiens
  misc_feature: GYAE6OF02HXDIT.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgcagggccagccggagtgttagaagtacttaggctggtaccaacagaaacctggccaggcctccaggctcctcatctatgatgtctccaagagggtcacgtggccgtccccgctaggttcagtcggcaggttgggtctgggacagacttcactctcaccgtcagcagcctagcgacctagaagtattttgtacggtttactactgtacagtcagtcgttccgcctcggccgacgttaacgttcgggcgggggaccgaggggtggagaggagacgaactgtggctgcacgagtctgtcttcactccgttcccgctactctagtacatacgg

SEQ ID NO: 23635 - DNA, 638 bp, Homo sapiens
  misc_feature: GYAE6OF02JBNEU.24.35.D02.1.454.CMB.1.raw
  modified_base (202)..(202): a, c, t, g, unknown or other
  misc_feature (202)..(202): n is a, c, g, or t
  modified_base (268)..(268): a, c, t, g, unknown or other
  misc_feature (268)..(268): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
tcagactactatgtcacgaccggtgctcgatttagcacacgatagttgggtttggggaggaactgctcagttaggacccagagggaaccatggaagccccagctcagcttctcttcctcctgctactctggcctcccagagaccaccggagaaattgtgttgacacagtctccaggcaccctgtctttgctccgaagggganagacgcccaccctctcctgaccagggccaggccggagtcgttagaagtacttaggctggtaccaanagaacctggccaggctccaggcctcctgatctatgatcgtactccgaatgggtccacgtggcctacccgctaggttcagtggcaggtggtcnggacagtcttcgactctcgaccgtnagcagcctagcgtcctagaacgtatttcgacgtttactacgtgtctagctagccgttaccgccgttcggacccgtacgttaaccggttcggggaccgggggtaccgtacggggtacggaaggacgggtaacgtaaccggtaacgtcggtacgggtccgttacggaccgtaaccgtacgttcggttacgttaccgttaccgtaacgttcccgtttaccccggctacgttaccgtacgtaaccgtagttaaccgg

SEQ ID NO: 23636 - DNA, 717 bp, Homo sapiens
  misc_feature: GYAE6OF02F5L86.24.35.D02.1.454.CMB.1.raw
  modified_base (206)..(206): a, c, t, g, unknown or other
  misc_feature (206)..(206): n is a, c, g, or t
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaagngccaccctctcctgcagggccagtgagaatgttggcagcaacttgcctggtaccagcagaacctggccaggctccaggctcctcctctatgctgtcctccaccgacgggcccctggtcgtcccagccgtaggttcgtgggcggttgggtcgtgggactaggtactttcacgttcctcaaccctatccgacggccgggtaccctaccgtacggttccgtaggaaacgttacgtttttcggaccttacgttttttactttccgttacggttaacctaaaacgttaccttaacggttacggttacgtaaccgttccgggtacccctttacccggttaacctttaccggttttttacgggacccggtaacgggggtaaaccctaaaaccggttcggaaacgtacgttaacccgtaaacgtaaccggttagggttaccgggaccttacggaacccgtaccgtaacgtttaccgttacgtttacctttaccctacgtttccccttaccccggtaccc

SEQ ID NO: 23637 - DNA, 568 bp, Homo sapiens
  misc_feature: GYAE6OF02IYYYI.24.35.D02.1.454.CMB.1.raw
  modified_base (262)..(262): a, c, t, g, unknown or other
  misc_feature (262)..(262): n is a, c, g, or t
  modified_base (512)..(512): a, c, t, g, unknown or other
  misc_feature (512)..(512): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaanagaaacctggccaggcctccaggcctcctcatctatgatgtctaccaacgagggtccacgtcggccgtcccccgcaggttccagtggcaggtgggtctgggacagtaccttcactctcaccgtcagcagcctagacgcctgaagtatttgtcggtttactactgtcagcagtccgttccgcctcggccgtcgttaaccggtttccgggcgggggaccgtaggggtgggaggaggacgacgaacgtggtgngtcgcacgatcgttcgtcttcacgttccttcccgctactcgtacgtactagtacgg

SEQ ID NO: 23638 - DNA, 822 bp, Homo sapiens
  misc_feature: GYAE6OF02J2PYU.24.35.D02.1.454.CMB.1.raw
  modified_base (199)..(199): a, c, t, g, unknown or other
  misc_feature (199)..(199): n is a, c, g, or t
tcagactactatgtcacgaccggtgctcgatttagcacacgatagttgggtttggggaggaactgctcagttaggaccagagggaaccatggaagccccagctcagcttctcttcctcctgctactctggcctcccagacgaccaccggagaaacttgtgttgacacagtctccagcaccctgtctttgctcgaggggnagacgccacctctcctgcacgggccaggtccaggcgttgtacgcaggcaggtctacttagccgtggtaccagcaacgtaaccgtcggtacctcggtccttaccccgaggtcccttccctactacttccgttaagttcggtccgaccgttacccaccggaaccgggtcccaacggttcgggccggttccggaccggacgtaagggttccgacggttcgggcgtagggtcggtcggtttcggggaacttacggtacgtttaccagttcccttacgaactttccgtaaccgtaccgtaaccgtaccggtaccggtacgggtaccggtaacccggttaaagtttacgtttacggacgttaacggttacggtttaccgtttaaccgttacggttaccgtacgggttacggttttccggttttaccgggttcccctttacccgtttcccgtttacccgtttaccgtttaccggttttacccgtttaccgttttttaccgggaccgttaccgggtttacccggtaccgggttcgtttaccgggtaacggttacgttaccgtaaccgggttaccgttaaaccggttcggttaccggtaccgtttacgacccggttaccgtaggtttacccg

SEQ ID NO: 23639 - DNA, 642 bp, Homo sapiens
  misc_feature: GYAE6OF02FV1PA.24.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggcaccctgtctttgtctcagggganagagccaccctctcctgcagggccagccggagtgttagtaagtcttaggctggtaccaanagaacctggccaggctcccaggcctcctcatctatgatgtctaccaagngggtccacgtcggccgtccccgcagggttcaggtggcaggtgggtcnggacngtacttcactcncaccgtcagcacgcctaggacgcctagaagtagttttcgcggttttactacttgtacagcgtacgtccgttaccgccgttcggcccgtcgttaaccggtttccggggggccggggggtaacccgtagggggtcgggaagggaacgggaacggtaaccggtaaagtcgggtacggacgtcggtaccgaacccgtagttccgttaggttccttacccgtagtttccccgttccccggactaccgttccgtaacggtaacctagttaacgg

SEQ ID NO: 23640 - DNA, 764 bp, Homo sapiens
  misc_feature: GYAE6OF02IPEEP.24.35.D02.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcagggccagccggagtgttagtaagtcttaggctggaccaanagaacctggccaggcctccaggcctcctnatctatgatgtctaccaagagggtccacgtcgggcccgtcccccgcgtaacggttccaggttcggcgtacgggttgggtcgtaggggaacctaggtacctttccgacctttccgtacccgtacccggttcgaacggtccaacggtacccgtaggacgtcccgttaaggaacgtttagtttttcggaccggtttttaactacgttcgtacagcgtacggttcccgttcccggtcccgtcgggtacccctaccgttttaaccgggtttccggggggacccggggggtaaccggtaggggggttagggaacgggtaacgggtaacgggtaaaccgtaaacggttgggtaccgggtcgttacggaccgtaacccgttaggttcccggtttacggttcccgttttacctaaccggtttttccccgttacccccggtccctttaacttcccggttaacgtaaaccgttagtttaaccggg

SEQ ID NO: 23641 - DNA, 557 bp, Homo sapiens
  misc_feature: GYAE6OF02IARAP.24.35.D02.1.454.CMB.1.raw
  modified_base (316)..(316): a, c, t, g, unknown or other
  misc_feature (316)..(316): n is a, c, g, or t
  modified_base (526)..(526): a, c, t, g, unknown or other
  misc_feature (526)..(526): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggcctcccaggcctcctcatctatgattgtcctaccaacgngggtcacgtgggccgtcccccgctaggttcaggtggcaggttgggtctgggacagtacttcactctcaccgtcagcagcctagcgctgaagtatttcgtcggtttactacgtgtcgagcgacgtccgttccgtccgtcggccgtcgttaaccggtttccgggccgggggaccgaggggtggaggaggacgacgaacgtggtgcgtgcacngtctgtctcntcctccnctntcntacngtag

SEQ ID NO: 23642 - DNA, 523 bp, Homo sapiens
  misc_feature: GYAE6OF02FUJUB.24.35.D02.1.454.CMB.1.raw
  modified_base (200)..(200): a, c, t, g, unknown or other
  misc_feature (200)..(200): n is a, c, g, or t
tcagactactatgtcacgaccggtgctcgatttagcacacgatagttgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtataagaagcaactacttagcctggtatcaacagaaacctggccaggctcccaggctcctcatctatggtatatccagcagggccacgtggtctcccagccaggttcaggtgcaggtgggtctgggacaggacgtttcacttctacaccgtatcacgcagtctgcagtctagaagtatttgcttagtttattactgccagcagcactagtgacgtcggccgctcgtacgtttcgggcggtaggaccgtaagggtgaacgactacgaaacgacgtggtacggctgacacctatcg

SEQ ID NO: 23643 - DNA, 202 bp, Homo sapiens
  misc_feature: GYAE6OF02HGBGD.24.35.D02.1.454.CMB.1.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagccaccctgtctntgctcaggggaancn

SEQ ID NO: 23644 - DNA, 590 bp, Homo sapiens
  misc_feature: GYAE6OF02FTDSD.24.35.D02.1.454.CMB.1.raw
tcagactactatgtcacgaccggtgctcgatttagcacacgatagttgggtttgggggaggaactgctcagttaggacccagagggaaccatggaaaccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggaccaggcctcccaggctcctcatctatgatgtctcaacgagggtcacgtggccgtccccgctaggttcagtggcaggtgggtctggggacagacttcactctcaccgtcagcagcctagacgcctagaagtagttttgtcggttttaactacgttgtcagcagtccgttccggcctcgggcccgtcgttaaccgtttccggggaccggggggtaaccgaggggttacgggaaggagggaggacggaacgttggtcggcgtgccacgagtcgtgtccttcgtacttccttcccgctacttcctagaactagtagtacgg

SEQ ID NO: 23645 - DNA, 622 bp, Homo sapiens
  misc_feature: GYAE6OF02ITPBX.24.35.D02.1.454.CMB.1.raw
  modified_base (264)..(264): a, c, t, g, unknown or other
  misc_feature (264)..(264): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgcagggccagccggagtgttagtaagtacttaggctggtaccaanagaaacctggccaggcctcccgaggcctcctcattctatgtatcgttctcccaagagggtccacgttcgggccgtccccgctaggttcaggtggcagggtggtcgtggacagtacttcactctccacgtcagcacgcctaggacgctagaacgtgtttggacgttttactacgtgtacgagtcgacggtccgttccgccgttcggacccgtcgttaaccggttccggggaccgggggtaccgtaggggtacgggaacggagggacgaacggtaacggtggtaggcgtcgacgacctagtcgttcgttactttccgacgttccgtacccgtacgtactaccgtaacgtactagttacgg

SEQ ID NO: 23646 - DNA, 546 bp, Homo sapiens
  misc_feature: GYAE6OF02G7W3U.24.35.D02.1.454.CMB.1.raw
  modified_base (205)..(205): a, c, t, g, unknown or other
  misc_feature (205)..(205): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatgccaccggagacattgtgttgacacagtctccagcccaccctgtctttgtctccgaggggaaanagcccaccctctcctgcagggccagtgacaatgttaggagttgttagcctggtatcaacacaaacatggccaggcctcccccggctccctcactctatgatgcatccaagtacgggccagtcggcatcccagactaggttcaggtgcaggtggtctgggacagacttcactctacaccatcagcagtgtagagcctagaagttatttgattaagtttattacgtgtacagtcctacgtgaacacgtacgcccttacgttccggcccgtcgggaccagacgtcggacacgtaccaacggacttcgggtcgactcgacctacctactcgtcgttccttctccg

SEQ ID NO: 23647 - DNA, 518 bp, Homo sapiens
  misc_feature: GYAE6OF02H7RFU.24.35.D02.1.454.CMB.1.raw
  modified_base (496)..(496): a, c, t, g, unknown or other
  misc_feature (496)..(496): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaagagccaccctctcctgcagggccagtgagaatgttgcagcaattagcctggtaccagcagaaacctggccaggctcccaggctcctcctctatgctgtctccacaggcccctggtcgcccagccaggttcgttggcggtggtcgtggggacagtatttcacgtctcaccatcagcggccctcacgtctagagtatttgcttactttatttctgtcaactactatggtgactggcctcgtactactttcgcgagggacctaacgtggacgatacgaacgactgtgtctagcacntctgtctcatccttccgctacg

SEQ ID NO: 23648 - DNA, 602 bp, Homo sapiens
  misc_feature: GYAE6OF02H3LU1.24.35.D02.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgccaccctctcctgcagggccagccggagtgttagtaagtacttaggctggtaccaanagaaacctggaccaggcctcccgaggcctcctcatctatgatgtctccaacgagggtcacgtggccgtccccgctaggttcaggtcggcaggtgggtctgggactaggtacttcgacttctcgaccgtcagccacgcctagacgcctagaacgttattttcggtcgtttactacgttgtactagctacggtccgttccgccgtcggccgtacgttaacgttccgggcggggtaccaggggtgaaggaggacgacgacgtggtggcgtcgcgtaccgtgttccgtcgttccttactaccgtttccgttacccgcctagttccaacgtaactagttaacg

SEQ ID NO: 23649 - DNA, 876 bp, Homo sapiens
  misc_feature: GYAE6OF02FEKPT.24.35.D02.1.454.CMB.1.raw
  modified_base (773)..(773): a, c, t, g, unknown or other
  misc_feature (773)..(773): n is a, c, g, or t
tcagactactatgtcacgaccggtgctcgatttagcacacgataggttgggttggggaggaactgctcagttaggacccagagggaaccatggaacgccccagctcagcttctcttcctctgctactctggcctcccagacgaccgacggataattgtgtacacacgtagtcctaccgacggtcctacccgttgttacgtttcgaccgtaccggaaggggacaccggaccgtccctacccgttcgttccggaggaccggtacgggtcccgtacgggtaccgttaaggtttaaggtttaacggttaaacgttacgtttaacgggtaaccgttaccggttaaacccgaaacgtaaccggtaaaccggttccggacccgtaacccggtccgttaccccggtaacggtcccttttaacccggtagttaacttacgttacggtacggttaccttcccggttaaacccgtaaccggtaccggtaccgttaccgtaccggtcccgggtacccccgtacggttacggtacggttcggtaaccggtcggtacggggttacgttcgggtacgtaccggtaccttaccgtaccttaccgacctacccggtaccgtacgaccgacgtaccgtacgacggttactacgtacgtttattacgttcgttcgtaacgttcgtcgtcgtacgtaccgtacgccggttccgtacgccgggttaacgttaccgggtacgggttaccggggccggaacgggtgggacggacggtacggaccgtcgtaccggtntaccggtgaccctacgtactactacccgtttagggacccttaccgttaacccgttcgacccgtaaccttcgtaaccggtaacttacggtgttaagggttcccg

SEQ ID NO: 23650 - DNA, 558 bp, Homo sapiens
  misc_feature: GYAE6OF02HCYR4.24.35.D02.1.454.CMB.1.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggcctcctcatctatgatgtctccaacngggtcactggccgtccccgcaggttcagtggcaggtggtctgggacagacttcactctcaccgtcagcagcctagacgtcctgaagtattttgtcggtttactactgtcagcagtccgttccgcctcggccgtcgtacgtttcgggcgggggtaccgaggggtggaggaggagacgaacgtggtggcgtgcaccgtacgtcgtcgttcttctacttccgttcccgcctactcgtacgtactagtacg

SEQ ID NO: 23651 - DNA, 721 bp, Homo sapiens
  misc_feature: GYAE6OF02IEZW9.24.35.D02.1.454.CMB.1.raw
  modified_base (153)..(153): a, c, t, g, unknown or other
  misc_feature (153)..(153): n is a, c, g, or t
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
tcagactactatgtcacgaccggtgctcgatttagcacacgatagttgggtttggggaggaactgctcagttaggacccagacgggaccatggaagcccctagctcagcttctcttcctcctgctactctggcctcccagagaccaccggganaaattgtgttgacctacagtctcctaggcaccctgtctttgtctccgagggganagacgcccacctctccgtggcgagggccaggccggagttgttaagtaagtccttaggctggtaccaacgagaaactgaccaggcctaccgaggtctcctnattctatgatgtctaccgaacgagggttcaacgtcggaccgtcccggcctagggttcaggttcggctaaggtcgggtactggactagaccttacgaacttcgtaccgaaccgttcgaagtcgtaacggacccgtaagacgtacccttaggtaacgttacgtttttcgggaacccggttttaactacgttaccggttacaacggtaccgtaacgtcccggtttacccggaccttcgggtaccccgtaagtttaaacccgggttcggggaaccgggggacctacggggttacggaaggaacggggtaacgacggttaaccggttggtcggccgttacgaccgtaccgtagttccgttacgtaccgtttcgaaccgtttccgttcccacgttacttccgtaagtacctagtttacgg

SEQ ID NO: 23652 - DNA, 528 bp, Homo sapiens
  misc_feature: GYAE6OF02JERGA.24.35.D02.1.454.CMB.1.raw
  modified_base (203)..(203): a, c, t, g, unknown or other
  misc_feature (203)..(203): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (396)..(396): a, c, t, g, unknown or other
  misc_feature (396)..(396): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacntggccaggctccccggntcctcatctatgatgcatccaatagggccactggcatcccagacaggttcagtggcagtgggtctgggacagacttcactctcaccatcagcagtgtagagcctgaagtntttgctagtttattactgtacagtcaccgtgacctacgtcggccctacgtttccggcccgttgggacctagactcggactacgtccgaacgtactcggtcggtctgaccactactacgtcgtaccttactac

SEQ ID NO: 23653 - DNA, 222 bp, Homo sapiens; identical to SEQ ID NO: 23222
  misc_feature: GYAE6OF02G615G.24.35.D02.1.454.CMB.1.raw
  modified_base (219)..(222): a, c, t, g, unknown or other
  misc_feature (219)..(222): n is a, c, g, or t

SEQ ID NO: 23654 - DNA, 587 bp, Homo sapiens
  misc_feature: GYAE6OF02GIZCU.24.35.D02.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacncgggtcacgtcggccgtccccgccgaggttcaggtggctaggtcgggtctgggacaggtacttcgactctcaccgtcagccagcctagacgtcctagaacgtattttgtcggttttacttacgttgtacacgctagtccgttccgccgtcggcccgtctaaccgtttcgggcgggggtaccgagggtggaggaggaggtacgaacgtggtacggcgtgcaccgtagtctcgttcttctacttcccttcccgtcctacttcctacgtactagttaacg

SEQ ID NO: 23655 - DNA, 554 bp, Homo sapiens
  misc_feature: GYAE6OF02I0C7F.24.35.D02.1.454.CMB.1.raw
  modified_base (201)..(201): a, c, t, g, unknown or other
  misc_feature (201)..(201): n is a, c, g, or t
  modified_base (509)..(509): a, c, t, g, unknown or other
  misc_feature (509)..(509): n is a, c, g, or t
  modified_base (522)..(522): a, c, t, g, unknown or other
  misc_feature (522)..(522): n is a, c, g, or t
  modified_base (538)..(538): a, c, t, g, unknown or other
  misc_feature (538)..(538): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggcctcctcatctatgatgtctccgaacagggtcacgtggccgtccccgctaggttccagtggctagtgggtctgggacacgacttcactcctacaccgtcagcacgcctaagacgcctagaagtattttgtcggtttactacgtgtacagcagtccgttaccgcctcggcctcgtaaccgtttcgggcgggggtacctggggtggagaggagacgaagtggtcgntcgcacgatcgtntcgtcacttccgtccncatcacgtactgtacg

SEQ ID NO: 23656 - DNA, 550 bp, Homo sapiens
  misc_feature: GYAE6OF02F2OVG.24.35.D02.1.454.CMB.1.raw
  modified_base (309)..(309): a, c, t, g, unknown or other
  misc_feature (309)..(309): n is a, c, g, or t
  modified_base (359)..(359): a, c, t, g, unknown or other
  misc_feature (359)..(359): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaanagggtcactggccgtccccgccaggttcagtggcaggtgggtctgggacngacttcactctcaccgtcagcagcctagacgcctagaagtattttgcggttttactacgtgtcagcgacgtcgttccgcctggcccgtctaacgtttccgggcgggggtaccgaggggtggaggagggagacgaacgtgtggctgcgacatctgttctctacttccttcccgcctatctacgactattacg

SEQ ID NO: 23657 - DNA, 799 bp, Homo sapiens
  misc_feature: GYAE6OF02GEHWI.24.35.D02.1.454.CMB.1.raw
  modified_base (214)..(214): a, c, t, g, unknown or other
  misc_feature (214)..(214): n is a, c, g, or t
tcagactactatgtcacgaccggtgctcgatttagcacacgatagttgggtttgggggaggaactgctcagttaggacccagagggaaccatggaagccccagctcagcttctcttcctcctgctactcgtggcctccagacgaccgaccggaagtaaattgtgttgacacagtcctccacgccctacctgtctgtcgtcctcggaaggggaancgcccaccctctcctgcgacgggccaggtgaagtaagttggttcggacagacctaaacgttacgccgttacggtaaccacgacgaaacgaaaaccgtcggaccgacggtccctacccggacggtcccttcccttccctacttacgtcggtcttcggtccctaccccgaaccggtacccggggtcccccgttgggttcccgtaccccgacggtacccggttacggggtttccgggttcggggtccggggttcggggttccggttacgggggaaccgttacggttaccgttttacccgtaacctttccctaacccgaacccttaacgtccggaaccgggtcccggtccccttaccgtacgttcgttaaggtaaacgtttagttttccggactttaaccgtttttatttccgttacgtaacctaacgttacttaggttcggtacgtaccgtcggtcccttaccgtacgtttcggtttcggaccggtaacgggtaacctaaacggttggaacgtaacgtaaccgaaacgtacgttggacgtcgtcgaccacgtcgttcgtcgttctctcgttccctcccgactcttacg

SEQ ID NO: 23658 - DNA, 688 bp, Homo sapiens
  misc_feature: GYAE6OF02H4L0K.24.35.D02.1.454.CMB.1.raw
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatgcccaccggagacattgtgttgacacagtctccagcccacctgtctttgtctccaggggaaangcccaccctctcctgcagggccagtgacaatgttaggaagttgttagcctggtatcaacacaaacatggccaggcctccccggntccnatctatgatgctatccgaagtcggcctacgtggaccactacccgagacgtaggttccaggtcggcgtagggtcggggtaccgtaggggaacctaggtaacctttcgaccttccgttaccaaccctagttaccaacggtccgtaaggttacggtaacggaccgtaccgttaaggtaaacgtttagtttttacggtaaccgtttaagtttttacgtttacgttcgttaccgtacgtaccctaaccggtacgaaaccgtaaccggttccggaccccttaccggtttcccgggacccgttacggggacctaacggtacgtcgactaaccgtaccgtaaaccggtaacgttcggtacgtccgtacgaccctactacgtttcctacgttcccttactacccg

SEQ ID NO: 23659 - DNA, 572 bp, Homo sapiens
  misc_feature: GYAE6OF02GQX5S.24.35.D02.1.454.CMB.1.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacgngggtccacgtcggccgtccccgctagggttcaggtggctaggtgggtctgggacaggtacttcacttctcaccgtcaagcacggcctagacgcctagaagtagttttcggtcggtttactacttgtacagtcacggtccgttccgcctcggccgtacttaacgtttccgggcgggggaccgtaggggtaggaggaggacgacgaacgtgtggctgcacagtcgtgtcttcacttccgtcccgctactcgtagactagtagg

SEQ ID NO: 23660 - DNA, 579 bp, Homo sapiens
  misc_feature: GYAE6OF02G7912.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggaaagagccaccctctcctgcagggccagtgagaatgttggcagcaacttgcctggtaccagcagaaacctggccaggctccaggctcctcctctatgctgtctccacccagggcccctggtcgtcccagccaggttcgttggcggtgggtctgggacagatttcactctcaccatcagcggcctccagtctgaagtattttgctactttatttctgttcaactacttatggtgacttcggccttccgtactacgttttggaccgtacgggggaacctaaacgtgggaacgtacgtacgaaaacgtacgtggttacggacctggcctaacctattaccgtgttcctttcgacttcccttaccccgccttacttcctaacg

SEQ ID NO: 23661 - DNA, 679 bp, Homo sapiens
  misc_feature: GYAE6OF02FHZYZ.24.35.D02.1.454.CMB.1.raw
  modified_base (402)..(402): a, c, t, g, unknown or other
  misc_feature (402)..(402): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctcctaggggagagagccaccctctcctgcagggccagccggagtgttagtaagtacttatgctggtaccaacagaacctggccaggcctccgagctcctcatctatgattgtctccaagtacgggtcacgtggccgtccccgcctaggttccagggttcggcgtagggtcgggtcgttcggggactaggtaccttcacttcctcaaccgtnacgccaagcccttaagacgccgtagaaggttacgttttcgtacggtttacttacgttagttacctaggtctacggtccgttcccgtccgtcgggtacccgtacgtttaaccggtttccggggaccggggggtaccgtacgggggttacggggaacgggaggggtaacggaacggtaaacgtcggtacgggtcgttcggaccgtaccgtagttccgttacgttcgtttccgtacgttcccgttacccgtacctaccgttaccgtacgtaaccgtaacg

SEQ ID NO: 23662 - DNA, 699 bp, Homo sapiens
  misc_feature: GYAE6OF02H9J1M.24.35.D02.1.454.CMB.1.raw
  modified_base (170)..(170): a, c, t, g, unknown or other
  misc_feature (170)..(170): n is a, c, g, or t
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (320)..(320): a, c, t, g, unknown or other
  misc_feature (320)..(320): n is a, c, g, or t
tcagactactatgtcacgaccggtgctcgattttagcacacgatagttgggtttggggaggaactggctccagttagggacccagagggaaccatggaagccccagctcagcttctcttcctcctgctactctaggctccagtagaccaccggagtaattggtgttgacnctagttcgtccaggctacccttgtacttttgtctccgagggngagagcccaccggtntcctggccagggccagggcccgagttgttagtaagtacttaggcttcggtacaactagtaaacctggaccaggtcctcccgaggtctaccctnaacttctatgtacttcgcctaccaacgtgggtacagtcggcctccccggactaggttccaggtaggtactaggttaggggttcagggactagtaacctttgaacttcgttaccgaccggtctaaagtcctaacggtccgtaagggacgtacccgtagtaaacggttactttttcgaccggttttaactacgttacgtacttaaaccggctaacggtccgttccgtaccgttaggaccctacgttaacgttcgggacggggtaccaggggttcggagagggtacgaacgactggcggtactacgacacgtacgtcgttacggtcgttacctaacgttccgttacccgacgtacgtttaccggacgttaccgagttaacgg

SEQ ID NO: 23663 - DNA, 551 bp, Homo sapiens
  misc_feature: GYAE6OF02IHUZ7.24.35.D02.1.454.CMB.1.raw
  modified_base (202)..(202): a, c, t, g, unknown or other
  misc_feature (202)..(202): n is a, c, g, or t
  modified_base (395)..(395): a, c, t, g, unknown or other
  misc_feature (395)..(395): n is a, c, g, or t
  modified_base (537)..(537): a, c, t, g, unknown or other
  misc_feature (537)..(537): n is a, c, g, or t
tcagactactatgtcacgaccggtgctcgatttagcacacgatagttggggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggcctcctcatctatgatgtcctccaacagggtcactcggccgtccccgcaggttcagtcggcaggtgggtctggacagtacttcactctcaccgtcagcagccctagacnctgaagtatttgcgtttactacgttgtcagcagtccgttccgccgttcgccgtcgtaaccgtttcgggacggggggtacctaggggtggaggaggagaagacgtggtggctgctacgatcgtgtcttcacttcctcccgctntctacgtacatacg

SEQ ID NO: 23664 - DNA, 825 bp, Homo sapiens
  misc_feature: GYAE6OF02G95HV.24.35.D02.1.454.CMB.1.raw
tcagactactatgtcacgaccggtgctcgatttagcacacgatagttggtttggggaggaacttggcttcagttaggacccagagggaaccatggaagccccagctacaaagcttactcttcctcctgtccttactcctggctcccgaggagacccaaccggagaaagtttcgtgttcgaacgtacacgtcctccaggcacccgttggtcctttggtccttccgaggggagacgtacggccaaccctctcctcgccacgggccagtccggagttcgtttaacgtaaggtacgttacggcctaggtaacccaaagaggaaaacctggacctaaggcctcccgaggctacctccgactccgtacgtaggattgtaccttacgaacgtagggtaccaacgtcggccgtaccccgcgtacggttccgaacggttcggtactacggttgggtccgttagggaacctacgtaaccgtttccgtaaccgtccgttacccgaacccgttacgaacggacccgaacggtacccctaaggaaccgaccgttacgtaaacgttcgtttttaccggtacggttttaacctacgtttcgtacctacgtaccgtacggtcccggtttacccgcccgttacgggcccgtaccgtttaaccgttttccggggtaccgggggtacctagggggttcgggaaggtacgggtaacgtaaccggtaacgttggtacgggtcctacggacgtaaccgtaggttcccgttaggttaccgttaccgttacgttttcccgttacccggttaccgttacgttacccgtaacggtaccgtaagttaacggg

SEQ ID NO: 23665 - DNA, 605 bp, Homo sapiens
  misc_feature: GYAE6OF02HHB7N.24.35.D02.1.454.CMB.1.raw
  modified_base (214)..(214): a, c, t, g, unknown or other
  misc_feature (214)..(214): n is a, c, g, or t
  modified_base (311)..(311): a, c, t, g, unknown or other
  misc_feature (311)..(311): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagcccaccctntcctgcagggccagccggagtgttagaagtacttaggctggtaccaacagaaacctggccaggctcccaggctcctcatctatgatgtctccaacgngggtcacgtggcctccccgctaggttcagtggcaggtgggtctgggacagacttcactcncaccgtnagcagcctagngcctagaatagttttgtcggtttactacgtgtcagcagtccgttccgccgtcggaccgtacgtaccggtttcggggaccggggtaccgtaggggtacggaggtaggacggaccgaacggttggaggtcgtgccgaccgtacgttccgttacgttccttaaccttccgttacccgtttccccgaccgttaattcccgtaacgtaacgtattaacggg

SEQ ID NO: 23666 - DNA, 700 bp, Homo sapiens
  misc_feature: GYAE6OF02GCJK3.24.35.D02.1.454.CMB.1.raw
  modified_base (201)..(201): a, c, t, g, unknown or other
  misc_feature (201)..(201): n is a, c, g, or t
  modified_base (364)..(364): a, c, t, g, unknown or other
  misc_feature (364)..(364): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccagccggagtgtagtaagtacttaggctaggtaccaacaggaaacctggaccaggctccaggcctcctcatctatgattgtctccaacgagggtcacgtggcctccccgctaggttcagtggcaggtgggtctgggacngtacttcgactcctcacgtcagccagtcctaagactccgtaggtaacgtagtttttcggtaccgggttttaacctacgttcgtacgtacgtcgtaacggttcccggttcccgtcccggttacggccccggtacgtttaaacccgggtttccgggggacccgggggggtacccgtaaggggggtcggggtaaagggtacggggacgtaaccgggtaaccttggggttcgggaccgttcggccgtaaccgtacgtttcggttacgttcccgtttaccttaacgtttcccccgttacccggtacccttacgtttaccgacgttaacgtatttaaccggg

SEQ ID NO: 23667 - DNA, 630 bp, Homo sapiens
  misc_feature: GYAE6OF02JXDW7.24.35.D02.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (379)..(379): a, c, t, g, unknown or other
  misc_feature (379)..(379): n is a, c, g, or t
  modified_base (398)..(398): a, c, t, g, unknown or other
  misc_feature (398)..(398): n is a, c, g, or t
  modified_base (545)..(545): a, c, t, g, unknown or other
  misc_feature (545)..(545): n is a, c, g, or t
tcagactactatgtcacgaccggtgctcgatttagcacacgatagttgggtttgggggaggaacgtgctcagttaggacccagagggaaccatggaagccccagctcagcttctcttcctcctgctactctggctcccagagaccaccggagaaattgtgttgacacagtctcaggcaccctgtctttgtctccgagggganagagcccaccctntcctgccagggccagccggagtgttagaagtcttaggctggtaccaacaggaaacctggaccaggcctcccgaggcctcctcgatctatcgattcgtacctaccaacgtgggtaccacgtcggcccgtacccccgctaagggtccaggtcggcaggtgggtccngggacagtacttcgactcncgacgcgtagcagccgtagcgaccgtgtaacgtagttttcgacggtttactgtgcgtagccagtccgttaccgccgtggccctacgttacggttccggggcggggacgttgggtggacgggcggagaccgtaacggtggaccggtcncggtaccacccgttagtcccggttgttacccttcggacctttcccgttacccggacttatcccggtttaagtaaccagtttacgg

SEQ ID NO: 23668 - DNA, 585 bp, Homo sapiens
  misc_feature: GYAE6OF02G8123.24.35.D02.1.454.CMB.1.raw
  modified_base (339)..(339): a, c, t, g, unknown or other
  misc_feature (339)..(339): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagccatcaccggaggaattgtgttgacgcagtctccaggcaccctgtctttgtctccgaggggagagagccaccctctcctgcagggccagtcagagtgtagcagcagctacttagcctggtaccagcagaaacctggcctggctcccaggctcctcatctagtcggtgccgtccaccgagggccacgtggcgtcgcggacnggttcagtggcaggtggtcgttgggactagtacttcactctacatcatcgacagtacgtggacgaccgtaagtagtttcgacgtagttgttattacgtgtcaggtcttggtttcgtcccttcgtcccttccgtacttcgttaccttacgttttcggaccgttacgggttcccgtaggtaccgttgggaacgtactacgtaaggtccgtaacgttacgggtggttaccgtacggtacctaccgtacg

SEQ ID NO: 23669 - DNA, 615 bp, Homo sapiens
  misc_feature: GYAE6OF02FIA2Y.24.35.D02.1.454.CMB.1.raw
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagcccaccctctcctgcagggccaggccggagtgttagtaagtcttaggctggtaccaanagaaacctggccaggctcccaggctcctcatctatgatgtctccaacngggtcactggccgtccccgccaggttccaggtgcaggtgggtcngggacngtacttcactctcaccgtnagcagcctagcgcctagaagtattttgcggttttactactgtcagcacgtccggtttcccgccgttcgggcccgtccgttaaccggtttccgggggaccggggggtaaccgtaggggggtaggaagggagggaaggaccgtaaaccgtggtcggcgtaggccaaccgacgttcgtcgttccttacgtacctttcccgttaccccgcctacgttccgtacggtaacctagttaacg

SEQ ID NO: 23670 - DNA, 803 bp, Homo sapiens
  misc_feature: GYAE6OF02JVOMP.24.35.D02.1.454.CMB.1.raw
  modified_base (745)..(745): a, c, t, g, unknown or other
  misc_feature (745)..(745): n is a, c, g, or t
tcagactactatgtcacgaccggtgctcgatttagcacacgatagttgggtttggggaggaacgtgctcagttaggacccagaggaaccatggaagcccagctcagcttctctcctcctgctactctgcctccacgacgaccaccggagaattgtgttgacacgacgtctaccaggccaccctgtctttcgtctccgaggggacaggacgccacccttcctcctgaccgaggccaggccggtagttcggttagtaagttacgtaggtccgttaggtaaaccaacgaacgtaaacccgtggtacccgaaggtcccgtacccgaggccttcccgtactaacgttccttaagtcggagtttaccgtcccgttaaccgaaacgttacggggtccctaacggtccggggtccccgttcccccggaccttacgggttttaaccgacggttccgggacgtacgggtttcgggtccggacgggtaactaacgggacctttccggacccgtcgttacccggtacccggttacgaccgtacaccggtaccttaacgggacgtcccgtaaggtaacgtttacgtttacggttaccgtttaaccgtcgttcgtacgtacgtctaccggtccgttaccgtcccgtacggcccttagtaacccgggtttccgggacggggtaccggtacggtcgggtaaaggcgacgggtaaccgtaggtgttacggggccttgggcccaacgttaccggtcgtttacnccgttacgttaacccggtcttcccccggattaccgtacgttacggaacccttaggttg

SEQ ID NO: 23671 - DNA, 673 bp, Homo sapiens
  misc_feature: GYAE6OF02I6X60.24.35.D02.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatgccaccggagacattgtgttgacacagtctccagccaccctgtctttgtctcaggggaanagccacctctcctgcagggccagtgacaatgttaggaagttgtagcctggtatcaacacaaacatggccaggctccaggctcctcctntatgctgtcctccaccgacgggcccctggtcgtcccagccgtaggttcggtgggcggttgggtcgtggggactagtactttcgactctacaaccctatccgaggtccggccctacgagtctagtaagttattttcgacttacttttatttcttacgtacctaaactacttagttcggtacgtaccgttcggtcccgttaccgttaacttaccggttttacgggacccggtaacggggtaaaccctaaaacggttacgggaaacgtaaacgttaaccgaaaaccggttacgttacgggttacggtaccgttaacggacctaacccgtaagttaccgttcgtttaccgttctaaccgtttccccgttaccccgtacctacttaccg

SEQ ID NO: 23672 - DNA, 617 bp, Homo sapiens
  misc_feature: GYAE6OF02HUQM3.24.35.D02.1.454.CMB.1.raw
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccagccggagtgttagtaagtacttaggctggtaccaacagaaacctggccaggcctcccaggcctcctcatctatgatgtctccaacgagggtcacgtggccgtccccgcgaggttcagtggcagtgggtctggcagacttcactcncaccgtcagcagcctagacncctgaagtatttgcgtttactacgtgtcgagcgacgtcgttccgccgtcggcccgtacgttaacggttttccggggaccggggggtaccgtacgggggttgggaacggaggggacgtaacggtaacgttggtacgggccgtaggcctaaccgtacgttcgtacgttccttaccgtactttcccgttccccgtaccgtacttcccgtacgtaacctacgttaacgg

SEQ ID NO: 23673 - DNA, 766 bp, Homo sapiens
  misc_feature: GYAE6OF02HCRAT.24.35.D02.1.454.CMB.1.raw
  modified_base (193)..(193): a, c, t, g, unknown or other
  misc_feature (193)..(193): n is a, c, g, or t
  modified_base (260)..(260): a, c, t, g, unknown or other
  misc_feature (260)..(260): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaattgtgttgacacagtctcagcacctgtcttgctcgaggganagacgccacctctcctgcacgggccaggccggagtgttagtaacgtacgtaggcctaggtaaccaanacgtaaacctggaccaggcctcccgaggtcctccgtcattctatgacttcgtacctccaaacgtcgggtcctacggtcggcccgtcccccgacgtacggttccgaaggtcggaccgtacgggttcgggtaccgtagggaactaggttactttaccgacgtttaccgtaccaaccgtaattaccgacggacccggttacccttaccggagtttaccgtaacgtaacgtttagtttttacgtacctttaacgtttttactttacgtttacgttaacctaaaccgttaacgttaacggttacgggtttacggtaacccgttccgggttacccgtttacccggtttaaccgttaccggtttttaccgggaaccggtaaccggggtaaaccctaaacggtcggtaacgtaacgtaacgtaaacgtacgtgtacggtaccgtcggaccgtacctacgttccgtacgtttaccttcgttacttacccgttccccgtactaccttaccgtaacg

SEQ ID NO: 23674 - DNA, 640 bp, Homo sapiens
  misc_feature: GYAE6OF02GLCIU.24.35.D02.1.454.CMB.1.raw
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagcccaccctctcctgcagggccagccggagtgttagtaagtacttaggctggtaccaanagaaacctggccaggctcccaggctcctnatctatgatgtctccaacngggtcacgtggccgtccccgctaggttcaggtggcaggtgggtctgggacagtacttcacttcctcaccgtcagcacgcctagacgccctaggaagttagttttcggcggttttaactacgttgtacagtccacggtccgtttccgcccgttcgggcccgttacgttaaccggttttccggggaccgggggtaccgagggggtcgggagggagggacggtaacggtaacgtgggtacggtcgtacggccgtaccgtagttccggttcgttccctttacgtcgtttcccgttaccccgaccttacgttccgtacggaacctgtttaacgg

SEQ ID NO: 23675 - DNA, 217 bp, Homo sapiens
  misc_feature: GYAE6OF02HJ3ED.24.35.D02.1.454.CMB.1.raw
  modified_base (204)..(217): a, c, t, g, unknown or other
  misc_feature (204)..(217): n is a, c, g, or t
tcagactactatgtcacgaccggtgctcgatttagcacacgatagttgggtttggggaggtgtgtcacaagatttgggctctgggcaccgtgggcacggggaggtgtgtcacaagatttgggctctgggcacagcggccctgggctgcctggtcaaggacttacttccacatagtagtctgagcgggctggcaaggcgcatagnnnnnnnnnnnnnn

SEQ ID NO: 23676 - DNA, 662 bp, Homo sapiens
  misc_feature: GYAE6OF02HUEF3.24.35.D02.1.454.CMB.1.raw
  modified_base (213)..(213): a, c, t, g, unknown or other
  misc_feature (213)..(213): n is a, c, g, or t
  modified_base (310)..(310): a, c, t, g, unknown or other
  misc_feature (310)..(310): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctntcctgcagggccagccggagtgttagtaagtacttaggctggtaccaacagaaacctggccaggctcccaggctcctcatctatgatgtctaccaanagggtcacgtggccgtcccccgctacggttcagtcggcaggtgggtctgggacaggtacttcactcgtcacgtcagcacgctaaggcgcctagaagtattttgtacggtttactacgtgtacagcagtccgttcccgcgtcggccgtacgttaacggtttccggggacggggggtaccgtaaggggtgggaaggtagggaacgggtaaccggtaaacgttggtaccgggtacgtcgggtacccaaccgtaacgttcccgtttcggttacccttttaccgtaaccgttttccccgtttacccccgtaccgttaaccgtttcccgttaaacggtaaccttaacgtttaaccggg

SEQ ID NO: 23677 - DNA, 749 bp, Homo sapiens
  misc_feature: GYAE6OF02G0KGS.24.35.D02.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccacctctccgtgcagggccagccggtagtagttagtaacgtacttaggctaggtaccaacgtagaaacctggacctaaggcctcccgaggcctaccncatctatgattcgctaccaagtggtcacgtcggacctccccgacgtacggttcaaggtcgacgtaggtcgggctagggactaggtaccttcgaccttctacgaccgtagagaccacgcccgttaaaggaccaccgttaaggtaaacgtttacgtttttacgggtaacgggtttttaaccctagtttacggtacgtaaacggtccgtacgggttacccggtttcccgtacccgttcgggtacccgtaccggttttaaccgggtttccggggaacccggggggtaaccgtagggggtacgggaagggtaaccgggtaacggtaaccgaaaccgggttcggttacgggactaccgggtacctaaccgttacgttcggtacgttaccctttacaccgttttaccccgtcccgtaacctacgttaccgttaacgaagttaacctaagg

SEQ ID NO: 23678 - DNA, 827 bp, Homo sapiens
  misc_feature: GYAE6OF02GCGSF.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccacctctccgtgcgacgggccacggccggtagttagttaagtaacgtacgttaggcgttacggtaacccaaacgaacgtaaaccgtcggaccgacggtcctacccgaaggtcccttacccgtactaactacttacgtagtacgttcgtaccctacccgaaacggtacggggtaccacggttcgggccccgtccccggcgttaacgggttcaggttcggacgttaggtcgggtcgtagggacacgtaccttacaccgttcaccgtaccgtcgacggctaaccggtccgtaacggaccgtccgtaacggtaacgtttacgtttttacggttaccggtttttaaccgttacgttcggtacgtacggtaccgtaccggttaccggtttcccggtccgttccgggtaccccgttaacggtttaacccgggtttaccgggggtacccggggggttaccggtagggggtacgggtaacgggtaacgggtaacgggtaaccgggtaaacggttcgggtacggtacggtaccgtaccgtaaccgttaccgttcgttcggttaccgttccgttaccgttcccgttacccgtcgttaccttaccggttaacgtaaccgttagttaccgg

SEQ ID NO: 23679 - DNA, 541 bp, Homo sapiens
  misc_feature: GYAE6OF02FJIQ1.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacagggtcactggccgtccccgcaggttcagtggcagtgggtctgggacagacttcactctcaccgtcagcagcctagacgcctgaagtattttgcggtttactactgtcagcagtcgttccgctggccgctaacgtttcgggcgggggaccaggggtggaggagggagacgaactggtggcgtgcacagtctgtcttcacttccttcccgcctactctacgaactagttacgg

SEQ ID NO: 23680 - DNA, 722 bp, Homo sapiens
  misc_feature: GYAE6OF02JCJQ7.24.35.D02.1.454.CMB.1.raw
  modified_base (203)..(203): a, c, t, g, unknown or other
  misc_feature (203)..(203): n is a, c, g, or t
  modified_base (326)..(326): a, c, t, g, unknown or other
  misc_feature (326)..(326): n is a, c, g, or t
  modified_base (407)..(407): a, c, t, g, unknown or other
  misc_feature (407)..(407): n is a, c, g, or t
tcagactactatgtcacgaccggtgctcgatttagcacacgatagttgggtttgggggaggaactgctcagttaggacccagagggaaccatggaagcccccagctcagcttctcttcctcctgctactctggctcccagagaccaccggagaaattgtgttgactcagtctccaggtcaccctgtctttgtctccgaggganagagccaccctctcctggcacgggccagccggagttggttacgaagtcttaggctggtaccaacgagaaaccctggccaggcctcccgaggtctcctcattctatgactggtcctaccaacgnggtccacgtggccgtcccgctaggtccaggtgcgtaggtgggtcgtggaacgagtaccttcacgttcctaccgaccggttnacggtccgaccgtaccttaaggaccgtcccgtagtaaacggttcttttacggtaccggttttaactaaccgttgtacctaggtaccgtacggttcccgttcccgaccgttaccgggtaccccgtacgtttaacccggttccgggggacccggggggaaccgtagggggttacgggaacgggaacgggtacggtaaccgggtaacgtcggttacgggtcgtacggccgtaaccgtacggttcgttaccgtttacttaccgtaccgtttcccgtacccgtccgttacgttaccgtacggttaaacgtacgttaacgg

SEQ ID NO: 23681 - DNA, 688 bp, Homo sapiens
  misc_feature: GYAE6OF02JOTHY.24.35.D02.1.454.CMB.1.raw
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtcttgtctccaggggagagagccaccctctcctgcagggccagccggagtgttagaagtacttaggctggtaaccaacacgaaacctggccaggcctcccaggctcctcatctatgatgctaccaagagggtcacgtcggccgtccccgctagggttcaggttcggctaggtcgggtcgtgggaacngtacttcaacttcgtccaccgtnagcacgtcctaggactcccgtagtaacgtcgttttacggtacggtttaacctacgttcgtacgtaacgttaccgtacgtccggttccgtaccgtcgggtacccgtacgttaaccggtttaccggggaccgggggggtaccgtaacgggggtcgggaacgggtaacgggtacggaaccgggtaacggttcgggtacgggtacgtcggaccgaaccgtacggttccgttacggttccttaaccgttcgttacccgttcccgtacgtaccgttacgtaaccgtaacgtacgttaacgg

SEQ ID NO: 23682 - DNA, 545 bp, Homo sapiens
  misc_feature: GYAE6OF02GC11U.24.35.D02.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtcttaggctggtaccaacagaaacctggccaggctcccaggctcctcatctatgatgtctccaacngggtcacgtggccgtcccgcaggttccagtggcaggtgggtctgggacagacttcgactctcaccgtcagcagcctagacgctagaagtattttgcgtttactactgtcacgcagtcgttccgctcggccgtacgtacgtttcgggcgggggtaccaggggtggagaggacgagaacgtggtgctgcacgtagtcgtgtacttcacttccgttcccgctatccgtacgactatacg

SEQ ID NO: 23683 - DNA, 743 bp, Homo sapiens
  misc_feature: GYAE6OF02II1ND.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggganagagcccaccctctcctgcagggccaggccggagtgttaagtaagtacttaggctggtaccaacagaaacctggccaggcctcccaggctcctcatctatgattcgtctaccgaacgacggggtcaccgtggcccgtccccgctaggttcaggtggctaggtcgggtctcgggactacgtacttccgtacttccgtaccgacccggttcaacggtaccacggtacccgttagggacgtcccgttaaggtaaacggttacgtttttacgggttaccggtttttaaccgttacgtttacggtaccaacgggtaccgtacggttcccggttttccccggacccggttcgggttaccccgttacggtttaaacccgggtttccggggggaccgggggggtaacccggtacggggggtagggaacgggtaacgggtaacgggaaccgtaacggttgggtacgggccgttacggaccctaacgtacgttcgttcgttccttacgttcttaccgtttccgtaccgtcctacttccgtagtaactacgg

SEQ ID NO: 23684 - DNA, 712 bp, Homo sapiens
  misc_feature: GYAE6OF02GE1GO.24.35.D02.1.454.CMB.1.raw
  modified_base (312)..(312): a, c, t, g, unknown or other
  misc_feature (312)..(312): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctcgaggggagagagccaccctctcctgcgagggccagccggagtgttaagtaagtacttaggctggtaaccaacagaaacctggccaggctcccaggctcctcatctatgatgtctccaacngggtcacgtcggccgtcccccgcgacggttcaggtcggcgtaggttcgggtcgtcgggaactacggtaacttcgaccttctaccaccgtcacgccagtcctagacgcctaggtaaagttactttttcggtacggtttttaacttacgttcggtacctaggtcctaacgggtcccggtttacccggcccgttcgggtcccgttacgttaaccggtttccgggggacccggggggtaccgtagggggttacgggagggtaacgggaacggtaaccggtaacggttcgggttacgggccgtacggacccgtaaccctaacggttccgttacgtttccgtttaccgtaactttcccgttaccccgtacctaccgttaccgtaacgtaaccgtaagttaaccggg

SEQ ID NO: 23685 - DNA, 732 bp, Homo sapiens
  misc_feature: GYAE6OF02I6WJM.24.35.D02.1.454.CMB.1.raw
  modified_base (202)..(202): a, c, t, g, unknown or other
  misc_feature (202)..(202): n is a, c, g, or t
  modified_base (415)..(415): a, c, t, g, unknown or other
  misc_feature (415)..(415): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcagggccaggccggagtgttagaagtacttaggctggtaccaagagaacctggccaggcctccaggcctcctcatctatgatcgtacctaccgaacgtagggtccacgtcggcccgtcccccgcgtaggttccaggtcggctagggtgggtctgggactaacggtaccttcgaccttcgtaccgtaacccggtnaacgccgaggtacccgtaaggacgtcccgtaggtaaacgttagtttttcggtaccggttttacctacgttcggttacgaacggtaccgtacggtcccgttcccggtacccgtcgggtacccgtaccgtttaaaccgggtttccgggggaccggggggtacccgtaggggggtacggtaagggaacgggtacggtaacggtaacgggttcggtacgggtccgtacggaccgtaaccgtacggttccggttacggttccgttaccgtaccgtttcccgttaccccgacctacgttaccgtacgtaaccgtacgttaagg

SEQ ID NO: 23686 - DNA, 721 bp, Homo sapiens
  misc_feature: GYAE6OF02IM5DB.24.35.D02.1.454.CMB.1.raw
  modified_base (309)..(309): a, c, t, g, unknown or other
  misc_feature (309)..(309): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccaggggagagagccaccctctcctgcagggccagccggagtgttagtaagtacttaggctggtaccaacagaaacctggccaggctccaggctcctcatctatgatgtctaccaacnggtcacgttggcctccccgctaggttcagtggctaggtgggtctgggacagacttcacctctacaccgtcagccaaggtccctaaggcgtacccgtagtaaacgtacgtttttacggtaccgggttttaaccgttaaccgttaggtaccgttaacggccgtaaacggtccggttttacccggaccgttccgggtacccgtaccgtttaaaccggtttttccggggaccggggggggtaacccgtaagggggttacgggtaagggtaacggggtaacgggtaaccgggtaaaccgtggtacgggtacgttacggacctaaccggtaacgttccgttacggttcctttaccgtacgtttacccgtttaccccggacctaacgtttacccgtaacggtaaccttaacgttaacgg

SEQ ID NO: 23687 - DNA, 598 bp, Homo sapiens
  misc_feature: GYAE6OF02HJ32I.24.35.D02.1.454.CMB.1.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctccaggctcctcatctatgatgtctccaanagggtcacgtggccgtccccgcaggttcagtggcagtcgggtctgggacaggacttcactctcgaccgtcagcagcccgtagacgtcctagaagtatttgcgtttactacgttgtctagcacgtccgttccgccgttcgcccgtacgtaaccgttcgggccgggggaccgtaggggtacggaggaggacgacgtaacgtcggtacggtcgtcgccaaccgtacgttcgttcgttccgttacgtacgttaccgttccccgaccgtacttaccgtacgtacctagttaacgg

SEQ ID NO: 23688 - DNA, 632 bp, Homo sapiens
  misc_feature: GYAE6OF02IB1MO.24.35.D02.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagatgccaccggagacattgtgttgacacagtctccagccaccctgtctttgtctccgaggggaanagccacctctcctgcagggccagtgacaatgttaggaagttgtagctggtatcaacacaaacntggccaggctccccggntcctnactctatcgatgaccatccaagtacgggcctacgtcggcacgtcccgaagacaggttcaggtcggcgaggtgggtctaggggacaggtacttcacttctaccactatccagcgtagtagtagacgtcgtagtaagttagtttgtacgttacgttttatttacgtagtacctagtcctaaccggtcgaaccgtaacgtccggtacccttaccggtttcccgggcccgttacggggacccgaacgtaccgtacggtaccgtaaccgttacccgtaaacggtaccgtacggtaccgggttcctacggtacctaccgtacctttcgttaccggttaccttacttacccg

SEQ ID NO: 23689 - DNA, 576 bp, Homo sapiens
  misc_feature: GYAE6OF02FVCBO.24.35.D02.1.454.CMB.1.raw
  modified_base (369)..(369): a, c, t, g, unknown or other
  misc_feature (369)..(369): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggcaagccggagtgttagtaagtacttaggctggtaccagcagaacctggccaggctcccaggctcctcctctatcgctgtcctccaccgagggtcccctgggtcgtcccaggccctagggttcgttgggcgggttgggtctgggacngtatttcactctcaccatcagcggccctcagtcctagagtatttgctactttatttctagtcaactactagtggtgtcgtgtcctccgtactacgtttcggccgtagggacctaacgtgagactacgaaacgtacgtagacgtctacgactaccgtatccgtcgttccttactacttccttacccgtcctactcgtacgtactaacg

SEQ ID NO: 23690 - DNA, 711 bp, Homo sapiens
  misc_feature: GYAE6OF02G8T5A.24.35.D02.1.454.CMB.1.raw
  modified_base (262)..(262): a, c, t, g, unknown or other
  misc_feature (262)..(262): n is a, c, g, or t
  modified_base (392)..(392): a, c, t, g, unknown or other
  misc_feature (392)..(392): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaanagaaacctggccaggctcccaggcctcctcatctatgatgtcctccaacgagggtcacgtcgggccgtccccgcaggttcagttcgggcaggtgggtcctgggacagtaccttcaccttctccgaccgtnaagcacgcccttagacgtccgtagaacgtagttttggtacggttttaacgtacgttgtcgtagtctacgtccgttccgtccgttcggtcccgtaccgttaaccggttttccggggaccggggggtaccggtacgggggttacgggaacggggtaacgggtaacggtaaccgggtaaacgttcgggttacgggtccgttacggaccgtaaccggttacgttccggtttacggtttacccgtttaccgttaaccgtttcccggtttacccccggtacccttaacgttacccgttacggtaaacccgtaggttttaaaccgg

SEQ ID NO: 23691 - DNA, 757 bp, Homo sapiens
  misc_feature: GYAE6OF02HB6TS.24.35.D02.1.454.CMB.1.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggaaanagccaccctctcctgcagggccagtgagaatgttggcagcaacttagcctggtaccagcagaaactggccaggctcccaggctcctcatctatgatcgtctaccaacngggtcacgtcggtccgtccccgccgtacggttcaggtcggcgtacggtggggtacgtgggaacagtaaccgtttcaccgttctaccgacccggttcacggtccacggtacccttaagacgcccgtaaggtaagttacgttttcggtaccggttttaactacgttcggtactaacggtccgtacggtcccggtttacccggtcccgttacggggtaccccgtacgtttaaccgggttttacccggggggcccgggggggtaacccggtaggggggttacgggaaacgggaacgggggtaacgtaaccgggtaaacggttcggggtacgggtaccggttaccggtacccgtaacccggttacgttaccggtttaccggtttccgtttacccgttaaccgtttccccggtttaccccccggtacccgttaccgttcccggttaaaccgg

SEQ ID NO: 23692 - DNA, 518 bp, Homo sapiens
  misc_feature: GYAE6OF02GHJBD.24.35.D02.1.454.CMB.1.raw
  modified_base (300)..(300): a, c, t, g, unknown or other
  misc_feature (300)..(300): n is a, c, g, or t
  modified_base (416)..(416): a, c, t, g, unknown or other
  misc_feature (416)..(416): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccacctctcctgcagggccagccggagtgttagtaagtacttaggctggtaccaacagaaacctggccaggctcccaggctcctcatctatggtncgtccaccagggccactggcgtcgcggacaggttcagtggcagtggctttgggacagacttcactctcatcatcgacagactggacgccgaagattttgctagtgtattactgtcngcttgtttgtccctctcctcctatgtactacttttggcctagggttccaggtctggagtatcagcgaacgtgtggctgcactactctgtcttctatctcccg

SEQ ID NO: 23693 - DNA, 547 bp, Homo sapiens
  misc_feature: GYAE6OF02GJHOF.24.35.D02.1.454.CMB.1.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccacctctcctgcagggccagccggagtgttagaagtacttaggctggtaccaanagaaacctggccaggctcccaggctcctcatctatgatgtctccaacgtgggtcacgtggccgtccccgcaggttcagtcggcaggtgggtctgggacaggtacttcacttctcaccgtcagccagccctagacgcctagaagtgttttgtacggtttactacgtgtcagcagtcgttccgccgtcggccgtctaacgttcgggcgggggaccgtgggnggagaggagacgagtggngcngcactgtctgtaccttcacgttccttccgcctactctagactatacg

SEQ ID NO: 23694 - DNA, 546 bp, Homo sapiens
  misc_feature: GYAE6OF02GARND.24.35.D02.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagaagtacttaggctggtaccaacagaaacctggccaggctccaggctcctnatctatgatgtctccaacagggtccactggccgtccccgcaggttcaggtggcaggtgggctgggacagacttcactctacaccgtcagccagcctagacgtcctagaagtattttgctacttttatttctctacaactatattgtgtactcgcctccgtactacgttttcggaccgacgggaccaaacgtggagatacaaacgtaactgtggctgcaccactctgttcttctacttccttcccgacctactctacg

SEQ ID NO: 23695 - DNA, 695 bp, Homo sapiens
  misc_feature: GYAE6OF02HHAXU.24.35.D02.1.454.CMB.1.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (318)..(318): a, c, t, g, unknown or other
  misc_feature (318)..(318): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagcccacctctcctgcagggccaggccggagtgttaagtaagtacttaggctaggtaaccaanagaaacctggccaggcctcccaggctcctcatctatgatgtctaccaacgngggtcacgtcgggccgtccccgcgtaggttccaggtcggcgaggttcgggtacgtcgggaacagtacttccgaacttcgtaccaccggtacagtaccagtcccgtaagacgtcccgtaggaaacgtttagtttttcggaaccggtttttaacacgttgtacgtagtccgtacgggttccgttacccggtccgtacgggtccccgtacgtttaaaccggtttccgggggaccgggggggtaaccgtagggggtacgggaaggaacgggaacggaaccggtaacggttggtacgggacctacggaccgaaccgtagttccgtaggttccttacctacgttcccttccccggacctagtaccgtacgaactagttaacgg

SEQ ID NO: 23696 - DNA, 727 bp, Homo sapiens
  misc_feature: GYAE6OF02JVN7H.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccagagaaattggtgttgacacagtctccaggccaccctgtctttgcctccgaggggagagacgcccaccctctcctgccgacgggccacggccgggtagttcgttaaggtaacgtacgttaggctacggtaaccaacaacgaaaccgtggaccaggcctcccgaggtcctccgtcattcctatcggatcgtacctaccgaaacggcggttccacgtcggcccgtccccgcgtaggttccgaggtcggcgagggttcgggtcgtagggactacggtacctttaccgacctcgtaccgaccggtacacggccgtaacggtcccgtaaagccggtacctaagggtaacgttacgtttttacgggtaccggtttaccttacgttcggtacgacggtccgtacggttcccggttcccgtcggtaccggtccgtaccgttaaccgggttccggggaccgggggtacctgggggtacggacggtacgggaacgtaaccggtcgtacgggtcgacgtcgacctcgtaacgtcgttacgttacctcgttaccgtccttcccggacttagttaccgtacgtaacgttaacg

SEQ ID NO: 23697 - DNA, 654 bp, Homo sapiens
  misc_feature: GYAE6OF02G31JK.24.35.D02.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
  modified_base (393)..(393): a, c, t, g, unknown or other
  misc_feature (393)..(393): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccagccggagtgttagtaagtcttaggctggtaaccaanagaaacctggaccaggctcccgaggcctcctnatctatgatgtcctccaacgngggtcacgtcggccgtcccccgcgtaggttcaggtcggctaggtcgggtctgggacagtacttcactctcaaccgtnacgcacgtcctagacgtccgtagaagtattttcggtacgtttactacttcgtcagtctaggtccgttccgccgtcggccgtacgttaaccggtttccggggaccgggggtaccgtaagggggtcggaagggacgggtaacggtaacgtaacggttggtacgggtccttacggcctaaccgtacgttcgttcggtttaccttccgtaaccgttcccgtttaccccgcttaccgttaccgtaacggtaaccgtgttaaaacgg

SEQ ID NO: 23698 - DNA, 248 bp, Homo sapiens
  misc_feature: GYAE6OF02J2TA5.24.35.D02.1.454.CMB.1.raw
  modified_base (241)..(248): a, c, t, g, unknown or other
  misc_feature (241)..(248): n is a, c, g, or t
tcagactactatgtcacgaccggtgctcgatttagcacacgatagttgggtttgggggaagaggaagactgacggtcctcccaggagttcaggtgctgggcaccttgggcacgggggaggtgtgtcacaagatttgggctctgggcaccgtggcagtggggagtgtgtcacaagatttgggctgcctggtcaaggactacttccacatagtagtctgagtcgggctggcaaggcgcatagnnnnnnnn

SEQ ID NO: 23699 - DNA, 634 bp, Homo sapiens
  misc_feature: GYAE6OF02IQ6F5.24.35.D02.1.454.CMB.1.raw
  modified_base (264)..(264): a, c, t, g, unknown or other
  misc_feature (264)..(264): n is a, c, g, or t
  modified_base (315)..(315): a, c, t, g, unknown or other
  misc_feature (315)..(315): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaattgtgttgacacagtctccaggcaccctgtctttgtctccgaggggagagagcccacccctctcctgcagggccaggccggagtgttagtaagtcttaggctggtaccaanagaaacctggccaggctccccaggcctcctcatctatgatgtctccaacgnggtcacgtggccgtccccgcaggttcagtcggcaggtggtctgggacagtacttcactctcaccgtcagcacgcctagacgtccgtaggaagttacttttacggtacggttttactaaccgttggtaccgtagccgtacggtcggtttacccgcccgttcgggcccgtaccgttaaccggtttccggggccgggggtaacgtaggggtcgggaggaagggacggaacgtaacggtggtcggcgtacggcctaccgtacgtcgttcgttacttaccactttcccgttccccgcttacgtacctacgaacctagttaacgg

SEQ ID NO: 23700 - DNA, 624 bp, Homo sapiens
  misc_feature: GYAE6OF02IJBDZ.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcagggccagccggagtgttagtaagtactaggctaggtaccaacagaaacctggccaggctcccaggctcctcatctatgatgtctccaacagggtcacgtggccgtccccgctaggttcagtggcaggtggtctgggacagtactcactctacgaccgtcagcacgcctaagcgactagaagtattttgacttacttttattctagtactaaacgtacttaagtcggttacgacgtcggtccttaccgtacttacgttttcggaccgtaacgggtaacctaaacgtacggaactaacgtaacgaaaaccgtaacgttgtacggacttacggaccgtaaccctagttaccttacgttcctttaccgactttaccccgttaccccggaccttacgtacctaaccgg

SEQ ID NO: 23701 - DNA, 613 bp, Homo sapiens
  misc_feature: GYAE6OF02HMIOC.24.35.D02.1.454.CMB.1.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
  modified_base (365)..(365): a, c, t, g, unknown or other
  misc_feature (365)..(365): n is a, c, g, or t
  modified_base (406)..(406): a, c, t, g, unknown or other
  misc_feature (406)..(406): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccacctctcctgcagggccagccggagtgttagaagtacttaggcttaggtaccaacagaaacctggccaggctcccgagctcctcatctatgactgtcctacaacgngggtcacgtcggccgtccccgctagggttcaggtcgacaggtggtctggacngacttcactctacacgtcacgcagcctagcgcctagaagtnttttcgacggtttacacgttgctagtcaggtccgttccgcgtcggcctcttaacggttcggggcggggtacaggggtggaacggaggtacggaaccgtaacggtggtacggtctcggacctaacgtacgtttccgtacgtttcgttacctacgttccccgtttaccccggaccttaacgttccgtaacgttaacgtaccgttaacgg

SEQ ID NO: 23702 - DNA, 576 bp, Homo sapiens
  misc_feature: GYAE6OF02JXS4O.24.35.D02.1.454.CMB.1.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (516)..(516): a, c, t, g, unknown or other
  misc_feature (516)..(516): n is a, c, g, or t
tcagactactatgtcacgaccggtgctcgatttagcacacgatagttgggtttgggggtagggaacgtgctcagttaggacccagagggaaccatggaagccccagctcagcttctcttcctcctgctactctggcctcccagatcgccaccggagacattgtgttgactacagtcctccagcccacctgtcttgtctcgagggaangccacccgtctcctgcgagggcctagngacaagtgttaggagtttgtagcctggtacncaacncaaacntggccaaggcctcccccggnttaccncgatctatgactgcatccaagtcggcctacnggctactcccgagaaccgtgttacaggtcggatacggtgggtctagggcaagcttacactcgtaccacgatcgagcgaggtgtcacgctgtaaagtnttgattaagttntacgttgaacgtgacgtacgtgtaacaccggttcgtaccctacggtttccgcccggtacgactacgcggtaacncacgtaaccgaaacggtcgtacgcgccttagcctaacgtactcggttactcgttaccgtc

SEQ ID NO: 23703 - DNA, 639 bp, Homo sapiens
  misc_feature: GYAE6OF02FZYBZ.24.35.D02.1.454.CMB.1.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcagggccaggccggagtgttagtaagtactaggctggtaccaacagaaacctggccaggcctcccgaggcctcctcatctatgatgtctaccgaacgngggtcacgtcggccgttccccgcgtaggttcaggttggctaggtcgggtctgggacagtacttcactctcaccgtcagcagcctagcgtcctagaagtatttcgacggtttactagtgtctacgcgtacgtccgttccgccgtcggtccgtacgttaacggtttccggggaccgggggtaccgtaggggtcgggaacggacggggacgtaaccggtaacgtggtacgggtcgtcgaccgtacctaggttccgttacgtttccgttacgttaccgtttcccgttacccgccttaacgttcccgtaacggtaactagttaacgg

SEQ ID NO: 23704 - DNA, 788 bp, Homo sapiens
  misc_feature: GYAE6OF02HU2D8.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagataccactggagaagtagtcatgacgcagtctccagccacctgtctgtgtctccgaaggggaagagccacctctcctgcagggccagtgagaatgttggcagcaactttagcctggtaaccagaccaagaaaccgtggccaggcctacccaggcctcccgtcctctagtcgcctgtcctaccaccgacgggtccccgttggtaccgtcccgacggtacccgtaggggtttccggttgggggtaccgggttcggggttcccggtaggggtacgtacggttaaccgtttttccgaacccgtttcctaccaaacccgtgttacccgacgggtccccgggtaccctaccgtacggttaccgtacggtaaagttacgttttcgtactttacgttttactttcgtttacgtaaccttaactacttacgttacgggtacgtacgtaccggttcccgttacccggttacccgtttaccggtttttacgggacccggttaaccgggggtaacccgtaaacgggttacgggaaacgtaacgttaacccggaaaacgtaaccggtttacgggtaaccggtcggttaccggaacctacccgttaccgtttcgttccgtttacccgttttaccgtaccttttaccccggttacccctaaccg

SEQ ID NO: 23705 - DNA, 544 bp, Homo sapiens
  misc_feature: GYAE6OF02HKWAE.24.35.D02.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (393)..(393): a, c, t, g, unknown or other
  misc_feature (393)..(393): n is a, c, g, or t
  modified_base (434)..(434): a, c, t, g, unknown or other
  misc_feature (434)..(434): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagaagtacttaggctggtaccaacagaacctgccaggctccaggctcctcatctatgatgtctccaacngggtcacgtggctccccgcaggttcagtcggcaggtgggtctgggactaggcttcgactctcacgtcagcagcctagcgctgaagtnttttgcggtttactacttgtcagcagtcttccgctcggccncttaccgttcgggcggggaccaggggtggaggaggagacgaacgtggtaggctgcacgacgtctcgttctctacgttccctcccgtcctattcgtacgtactagttacgg

SEQ ID NO: 23706 - DNA, 706 bp, Homo sapiens
  misc_feature: GYAE6OF02GR62O.24.35.D02.1.454.CMB.1.raw
  modified_base (198)..(198): a, c, t, g, unknown or other
  misc_feature (198)..(198): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (392)..(392): a, c, t, g, unknown or other
  misc_feature (392)..(392): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccacggagaattgagttgacacagtctcaggcacctgtctttgtctccgagggganagacgcccacctctcctgcagggccaggccggagtgttaagtaagtacttaggctggtaaccaanagaaacctggaccaggctcccgaggctccncatcatgatcgtccaccgaacgagggttccacgtcggccgtccccgacgtaggttcaggtgcgaggtcggtctgggacacgacttccactctcaccgtnacgcacgtcctagaccgtccgtagtaaacgtagttttcggtacggttttactacgttcgtacgtagcgtacgtccgttccgaccgtcgggtcccgtacgttaacccgggtttcggggaccggggggtacccgtaaggggttacgggacgggtaacggggaacgtaacgggtaaaccggttgggtacggtaccgttacggacccgtaaccgttaacgttaccggttacggtttacccggtttaacctaccgttttccccgtttaccccggtaaccgtaccgtttcccgaaccggttaaccgtacgtttaacccgg

SEQ ID NO: 23707 - DNA, 620 bp, Homo sapiens
  misc_feature: GYAE6OF02H4Q9Y.24.35.D02.1.454.CMB.1.raw
  modified_base (202)..(202): a, c, t, g, unknown or other
  misc_feature (202)..(202): n is a, c, g, or t
  modified_base (447)..(447): a, c, t, g, unknown or other
  misc_feature (447)..(447): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaatttgtgttgacacagtctccaggcaccctgtctttgtctccagggganagagccaccctctcctgcagggccagtcagagtgttagcagcagctacttagcctggtaccagcagaaacctggcctggctccaggctcctcatctatggtgcgtccacacgggccaactggcgtcgcggacaggttcagtggcaggtgcgtttgggacagactttcactctcatcactcgaacacgacttggacgacccgaaagtactttgctaagttgttatttactgtacgtacgtacgttnttttggtccccttcttaccccgttcctttaaacttcggttaaaccttaccgtttttcggacccgtaggggttttaccccagggttccgttaggggtaacgtaacgttacgtaaaacggtaccgaaacgtttcggtacgggtaccttacgggacccttaacccgatttacccgg

SEQ ID NO: 23708 - DNA, 560 bp, Homo sapiens
  misc_feature: GYAE6OF02IN2YQ.24.35.D02.1.454.CMB.1.raw
  modified_base (202)..(202): a, c, t, g, unknown or other
  misc_feature (202)..(202): n is a, c, g, or t
  modified_base (414)..(414): a, c, t, g, unknown or other
  misc_feature (414)..(414): n is a, c, g, or t
tcagactactatgtcacgaccggtgctcgatttagcacacgatagttggggtttgggggaggaactgctcagttaggacccagagggaaccatggaagccccagctcagcttctcttcctcctgctactctggctcccagagacgaccggagaaattgtgttgacacagtctccaggcaccctgtctttgtctcaggggaanagccaccctctcctgcagggccagtgacaatgttaggaagttgttagcctggtatcaacacaaacatggccaggcctcccccggctccctcatctatgatgcatccaagtacgggccacgtggcactcccagactaggttcaggtggctaggtcgggtcgtgggacagtacttacgactcctcacatccagctagtgtagacgctagagttntttgactagtttatactcgtacagctaccgtgactacgtcgaccctacgtttccgccgtcggaccaggactcggacacgtaccgaacgtaacgtggtacgctacgacctactacgtcttcgtaccttctaccgttcccgtaccccg

SEQ ID NO: 23709 - DNA, 679 bp, Homo sapiens
  misc_feature: GYAE6OF02IGBPO.24.35.D02.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
tcagactactatgtcacgaccggtgctcgatttagcacacgatagttgggtttgggggagaactgctcagttaggacccagagggaaccatggaagccccagctcagcttctcttcctcctgctactctggctcccagagaccaccggagaaattgtgttgacacagtctccaggcaccctgtctttgctccaggganagagcccacctntcctagcagggccagccggagtgttagtaagtacttaggctaggtaccaacgagaaacctggaccaggcctcccgaggtcctccgtactactctactgacttcgtacctacaacggtacgggtcaccgtcggtacccgtccccgcgtacggttcaggttcgacgtaggtcgggtacgtcggactacgtccttcaccttcgaccgtaccgtcacgcgtaccgacctaaggccgtacctaggtaacgtttacgttttcggttaccgtttaactcgttcgtacgacgtccgtacgttcccgttacccgtcggtacggtacccttacgtttaccgggttcccgggggaggggtaccgtaggggtaccggaggtacggtaagccgtaaggtcggacgtcgtacgccaacgtcgtaacgttctacgttacctacgtccccgtcccgtatacgtaccgtacgtacgtagttaacgg

SEQ ID NO: 23710 - DNA, 583 bp, Homo sapiens
  misc_feature: GYAE6OF02GZI7T.24.35.D02.1.454.CMB.1.raw
  modified_base (498)..(498): a, c, t, g, unknown or other
  misc_feature (498)..(498): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggaccaacacgaaacctggccacggctcccgaggcctcctcatctatgatgtcctaccaacgtagggtcacgtcgggccgtccccgctagggttcaggtggctaggtgggtctgggacacgacttcactctacgaccgtcacgcacgcctaggactcgtagaagttcgttttcggtcggtttaacttacgttgtctagcacgtccgttccgccgtcggccgtcttacggttcgggcggggtacgngggtcggagacggagacgacgtggtcgcgtgccactagtcgtgttcctctcttccgtccgcctattccgacgtaactagtaacgg

SEQ ID NO: 23711 - DNA, 553 bp, Homo sapiens
  misc_feature: GYAE6OF02H74HE.24.35.D02.1.454.CMB.1.raw
  modified_base (200)..(200): a, c, t, g, unknown or other
  misc_feature (200)..(200): n is a, c, g, or t
  modified_base (403)..(403): a, c, t, g, unknown or other
  misc_feature (403)..(403): n is a, c, g, or t
  modified_base (479)..(479): a, c, t, g, unknown or other
  misc_feature (479)..(479): n is a, c, g, or t
  modified_base (523)..(523): a, c, t, g, unknown or other
  misc_feature (523)..(523): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccagggganagagccaccctctcctgcagggccagccggagtgttagtaagtacttaggctggtaccaacagaaacctggccaggctcccaggctcctcatctatgatgtctccaacgagggtcacgtcgggccgtcccccgctaggttcaggtggcaggtcgggtctgggacagcttcactctcaccgtcagcagcctagcgcctgaagtntttgcggtttactagtgtcagcgtacgtccggttccgccgtcggcccgtcgtaacggtttcgggccgggggtaccnggggtaggaggaggagacgaagtgtggctgcacatctgtcttcncttccgtcccgctactctagactattacgg

SEQ ID NO: 23712 - DNA, 718 bp, Homo sapiens
  misc_feature: GYAE6OF02F4KIP.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccacctctcctgcagggccagccggagtgttagtaagtacttaggctggtaccaacagaaacctggccaggctccgaggcctcctcatctaatgattcgtactaccgaacgtaggggtccacgtcgggacctccccggctaagggttcaggtggactaggtgggtctgggacacggtacttcgaccttctaccgaccgtcagcctacgcctagacgcctagaacgttatttgactaactttacttacgtacgtacctaaactaggttaactcgtattacggtacctttaaccgtccccgtaaccgtttccgggacccggtaacgggggtaacctaaccggtaacgttaacgtaaaccgttaacgttaaacggtaccgtaaacgtttcggtacgggtacccgttacggtaacccctaaaccgttacgttacccgtttacggtttaacccttttaccggtaacccttttaccccggtttaccccggtaccctttacccggtttacgtaaacccgg

SEQ ID NO: 23713 - DNA, 578 bp, Homo sapiens
  misc_feature: GYAE6OF02GAQ11.24.35.D02.1.454.CMB.1.raw
  modified_base (204)..(204): a, c, t, g, unknown or other
  misc_feature (204)..(204): n is a, c, g, or t
  modified_base (360)..(360): a, c, t, g, unknown or other
  misc_feature (360)..(360): n is a, c, g, or t
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagaatgttggcagcaacttagcctggtaccagcagaaacctggccaggctcccaggcctcctcctctatgctgtcctccaccgacggcccctggtcgtcccagccaggttcgtggcggtgggtctgggacnggtactttcactctcacatcacgcgcctcgacgtctagaagtatttcgctactttactttctgtactaactacttagtggtgactcggtcccttcgtacttacgttttcggaccggtacgggtaacctaacgtcggactacgtacgaacgtacgtaggtcgtcgtacgacctaccgtagttcgttcgtaccttacgtaccttccgttaccccgtaccg

SEQ ID NO: 23714 - DNA, 695 bp, Homo sapiens
  misc_feature: GYAE6OF02G204O.24.35.D02.1.454.CMB.1.raw
tcagactactatgtcacgaccggtgctcgatttagcacacgatagttgggtttgggggaggaactgctcagttaggacccagagggaaccatggaacgccccagctcagcttctcttcctcctgctactctggcctcccagagaccaccggagaaattgtgttgacacagtctccaggcaccctgtctttgtctccgaggggacagagcccaccctctccgtgccgagggcccaggccggagtgttaagtaagtacgttaggctggtaccaagacgaaacctggaccaggctcccaggcctcctcatctatgactgtccaccaacgagggtcacgttcggccgtccccgctaggttcaggtggcctaggtcggtctagggacaggtcgttcacgttcgtacaccggttcaacggtcacgtcctaagacgtcctagtaacgtcttttacggaccgttttacacgttgtcaaggtacgtacggtccgtttaccgccgttacgggccgttacgtttaaaccggtttccggggaaccgggggtacctaggggtacgggtaacggtaacgggtacggaaccgtaacggttcggtcggtacgtcggacgtaccggtacgttacggttagttaccttaccggtaacctttcccgttacccggtccgttaaccgttaccgttacggtaaccttacgttaacgg

SEQ ID NO: 23715 - DNA, 710 bp, Homo sapiens
  misc_feature: GYAE6OF02G37GG.24.35.D02.1.454.CMB.1.raw
  modified_base (202)..(202): a, c, t, g, unknown or other
  misc_feature (202)..(202): n is a, c, g, or t
  modified_base (397)..(397): a, c, t, g, unknown or other
  misc_feature (397)..(397): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcagggccagccggagtgttagtaagtacttaggctaggtaccaacgagaaacctggaccaggcctcccgaggcctcctcattctatgatcgtctaccaacgagggtccacgtcggcccgtccccgctaggttcagtcggctaggtcgggtctggactagtacttcactcacgaccgtnacgcagcctagacgtccgtagaacgttgttttacggtaccggttttaacctacgttcgtacgacggtaccgtacggttcccggtttcccggacccgttcgggaccccgttacgtttaacccggtttccggggggaccggggggtaaccgtaggggggttcggaacgggaacggggtaaccggaaccgggtaaacgtcgggtaccggacgtacggaccgtaacccgtagttcccgttacgttacctttccgtaaccgttttccccgtaccccggtacctaccgttacccgtaacggaacccgttagtttaacgg

SEQ ID NO: 23716 - DNA, 212 bp, Homo sapiens
  misc_feature: GYAE6OF02FXE1X.24.35.D02.1.454.CMB.1.raw
  modified_base (205)..(212): a, c, t, g, unknown or other
  misc_feature (205)..(212): n is a, c, g, or t
tcagactactatgtcacgaccggtgctcgatttagcacacgatagttgggtttgggggaggtgtgtcacaagatttgggctctgggcaccgtgggcacgggggaggtgtgtcacaagatttgggctctgggcacagcggccctgggctgcctggtcaaggactacttccacatagtagtctgagcgggctggcaaggcgcatagnnnnnnnn

SEQ ID NO: 23717 - DNA, 713 bp, Homo sapiens
  misc_feature: GYAE6OF02IL07P.24.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (347)..(347): a, c, t, g, unknown or other
  misc_feature (347)..(347): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgccagggccaggccggagtgttagtaagtcttaggctggacanagaaacctggccatgctcccaggctcctcatctatgatgtctccaacgagggtcacgtggccgtccccgctacggttcaggtcggnaggtgggtcgtgggacagaccttcactctcaccatcagcagtgtagagcctagagtattttcgacttagtttacttacgttgtacgtacgtaccgtaacggtacgtaaaccgtaaccgtacccgtacccgtttacccggtttcccgggtaccccggttaaccgggtaacccgtaaccgggtacccgtaaccgggtaacccttaaaccggtaaaaccccggtaaaccggtaaccggttacgggttacccggtccggtaacccggtaaccccgtaacccgttaccgttaccggtttacccgtttacccgttaccgttaaccccgttttcccccgtttacccccggtacccttaacccgtttaacccgg

SEQ ID NO: 23718 - DNA, 791 bp, Homo sapiens
  misc_feature: GYAE6OF02HTU7Y.24.35.D02.1.454.CMB.1.raw
  modified_base (168)..(168): a, c, t, g, unknown or other
  misc_feature (168)..(168): n is a, c, g, or t
  modified_base (218)..(218): a, c, t, g, unknown or other
  misc_feature (218)..(218): n is a, c, g, or t
tcagactactatgtcacgaccggtgctcgatttagcacacgatagttggggttttggggggaggaacgtgctcagtttaggacccagtaggggaaccactggaagccccagcctcaggcttctcttcctcctgctactctggctccagagaccaccggtagaaattgngttgacgtactagtctccaaggtacaccctgtctttgtctccgagggganagagccgacccgtcgtccggtgcgtaggggcccagggcccggggtacgttagttaacgtaacgttaccttaaggtcgttagggtaacccaaacgacggtaaaacccgtgggaccctaggaccttaccccgagggtaccttcccgtcacgttaccttaagttacgacgtttcggttaccctacccgaaacggtcggggttaccgaaccgggtacgggccccgttccccggaccgtacgggtttcgacggttcggacgtaggtcgggtactgggactagtacctcactctacgaccgtcacgctacggcctaaggcgccgtaggtaacgtagttttcggtacgtttaactacgtagtacgagtctacgtccgttcccgaccgtcggtcccgtacgttacggtttcggggaccggggtaacgtaggggtacggacggaacggtaacggaaccggtaacggtcggacggtacgttacggaccttaaccgtagtccgttaccggtactttacccgacgttttaccccgttaccccgttaccgttaacgtttccgttaaccggacctttaagtaaccgg

SEQ ID NO: 23719 - DNA, 737 bp, Homo sapiens
  misc_feature: GYAE6OF02HRVKW.24.35.D02.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagactactatgtcacgaccggtgctcgatttagcacacgatagttgggtttgggggacggaactgctcagttaggacccagagggaaccagtggaagccccagctcagcttctcttcctcctgctactctggctccagagaccacggagaaattgtgttgacacagtctccaggcaccctgtctttgctccgagggganagacgccaccctntcctgcagggccaggccggagtgttagtaagtacttaggctggtaccaagacgaaacctgggaccaggcctaccccgaggtccttccgtcacttactagtgaacttcggttcctacccgaaacgtaggggtaccaccgttggccccgtcccccggaccgttagggttccaaggtcggactacgggttcgggtcgtaggggaccacggtacttccacttcctccgaccgtcaacgccgacgtccctaggacgtacccgttaggaaagtttcgtttttacggaccggttttactaacgttcgtacgacgtcgtaacggtccggtttcccgaccgtccgggtacccgtacgttaaccggttttccgggggaccgggggtaccgtaggggttacgggacgggtaggaaccggtacgtaaccgggttgtacggcgttacgaccgacttacgttccgttagttcccttacgtcccgtttccggttaccccgacttcgttacccgttaagaacccgttagtttaacccgg

SEQ ID NO: 23720 - DNA, 615 bp, Homo sapiens
  misc_feature: GYAE6OF02HD9CT.24.35.D02.1.454.CMB.1.raw
  modified_base (316)..(316): a, c, t, g, unknown or other
  misc_feature (316)..(316): n is a, c, g, or t
  modified_base (404)..(404): a, c, t, g, unknown or other
  misc_feature (404)..(404): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagccaccctctcctgcagggccagccggagtgttagtaagtacttaggctggtaccaacagaaacctggccaggctcccaggcctcctcatctatgattgtcctaccaacgngggtcacgtcggccgtccccgctaggttccaggtcggctaggtcgggtctgggacagtacttcactctcgacgtcagcagcctagacncgtagagtattttggcggtttactcgtgtacagctacgtccgttccgccgtcggcctacgttaaccggttcggggacgggggtaccgtaggggtcggaggaggaacgacggtaacgtggtacggacgtggacctaccgtagttcgttacgttccttactaccgtttcccgttcccggaccttacgttaccgtacgtaaccgtagttaacgg

SEQ ID NO: 23721 - DNA, 614 bp, Homo sapiens
  misc_feature: GYAE6OF02GYXN5.24.35.D02.1.454.CMB.1.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
  modified_base (313)..(313): a, c, t, g, unknown or other
  misc_feature (313)..(313): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcacctgtcttgtctccagggganagagccaccctctccgtgcagggccaggccggagtgttagtaagtacttaggctggtaccaanagaaacctggccaggcctcccgaggctcctcatctatgatcgtctaccaacngggtccacgtcggccgtccccgcgtaggttccaggtggacagggttcgggtcgtgggaacagtacttcacgttcnccaccgtnacgcaagccctaagcgtctagaagtagtttggtaccggtttactacttgtacagtcgtagtccgttccgccgtggcccgtacttaccggttccgggacgggggtaccaggggtcgggaggtacgggacggacgtaacgtggtcggctcggacacgtacgtcgttcgtccgttactacgttcccgttacccgctacttaccgtataaccgtattaacgg

SEQ ID NO: 23722 - DNA, 646 bp, Homo sapiens
  misc_feature: GYAE6OF02IOGP8.24.35.D02.1.454.CMB.1.raw
  modified_base (213)..(213): a, c, t, g, unknown or other
  misc_feature (213)..(213): n is a, c, g, or t
  modified_base (428)..(428): a, c, t, g, unknown or other
  misc_feature (428)..(428): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccggagaaattgtgttgacacagtctccaggcaccctgtctttgctccaggggagagagccaccctntcctgcgagggccagccggagttgttacgtaagtacttaggctggtaccaacagaaaccgtggccaggcctaccgaggctcctcatctatgattcgccttaccaacgtaggtccacggtcggccgtacccccgctaagggtttccaagggtcggactagggtcgggttcgacggtacaagtcttacaccgtctcgaccgtcaagccagcctagcnctagagtatttgacgttatacgtgtacagctacgcgttccgtccgtacggccgtacgttaccggttaccgggcgggggttaccgacgggttacgggaacggacgggtacggaacggtaacgtggtacgggacgttcgaccgtaccgtaggtacctcggttacttccgtaccttcccgttccgacccgttactaccgttaacgaccgttagttaaccgg

SEQ ID NO: 23723 - DNA, 630 bp, Homo sapiens
  misc_feature: GYAE6OF02FPDO6.24.35.D02.1.454.CMB.1.raw
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctcgagggganagngcccacctctcctgcagggccagccggagtgttagaagtacgttaggctggtaaccaanagaaacctggccaggcctcccaggctcctcatctatgatgtctccaacgagggtcactggccgtccccgcaggttcaggtggcgtaggtgggtctggacngtacttcactctcaccgtnacgcagcctagcgcctagaagtatttggtacgtttactacgtgtcgacgtcacggtccgttccgccgtcggtcccgtactttaacggtttccgggccgggggtacgtaggggtacgggagggtacgggaacggtacggtaaccgttgggtacgggacgtcggtaccaccgtagttaccgtcgttccgtttaccaccgtttcccgttccccgtaccttacgttaccgtacggtaaccttaggttaacgg

SEQ ID NO: 23724 - DNA, 663 bp, Homo sapiens
  misc_feature: GYAE6OF02GTCL5.24.35.D02.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
  modified_base (547)..(547): a, c, t, g, unknown or other
  misc_feature (547)..(547): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcagggccagccggagtgttagtaagtacttaggctggaccaanagaacctggaccaggcctcccgaggcctcctnatctatgatcgtctccaacgtacgggtccacgtcggccgtcccccgctagggttccaggtcggcctaggttcgggtcctagggacacgtacttcaccttctaccgaccgtcacgcacgtcctaagacgtaccgtagtaacgttgttttacggaccggttttactacgttgtaccgagtctacggtccgttccgcgtccggccgttacgttaaccgggtttcggggaccgggggacgtacggggtggaacgggngggaacgtaaccggtaacggtggtacgggccgtacggccgtaccgtagttccgttcgttaccttccgtaccgttcccgttacccgacctacgttaccgtacgtaacgtagttacgg

SEQ ID NO: 23725 - DNA, 640 bp, Homo sapiens
  misc_feature: GYAE6OF02H8LQT.24.35.D02.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
tcagactactatgtcacgaccggtgctcgatttagcacacgatagttgggtttgggggaggaactgctcagttaggacccagagggaaccatggaagccccagctcagcttctctttcctcctgctactctggcctcccagagaccaccggagaaattgtgttgacacagtctccaggccaccctgtctttgctccgngggganagagccacctctcctgcagggccagccggagtgttaagtaagtacttaggctggtaccaacagaaacctggcctggcctccaggctcctcatctagtggtcgcgtcccaccgacgggccacgtcggccgtcggacggaccgtagggttcaggtcggctaggtcgggtcgtttagggactagtacttcgactctcatcatcgacacgacgtcgggacgaccgaagttacttttcggacgtaggttgttaatttacgttgtacgtaggtccgtttcgttttcggttcccttccgttccgttacctagttcgttaaccgttacggtttttccgaccggttacgggttccgtagggtctaggagtactacgacgtacgtacgtggtcgtcgtccgactacctacgttccgttcgttacctcgttaccttccgttaccccg

SEQ ID NO: 23726 - DNA, 677 bp, Homo sapiens
  misc_feature: GYAE6OF02FWIG7.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagccacctctcctgcagggccagccggagtgttagtaagtacttaggctggtaccaacagaaacctggccaggcctcccaggcctcctcatctagtgatcgtacctccgaagacgggtccacgtcggcccgtcccccgcgtaggttcaggtcggcgtaggttcgggtctgggactaggtacctttcaccttcctaccaccggtcacgctacgcccgtaggacgtcctaggtaagttagttttcggtacggttttactacgtcgtacgtagtcgacgtccgttccgccgttcggccgtacgttaaccggtttccggggaccgggggtaccgtagggggtacgggaacggacggggtaacggaacggtaacgtcggtacgggtcgtcggtaccgaaccgtacgttccgttacgttccttaccgtaccgtttcccgttacccgtccttaccgttccgtacgtaacctagttaacgg

SEQ ID NO: 23727 - DNA, 879 bp, Homo sapiens
  misc_feature: GYAE6OF02J11HV.24.35.D02.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtcctccagggganagagccaccccgtntccgtgccaagggcccaggcccggagttcggtttacgaaacggttacttagggccttagggtaaccccaaacgacggtaaaacccgttcggacccgtaacggcctttaccccggaacgggtcccttacccgttcccccttaccgttaacgttcggccgttcggttcccttacccgaccccgtaaccgggtccccccgttgggttccgttccccgaacggtcccgtaacggggtttccgttacggggtccgggttacgggttccggtcggggaaccgtaggtaaccgttttccgtaaccgttccctttaccaacccgtacgttacccgtaacgggtcccggccctttaccccgtacggttacccgttacgggtaaagtttacgtttttacggtcctttaaccgttttttaacttttccgtttacggtttaccctaaacttaaccggtttagttacgggttcgtaaccgtttccggggtaccccttacccggtttaaacttccgtttttacggacccggtaacggggtaaccctaaaccggttacgggtaactaacgtaaccgtaaacgtacctacggtcggtactccgacgtacccttaagtccgttagtctttaccaccgtttccgtcccgtacctagtttccctacggtaacttcgttaacg

SEQ ID NO: 23728 - DNA, 695 bp, Homo sapiens
  misc_feature: GYAE6OF02G9605.24.35.D02.1.454.CMB.1.raw
  modified_base (202)..(202): a, c, t, g, unknown or other
  misc_feature (202)..(202): n is a, c, g, or t
  modified_base (433)..(433): a, c, t, g, unknown or other
  misc_feature (433)..(433): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcgagggccagccggagttgttagagtacttaggctaggtaaccaacgagtaacctgggccaggtcctccgaggcctcctcatctagtgattcgtccacccgaagtcgggtaccaccgttggaccccgtccccgacgtaggttccaggttcggactagggttcgggtcgttagggaccaacgttaccttcgaacctttcctaccgtacccgtnacggcacggccgttagacgtccgtagtaacgttagttttcggtacgttttacacgttgtaccagtcgtagtccgttccgccgttcggccgtacgtttaaccggttcggggaccgggggtacgtaggggtacggagggaggaaccgtacggtaacgtcggtacggactacggccgtacgtacggttccgttacggttccttaacgtcccgtttcccgttaccggtaccctacgtttcccggtaaacgtcttaacggttaacgg

SEQ ID NO: 23729 - DNA, 770 bp, Homo sapiens
  misc_feature: GYAE6OF02I6SCZ.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagatgccaccggagacattgtgttgacacagtctccagccaccctgtctttgtctccagggganagagcccaccctctccctgcgagggccagtcagagtgttagcagcagctacttagcctggtaccagacacgaaaccgtggcctggcctcccgaggtcctccgtcactctagtcggtcgccgtacccgaccgacgggccacggtcggcggtccggcggaccgtacggtttcaagggttcggacgtagggttcgggtacgttttacggggaaactacggttaccgttaccgtaaccttccgtttacacgtttacctaacgtacccggaaactaaccgggtacgttacgggggtaacccgtaaccccggtaaaggtttaccgtttttacggacttaagggtttacgtttaacgtttaccgtttcgggttaccgaaccggtttcggtttcgggtttttaccgggtcccccttttccgtttaccccgtttaccgttaactttcggttaacccgtttaccgtttttacggggacccgttaaccggggttttccacggggttcgttaagggaacgtacgttaaccgtaacggtaccggtaaccgttgggtaccggtccttacggacccttaacccg

SEQ ID NO: 23730 - DNA, 684 bp, Homo sapiens
  misc_feature: GYAE6OF02JAAVF.24.35.D02.1.454.CMB.1.raw
  modified_base (270)..(270): a, c, t, g, unknown or other
  misc_feature (270)..(270): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccacccctctcctgccgagggccaggccggtagtgttagtaagtacttaggctggtacccaanagaacctggccaggctcccgaggtcctcctcatctatgatcgtctaccgaacgtagggtcacgtcggcccgtccccgccgtagggttcaggtcggctaggttcgggtctgggaactggaccctttcaacgttctaccaacctacgtcgacgcgtaaggttcggtaacgacgtccgtaaggtaacgttattttgtcgttagttttaatttacgttagtacgtacgtaccgtaccggttacgacctaaccgtccggacccgtaccgtttccggacccgtacgggtaccgaacgtacgtacggacctacgttaacccgaacgtaacgttcgtacggtcgtacgacccgtacctacgttccgttcgtttacccttaccgtaccgttcccgttaccccgtaccctacgttaccgtaacg

SEQ ID NO: 23731 - DNA, 231 bp, Homo sapiens
  misc_feature: GYAE6OF02IAGLF.24.35.D02.1.454.CMB.1.raw
  modified_base (220)..(231): a, c, t, g, unknown or other
  misc_feature (220)..(231): n is a, c, g, or t
tcagactactatgtcacgaccggtgctcgatttagcacacgatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggacaaggcgcatagnnnnnnnnnnnn

SEQ ID NO: 23732 - DNA, 887 bp, Homo sapiens
  misc_feature: GYAE6OF02FS5HI.24.35.D02.1.454.CMB.1.raw
  modified_base (793)..(793): a, c, t, g, unknown or other
  misc_feature (793)..(793): n is a, c, g, or t
tcagactactatgtcacgaccggtgctcgatttagcacacgatagttgggtttgggggagggaactggctcccacgttagggtaccccaggagggtaaccatggtaaggccccagctacagcttctcttcctacctgactactctggctcccgagtaggaccaccggagaacttggtttcgtttgtacactaagtttacgtccgacggctaccgtgtcgtttgtcctccgaggggtagaggagcccgtacccgggtcgtcccgttggccacgggcccgtaggggtccccggaggttacggttaacgttaacggttaccgtttaagggtccgttacgggtaaaccccaaccgtaacggtaaaacccgttggaccccgtaaccgggtccttaaccccggtaaggttaccctttcccgtactaacttccgtaatcggtacgtccgtaccctaccgaacgtacggggtaccgacggtcggccgtacccgcgtacggttcgtaaggtcggtacgtagggtacgggttacgtcgggaaactaacggtaccttacgaactttccgttacgacccgtactaacgtcgtacggtaccgtaacgggacgtccgtaagtaaacgtcgtttttacgccgggttttaacctacggttactaccgtaagaccgtacgttcccggttaccgccgttacggtccccgttaagttaaccggttccgggggaccggggtaaccgttaggggtacgggaaggtacgggaccgtaagggtaccgttgggcggtactacggtacccttaaccgnggtttaccggtcgggttaccgttaccgtacgtttaccccggtacccgttacgttaacggtttcggtaaccgggtaacggtaccgttaaccgggg

SEQ ID NO: 23733 - DNA, 909 bp, Homo sapiens
  misc_feature: GYAE6OF02JUS0E.24.35.D02.1.454.CMB.1.raw
  modified_base (243)..(243): a, c, t, g, unknown or other
  misc_feature (243)..(243): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctccagagaccaccggaagtaaatttgtggtttagaacacgacgttctaccaggcctacccgttgttccgtttagtcctaccggaggggtagagtacgccccacccgttntacctacgcgacgggccaaggcccggtaggttcgtttaaggtaaacggtttaccttaggggtccttagggtaaccccaaacgaacggtaaaccccttgggaccccagggaccccttacccggaagggtcccttcccgttaaccacgtttccttaacgtagtactttaccggtacccttacccgaaacgtcggggttaccaccgttcggggaccccgtaccccccgtcttaacgggttttcccgaaggttcgggtaccgtagggtacgggtttaccgacggggtacaacggtttaccttacctccggttcccttaccggtacccgtacgaccggtaccgtaacggtcccgtaaacggtacccgtaccggttacgttaaacggtttcgttttttacggacccggttttaacgtaccgtttacgacgtaacgtccgtaacgggttccgtttacccgtccggttaccggccccgtttaacgtttaccgggttacccgggggtccgggggtaacccggtggggtaccggggtaaggtaaccggggtaaccggtaaccggtaacggttcgggtacggtacgtccggtaccaccggttacgtcggttcgtttaccttccggttacttcccggttcccgttccaaccgttcgttaaccgtaacctggttaaccc

SEQ ID NO: 23734 - DNA, 718 bp, Homo sapiens
  misc_feature: GYAE6OF02I9MWG.24.35.D02.1.454.CMB.1.raw
tcagactactatgtcacgaccggtgctcgatttagcacacgatagttgggtttgggggaggactgctcagttaggaccagagggaaccatggaagccccagctcagcttctcttcctcctgctactctggctccagataccactggagaaatagtgatgacgcagtctccagccaccttgtctgtgtctccgagggtaaagcgccacctctcctgcagggccagtcagagtataagaagcaactacgttagcctaggtactacaacgaacgtaaaccgtggacctaggcccttacccgaggtccctacccgtactacttacgtacgtttacggtaactagttccccgaaggaccgaacggggtccctaacgtgggttacccgtcccgaagccccgtaaggttccagggtacggtcgtagggttacggggtttaccagggggtactaacgggttagttacccgtacgttacccgtcctaaaccggtataccgtaacgtccgacgttacttccggattacgggtaccttaggtaaaccgtttgttttaccggacgttttaaacgttttacgttacgtacccgaccttacggacttcggaactaaccgtggtacgtaccgtcggacccgttcgtacctaacgggtttccggagggaaccggtaacgtaagggtcgaagtaacgacgtaaagtcgtagggtccgataccggactacgtaacg

SEQ ID NO: 23735 - DNA, 906 bp, Homo sapiens
  misc_feature: GYAE6OF02IHNQK.24.35.D02.1.454.CMB.1.raw
  modified_base (198)..(198): a, c, t, g, unknown or other
  misc_feature (198)..(198): n is a, c, g, or t
tcagactactatgtcacgaccggtgctcgatttagcacacgatagttgggtttgggggagaactgctcagttaggaccagaggaccatggaagccccagctcagcttctcttcctcctgctactctggctcccagagaccaccggagaaattgtagttgacacagtctccaggcaccctgtctttgtctccagggganagagccacccgtctccgtcgcgagggccaggtcccggagttggttaagtaagttacttaggctcggtaaccaacgagaaacctggaccaggtcctcccgaggcctcctcattcgtatggattcgtcctaccgaacgtacggggttccaacgttcggcccgttacccccggacttaggtttccgaggttcgggtacgtagggttcgggtcgttacggggacctacggttacctttccggaacctttcgttaccgaacccggttccgaacggtcccggtacccgttccgtaacggtttcgtacggtaaacggtttacgtttttacggaccgttttaacgtttttaacgtttttcgttacgttaaccctaacgttaaccgttttagttacggggtttacgtaccggttaccgggttaccccgtttaccgggtttaacccgtttacccggttttttaccgggggaaccccgggtttaacggggggtaaaccccgttaaaacgggttaccggggtaacgggttaaaccctttaaccgggtaaaaaccgttaaccgggttacgggttaccgggttaccggtaacccggttacccgtaaacccggttaacctttaccgggtttaacccgtttacccgtttaacccgtttacctttacccccggttttacccccgtaccctttaaccccgttaccggttaacccgtttaaaaccgg

SEQ ID NO: 23736 - DNA, 685 bp, Homo sapiens
  misc_feature: GYAE6OF02IMALU.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagcccaccctctcctgcagggccagccggagtgttagtaagtacttaggctggtaccaacagaaacctggccaggcctcccaggctcctcatctatgatgtctccaacgagggtcacgtggccgtccccgcgtacggttcaggtcggctaggtgggtctcgggacagtacttcacttctacaccgtcacgcagtccctaagacgccgttaggaaagtacgtttttcggacggttttaactacgttagtcaggtcacggttccgttcccgtccgtcgggtaccctacgtttaaccgggtttccggggaccggggggtaaccgtagggggtacggaagggtaacgggaacggtaaccgtaacggtgggttcgggaccgttacgggaccctaaccggtacgttaccttcgggttacctttaccgtaacggtttcccctttcccggacccttacgtttacccggtaacgtaaccttaggttaacgg

SEQ ID NO: 23737 - DNA, 717 bp, Homo sapiens
  misc_feature: GYAE6OF02F6L02.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccacccttctcctgcagggccagccggagtgttagtaagtacttaggctggtaccaacagaaacctggccaggcctcccaggctcctcatctatgatcgtctaccaagcgggtccacgttggcccgtccccgcgtaggttcaggtcggtcgaggttcgggtcgtgggacaggtaccttcaccttctccaccgtcagcacgccgtagacgtcctagtaagtacgtttttagtacggttttaacgtacgttcgtacgtacggtccgtacggtccgttacccggtcccgttcgggtacccgttaccgtttaaacccgggttttccgggggacccggggggggttaacccggagggggttacggggtaacgggaacggggtaacggtaaacccgggttaaacggtcgggtcgggtaccggtcggtaccctaccggtacgttcgttccggttcgttacctaccgttccccgtttacccggaccgttacgttccctaacgtacgttaagttaacgg

SEQ ID NO: 23738 - DNA, 589 bp, Homo sapiens
  misc_feature: GYAE6OF02GEPZ9.24.35.D02.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
  modified_base (379)..(379): a, c, t, g, unknown or other
  misc_feature (379)..(379): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccagggganagagccaccctctcctgcagggccagccggagttgttagtaaagtcttaggctgggtaaccaacagaaacctggccaggctcccaggctcctnatctatgatgtctccaaacgnggtcacgtcggccgtccccgcaggttcagtggcagtgggtctggacagacttcactctcaccgtnagcagcctaagcgctagaagtattttgcgtttactactgtcagcagtccgttccgcctgaccgtcgtaacgtttccgggacgggggtaccgaggggtcggagtagggacgaacggtaacgtggtcggtcgtgacctaccgtaagttccgtacgttccttacgtaacgttcccttacccggtacctacttaccgtacgaactagttaacgg

SEQ ID NO: 23739 - DNA, 710 bp, Homo sapiens
  misc_feature: GYAE6OF02FTTBQ.24.35.D02.1.454.CMB.1.raw
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (408)..(408): a, c, t, g, unknown or other
  misc_feature (408)..(408): n is a, c, g, or t
  modified_base (671)..(671): a, c, t, g, unknown or other
  misc_feature (671)..(671): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgcccaccctctccctgccagggcccaggccggagtgttagtaagtacttaggctggtaccaanagaaacctggccaggctcccgaggcctccncatctagtgatgtcctccaacgtgggtccacgtcggcccgtccccgcgtacgggttcaggtcggaccgtaggtcgggtcgtgggacacgtcttccacttctcgaccgtnacgcacgtcccgtaaggactccgtaggtaaagtacgtttttacggtacggttttacctacgtcggtacgtacgccgtacggtccgttcccgcccgttacggtcccgtacgtttaaccgggtttccgggggaccggggggtacccgtagggggtacgggaacgggaaccgggtaagggtaaccgtaacggttggtcgggtactccggaccgtacccgtagttccggttacgtttaccgttacgtaccctttacccggttccccnccgttaaccgttaccgtacgtaaacgttacgttaacggg

SEQ ID NO: 23740 - DNA, 641 bp, Homo sapiens
  misc_feature: GYAE6OF02FPG7R.24.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (389)..(389): a, c, t, g, unknown or other
  misc_feature (389)..(389): n is a, c, g, or t
  modified_base (414)..(414): a, c, t, g, unknown or other
  misc_feature (414)..(414): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggctcccgaggctccncatctatgatcgtcctccaacgagggttccacgtcggccgtccccgcgtaggttcaggtggctaggtgggtctgggacagtacttcactctcaccgtnagcacgtcctagcgtcctagaagtnttttcggtacgttttaactacgtgtcgagtcacgtccgttccgcgttcggccgtacgttaaccggtttccggggaccggggggtaccgtagggggttcggaacgggagggtacggaaccggtaacgtggttcgggacgtcggtaccgaccgtacgttccgttacgttaccgtttccgtaccgtttcccgttcccgtacctagttcccgtagtaaccgtagttaacgg

SEQ ID NO: 23741 - DNA, 572 bp, Homo sapiens
  misc_feature: GYAE6OF02HU35P.24.35.D02.1.454.CMB.1.raw
  modified_base (245)..(245): a, c, t, g, unknown or other
  misc_feature (245)..(245): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacgcagtctccaggcaccctgtctttgtctccaggggagagagccacccctctcctgcagggccagtcagagtgttagcagcngctacttagcctggtaccagcaagaaacctggcctggctcccaggctcctcatctagttggtcgcgttcccaccgtagggcccacgtcggcgtcggccggacaggttcagtggcagtggctttgggacaggacttcactctcatcatcgacagactggacgccgaagtatttgcgtagtcgttattacgtgtacagtctggtttcgtcccttcttccctcttacttcgtaaccttcgttttcggacccgttacgggttcctacgggtcgttgggaacgtacgtactaacggtacgacgtggtcggtcctaggacctaccgtattccg

SEQ ID NO: 23742 - DNA, 708 bp, Homo sapiens
  misc_feature: GYAE6OF02I3CW1.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagccatcaccggaggattgtgttgacgcagtctccaggcaccctgtctttgctcaggggagagagcccaccctctcctgcagggccagtcagagtgttagcagcagctactagcctggtaccagcagaacctggcctggctccgaggcctcctcatctagtggtcgccgtccaccgagggccacgtggtccgtcggaccggtactagggttcagggtcggacgtaggtggtccgtttaggggacctaacggtacttccacgttcctactaagttccacgtaccgacgtaacgtacgtacgggaaccgtaccggtaagttacgttttacggacgttaacggttacgtttaacgtttacgttgttacgtacgtccgtttacgggttttcggttcccccttctttcccgtttaccgttacgttaccggtttaaccgtttacccgtttttcgggtacccgggtttacgggttcccggttacgggttaccggttacgggtaaccgtaacgttaaccgtaacggaccggttaacgggttcggttacggtccggttacgtacccgtaaccgttaaccg

SEQ ID NO: 23743 - DNA, 579 bp, Homo sapiens
  misc_feature: GYAE6OF02FIHMG.24.35.D02.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (297)..(297): a, c, t, g, unknown or other
  misc_feature (297)..(297): n is a, c, g, or t
  modified_base (433)..(433): a, c, t, g, unknown or other
  misc_feature (433)..(433): n is a, c, g, or t
tcagactactatgtcacgaccggtgctcgatttagcacacgatagttgggtttgggggaggaactgctcagttaggacccagagggaaccatggaagccccagcgcagcttctcttcctcctgctactctggctcccagataccactggagaagtagtcatgacgcagtctccagccaccctgtctgtgtctccaggggaaangccaccctntcctgcagggccagtgagaatgttggcagcaacttagcctggaccagcagaaacctcggccaggctcccaggctcctcctctatnctgtctccaccagggtcccctggtgtcccagtccgaggttcggttggcggtcgggtctgggacagactttcactcgttacacccatcacgcggcctcctagtctgaagtatttgctactttattctgtacacactntagtgtactcggtccgtccgtactacgttttcggaccgtacggggtaccaaaccgtggtagactacgtaaccgtaacgtcgtagggtcctacgtaccgacctacgttcgttacgttcctttaccgacttacccttacccgtacccg

SEQ ID NO: 23744 - DNA, 885 bp, Homo sapiens
  misc_feature: GYAE6OF02F0LXM.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccacccttctccctgcgagggccaaggccggagttgttaagtaagtacttaggcgtaggtaacccaacacggtaaacctggaccgaggcctcccgaggcctcctcatctatgattcgtccaccgaacgcgggttccacgtcgggccccgtccccgacgtacgggttcgaggttcggacgtagggttcggggtccgtaggggtaacctacgggtaacctttccgaaccgtttcccgtaccctaacccgggttcaacccgggtaccgtaacccgggttaccgttaacgggaccccggttaccggttaacggtaaaaacggtttttcggtttttttaccggggaaccccggttttttttaacgtaaccgttcgggtttaacccgaacgggtcccgtttaacggggttccccccggtttacccggtacccggttacggggtaccccccggtttacgtttttaaaccccggggtttccggggggggaaacccggggggttaaccgtagggggggttaacgacggggttaaaacgggggaccgtaaaccggggttaaccgtgggttccgggtaccttaccggtacccgaccgttacgttttccgtacggttaccctttaccggacttttccccgggttacccacgtttaccgtaccggtaaacttaaccgtggtttaaaccgg

SEQ ID NO: 23745 - DNA, 668 bp, Homo sapiens
  misc_feature: GYAE6OF02FII1N.24.35.D02.1.454.CMB.1.raw
  modified_base (264)..(264): a, c, t, g, unknown or other
  misc_feature (264)..(264): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattttgtgttgacacagtctccaggcaccctgtctttgtctccaggggagagagccaccctctcctgcagggccagccggagtgttagtaagtacttaggctggtaccaanagaaacctggaccaggctcccaggcctcctcatctatgatcgtcctaccgaacgcgggtccacgtcggccgtccccgcgtaggttcagtggctaggtgggtcgtgggactagacttcgacttctacgaccgtcacgcacgtacctagacgccgtagtaacgtagttttcggtacggttttactacgttgtacacgtcgacgtccgttccgccgtcggtccgtacgttaccggtttccggggaccggggggtaccgtagggggtcgggaagggacgggacggtaaccggtaacgttcgggtcggtccgtacggaccgtaccgtacgttccgttcggtttaccttccgttaccgtttccccgttaccccgtaccgttaccgttcgttacggtaactaggttaacgg

SEQ ID NO: 23746 - DNA, 586 bp, Homo sapiens
  misc_feature: GYAE6OF02JF5XY.24.35.D02.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
  modified_base (426)..(426): a, c, t, g, unknown or other
  misc_feature (426)..(426): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccgganaaattgtgttgacacagtctccaggcaccctgtctttgctccgagggganagagccaccctctcctgccagggccaaggtcgaacaagttggttaaggaagttgttagcctggtatcaaacacaaacatggaccaggccttccccggntacccgtcatctatgatcgcataccgaagtacgggcctacgtggacactcccagacgtaggttcagtggctaggtgggtctgggacagtcttcactctcactatcagctagtgagacgctgaagtntttgcttagtttattcgtagtctacgtcgtacgtataacaacgtcggacccttacgttccggacccgtagggacccaggtaccgtcggaacctacgtacccaagtacgttaggtcgtccgtagacccgtactcgttaccgttgtaccttcgtacttcccg

SEQ ID NO: 23747 - DNA, 937 bp, Homo sapiens
  misc_feature: GYAE6OF02FZ8IG.24.35.D02.1.454.CMB.1.raw
tcagactactatgtcacgaccggtgctcgatttagcacacgatagttgggtttgggggaggaactgctcagttaggacccagagggaacccatggtaagccccagctcagcttctcttcctcctgctactctggctccagagaccaccggtagaaacttgtgttgacactagtctccgaggtcctaacccgtgttacctttggtctccgagggggtagagacggcccacccgttcgtccgtggccggtacgggcccaaggtcccgggtagttcggtttaaggtaacggttacgttaagggccttacgggtaaccctaaacgaacgtaaacccgttcgggacccgaagggtcccttacccccgaacggggtcctttaccctacgtaactttcctaagttcggaatttcggtacctacccgtaaaccggcggggttccaaccggttcggggccccgtttaccccccgggaccgtagggtttaccgaacggttcggggtaccgtagggtcgggggttaccgttggggtaacgttacggtacctttaccggaccgtttccggtacccgtacccggtacaacgggtcctaacggacccgttaacgggacgttacccggtaagggtaaacggttacgttttttcggaaccggttttaacttaccggtacgtttacgaggtaccgtaaccggttccgtttacccgaccgttcgggttacccgtaacgtttaaacccgggttttccgggggaccggggggttaaacccgtagggggtaccgggtaaacggtaacgggtaacgtaaaccgggtaacgttacgggcggtaaccgtcggtacctaaacccgtgttaccgtttacggtttacccgttacggtaacccgtttaccggtttaccccggaccgttacgttacccgtaacgggtaaccttaggtttaaccggg

SEQ ID NO: 23748 - DNA, 635 bp, Homo sapiens
  misc_feature: GYAE6OF02G3F57.24.35.D02.1.454.CMB.1.raw
  modified_base (204)..(204): a, c, t, g, unknown or other
  misc_feature (204)..(204): n is a, c, g, or t
  modified_base (321)..(321): a, c, t, g, unknown or other
  misc_feature (321)..(321): n is a, c, g, or t
tcagactactatgtcacgaccggtgctcgatttagcacacgatagttgggtttgggggaggaactgctcagttaggacccagagggaaccatggaagccccagcgcagcttctcttcctcctgctactctggctcccagataccactggagaagtagtcatgacgcagtctccagcccaccctgtctgtgtctccgaggggganagacgcccaccctctcctgcagggccagccggagtgttagtaagtacttaggctggtaccaacagaaacctggccaggcctcccgaggcctcctcatctatgatgtcctaccaacgngggtccacgtcggcctccccgctaggttcagtggcaggtcgggtctgggacagtacttcactctcacgtcagcacgcctagacgcctagaagtagttttggacgttttactacgtgtacagtctacggtccgttcccgccgtcggtcccgtacgttaaccggtttccgggggaccggggggtaccgtagggggtcggaagggacgggacgaaccgggtaacgttgggtcggtcgtcggaccgtaaccgtacgttccgttacggttccttaccgttacgttccccgtttaccccggacttacgttaccgtaacgg

SEQ ID NO: 23749 - DNA, 730 bp, Homo sapiens
  misc_feature: GYAE6OF02GD3CM.24.35.D02.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (320)..(320): a, c, t, g, unknown or other
  misc_feature (320)..(320): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgcccaccctctcctgcagggccaggccggagtgttagtaagtcttaggctggtaccaanagaacctggccaggcctcccaggcctcctcatctagtgattcgtcctaccaacgngggtccacgtcgggcccgtccccgacgtaggtttccgaggttcggactgggttcgggtcgtaggggaccagttaccttcacgtcctccgaccgtcacgccgaacgtcctaagggccgtacgtaggtaagttacgttttacggtaccggttttaacttacgtacggtctacgtcgtacggtccggttccgcccgttcggcccgttaccgttaaccggtttccggggggacccggggggtaccgtagggggtcgggtaacggaacgggtaacggtaaccggtaaacggttcggtacgggtccctacgggaccctaaccggtacgtttccggttacgtttccgtttaccgtaaccgtttccccgtttaccccggaccttaacggttaccctaacggttaactacggttaacgg

SEQ ID NO: 23750 - DNA, 617 bp, Homo sapiens
  misc_feature: GYAE6OF02FQDN0.24.35.D02.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcacccttgtctttgtctccgaggggganagagccaccctctcctgcagggccagccggagtgttagtaagtcttaggctggtaccaacagaacctggccaggctcccaggctcctcatctatgatgtctcaacngggtcagtcggcctccccgcaggttcaggtcggcaggtgggtctgggacaggtaccttcgactctccaccgtcaagccagtcctagcgcctagtaatgtttttcggacggttttaactacgtcgtacaggctacggtccgttccggccgttgggtccctcgttaaccggtttcgggggaccgggggtacagggggttaggacgggtaaggaacgacggtaactgggtacggtctcggacacctacggttcttacggttaccttcgtacgttcccgtccgaccttagtacctacgtaactgttaacgg

SEQ ID NO: 23751 - DNA, 690 bp, Homo sapiens
  misc_feature: GYAE6OF02HNOPA.24.35.D02.1.454.CMB.1.raw
  modified_base (203)..(203): a, c, t, g, unknown or other
  misc_feature (203)..(203): n is a, c, g, or t
  modified_base (319)..(319): a, c, t, g, unknown or other
  misc_feature (319)..(319): n is a, c, g, or t
tcagactactatgtcacgaccggtgctcgatttagcacacgatagttgggtttggggagagctgctcagttaggacccagagggaaccatggaaaccccagcgcagcttctcttcctcctgctactctggcctccagccatccaccggaggaattgtgttgacgcagtctccaggccaccctgtctttgtctaccgagggganagacgccacctctcctgcacgggccagtcagagtgttacgcagcagctacttagcctggtaccaggcaacggaaacctggcctggcctccgaggtcctcctcatcgtagtcggtcnccgtaccaccgtacgggcccagtcggcgtcgacggactaggttccaggtcgacgtaggtcggtacgtttacgggactacgggtacttcccaacgttctacgtacgtacgtacgttcgaaccgtaacggtacctacgggaacgtacccggtaagttacgttttacgaccgttaaggttacgttacgttacgtcggtactaggtcgtttacggttccggttcccgttccgtttcccgtaccgttaccgttacgttaacccgtttcggtttaccggtacccggtttacgggttacccggtacggtcgttacgggtaacggtacttaccggaacgtccgtaacgttcgggcggttaccgcgttaccagttacccg

SEQ ID NO: 23752 - DNA, 582 bp, Homo sapiens
  misc_feature: GYAE6OF02JDAE3.24.35.D02.1.454.CMB.1.raw
  modified_base (260)..(260): a, c, t, g, unknown or other
  misc_feature (260)..(260): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (444)..(444): a, c, t, g, unknown or other
  misc_feature (444)..(444): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcaggccagccggagtgttagaagtacttaggctggtaccaanacgaaacctggccaggcctacccgaggcctcctcatctatgatgtctacaacagggtcacgtcggccgtcccactaggttcaggtggctaggtggtctgggacagtacttcactcncnccgtcagcagcctagacnccgtagaattgtttcgtacggtttactactgtcagcacgtccgttccncgtcggcctacgttacgttcgggacggggactggggtgaggaggacgacgaacgtcggtcggcgtacgacctacgacgtcgttcgttacttccgacgtttccctaccccgtctaaccgttcgtaacgatacgttaacg

SEQ ID NO: 23753 - DNA, 874 bp, Homo sapiens
  misc_feature: GYAE6OF02IXR3J.24.35.D02.1.454.CMB.1.raw
  modified_base (806)..(806): a, c, t, g, unknown or other
  misc_feature (806)..(806): n is a, c, g, or t
  modified_base (842)..(842): a, c, t, g, unknown or other
  misc_feature (842)..(842): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtcttgtctccgagggagagacgccaccctctccgtgacgagggccagccggagttgttaacggtaagttaccgttagggcttacggaaccctaaagaaggaaaaccccgttgggacccgaagggtcccgtacccccgaagggtcccttacccgttacctaacgtttaccgtaagttaccggaacgttttcggttaccccgttaaccccgaaaaccggttaaccggggggtttcccaaaccggttttacccgggggtacccccggttcccccccggtaacccggttaacggggttttacccgaacgggtttaccggggaccgtaaacggggtttcgggggttacccgtacggggtaacctaacggtttaacccttccgtaaccgtttcccgtaccgtaacccgttacgaacggtccaccggtacccgtaagcccgtacgtaagtaacgttacggtttttcgtaccgggttttaactaccgttgtaccgaggtaccgtacgttcccgttccgtaccggtcggtacccgtaacgtttaaccggttccgggggacggggtacccgtaggggtcggaaacgacgggtaaccgaacggttacgtggttccggacgtacgcgtaaccgtnttccggtgttccggttaacctcgttacccggtaccncccgtattacccgagttaacccgtaggtaccg

SEQ ID NO: 23754 - DNA, 725 bp, Homo sapiens
  misc_feature: GYAE6OF02IP79H.24.35.D02.1.454.CMB.1.raw
  modified_base (199)..(199): a, c, t, g, unknown or other
  misc_feature (199)..(199): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcacctgtctttgctccagggganagacgccacctctcctgcagggccagccggagtgttagtaagtacttaggcttcggtaaccaacgtagaaacctggaccaggcctccgaggcctccgtacatcctaatgattcgtcaccaacgacgggtccacgtcggcccgtccccgctagggttcaggtcggctaggtcgggtctagggactaggtaccttcaacgttcgtaccgaccggttacacgccgtaacggtccctaagggaccgtacctaaggtaacgtttagttttcgggtaaccggttttaacttacgttacggtaccgtacgaccgttacggttacccggttcccgcccgtttacgggtccccgttacgtttaaaccggtttccggggggaccggggggttaccctagggggtacgggtaacggacggggtaacgacggtaacggtggtacggtaccgtcgaccgtaccggtacgtcggttacgttccgttaccgtacgttcccgttacccgcttacgtaccgtaacggtaacttacgttaacgg

SEQ ID NO: 23755 - DNA, 719 bp, Homo sapiens
  misc_feature: GYAE6OF02HRIZU.24.35.D02.1.454.CMB.1.raw
  modified_base (266)..(266): a, c, t, g, unknown or other
  misc_feature (266)..(266): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcacccttgtctttgtctccgaggggagagacgcccaccctctcctgcacgggccaggccggagtgttagtaagtctaggctggtaccaanagaaacctggaccaggcctaccgaggcctcctacatctatgtatcgtcctaccaacgtacgggtcacgtcggacccgtccccgcgtacggttcaggtcgacgtagggtcgggtacgtcggactcgtaccttcaccgttcctaccgaccgttacgacgacgtacgtacccgtaggaccgtccgtaaggtaaagtttacgtttttacgggtaccggtttttaacctacgttacgttacgaggtccgtaccggttccggttccccggtaccgtccgggtacccgttaccgttaaccgggtttcccgggggacgggggtaccgtagggggtcggaagggtacgggaacggtaccggtaaggttggtcgggtactcggaccgtaccgtacgttcgtaccgtttaccttaccgtactttcccgttacccgactcgtttacgtacgtacctagttaacgg

SEQ ID NO: 23756 - DNA, 788 bp, Homo sapiens
  misc_feature: GYAE6OF02H16JR.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtcctccaggccaccctgtctttgtctccgaggggagagacgcccaccctctccgtgccgacgggccagccggtagttgttaagtaacgtacgttacggcttacggtaaccaacgaacggtaaaccgtggacccgacggtccctacccgaacggtccttaccctcattcctatcggtattccgtccctaccaacggtacggtcacggtcggacccgtccccgtcgtacggttcgaggtcgccgtaggttcggtcgtacggactacgtacttacaccgttcgtaccgaccgttcgaacgtccgaacggtccgtaaggtaccgtacgtaaggtaacggtttacgttttacggtttaccggttttaacgtacggttcgtacgtacggtccgtaacgtcccggttcccggtcgtcccggtaccgttaccgtttaaccgggttccgggggaaccgggggtaccggtaacgggggttagggaacgggtaacgggaacggtaaccggtaacggttacgggtcggtaccgtacggaccctaaccgttcgtccggttaccgttaccttaccgttacccgttacccgtttccccgacgttaccgttaccgtaacgtaccgtaagttaccgg

SEQ ID NO: 23757 - DNA, 645 bp, Homo sapiens
  misc_feature: GYAE6OF02G7B89.24.35.D02.1.454.CMB.1.raw
  modified_base (203)..(203): a, c, t, g, unknown or other
  misc_feature (203)..(203): n is a, c, g, or t
  modified_base (322)..(322): a, c, t, g, unknown or other
  misc_feature (322)..(322): n is a, c, g, or t
  modified_base (429)..(429): a, c, t, g, unknown or other
  misc_feature (429)..(429): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcacccttgtctttgtctccgagggganagagcccaccctctcctgcgagggccaggccggagtgttagtaagtacttaggctaggtaccaacgagaaacctggccagggcctcccgaggcctcctcatctatgatgtctccaacgngggtcacgtcggcctccccgcgtaggttcaggtcggacgtaggtgggtctagggacaggtaccttcaccttctcgaccgtcacgcacgccctagcgcctagaagttntttaggtacggtttactactgtcacgtcctaggtccgttccgccgtcggtcccgtacgttaaccgtttccggggaccgggggtacgtacgggggtggacgggtacggtacggaccggtaacggtggtcggacgtcgaccgtaccgtacgttcctcggttaccttccgtacgttcccgttccccggtacttaccgttcgtacgtacctagttaacgg

SEQ ID NO: 23758 - DNA, 883 bp, Homo sapiens
  misc_feature: GYAE6OF02HZGNL.24.35.D02.1.454.CMB.1.raw
  modified_base (198)..(198): a, c, t, g, unknown or other
  misc_feature (198)..(198): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcacctgtctttgctcgagggganagcgccacctctcctgcgacggccaggccgggtagttgttaagtaaagttacgttacgggcttacgggtaaccaacgaaggtaaaaccctgggacccgaagggccctaccccgaggtcccttcctcgtattcctagttcggtaacttcgtaccctacccgaaacggtacggggttccaaccgtcgggtccccggtccccccggaccgttacgggtttaccgacgggttgggaccgtaaggggttccggggttaccgtacgggggtaaccaacgggttaccccttaccgtacccgttacgttaccccggaaacccggtttccgaacggtaccctaaaccgggttaccccgtaaacgggtacgtacccgtttaaggtaaacgttttaacggttttttcgggttaaccccggtttttacgttacgtttacgttaccgtacggtccgtaacggttccccgtttcccgggtaccgttccgggtacccgttacggtttaaccggtttccggggggaccgggggggtaacccgtacggggggttagggaacggggtaaccgggtaaacggtaaccggttaacgggtgtacgggtacgttccgaccgtaaccgtagttccggttacgtttcccgtaccgttacgttccccgttacccggccttaagttacccgttagtaccgtagttaaccgg

SEQ ID NO: 23759 - DNA, 717 bp, Homo sapiens
  misc_feature: GYAE6OF02H9YTA.24.35.D02.1.454.CMB.1.raw
  modified_base (201)..(201): a, c, t, g, unknown or other
  misc_feature (201)..(201): n is a, c, g, or t
  modified_base (691)..(691): a, c, t, g, unknown or other
  misc_feature (691)..(691): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccgagggganagagcccaccctctcctgcagggccaggccggagttgttagtaagtacgttaggctggtaaccaacgaagaaaccgtggaccctagggccctaccccgaggtcctcctacgacttcgtaatggacttgtaccctccaaacgtacgggttaccaacggttcggacccgtcccccggcttaggttaccgaggttcggacgtagggttgggtaccgtagggacgtacgttaccttccgtaacctttccgtaccgacccgttcacgcgtacgtcctaaggcgtaccgtagaacgtttgttttcgtacggtttactacgtgtacagtcgtacgtaccggtttccgcgttcggacccgttacgttaaccggttttcccgggggaccgggggttacgtaacgggggtcggaagggtacgggaacggaacgtaacgttcgggtcgtcggttacgccgtaacgtcgtacgttcgtaccttacgtccttccggttacccncgttactcgtacgtactagttaacgg

SEQ ID NO: 23760 - DNA, 827 bp, Homo sapiens
  misc_feature: GYAE6OF02GQ04P.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganaggacgccaccctctcctgcagggccagccggagtgttagtaagtacttaggctggtaccaacgagaaacctggaccaggcctcccgaggcctcctcatctatcgattcgtctaccaacgtgggtcacgtcggccgtccccggcaggtttccaggtcggacgtagggttcggggtcgtacgggactagtacccttcgtaaccttctaccgtaaccggtctacggctaacggtccctaaggaccgtcccgtaaggtaaacggtttacgtttttcgggtaaccggtttttaaccgttaccgttacggttacgaacggtaccgtaccgggttacccggtttccccggtacccggttaccggggtaccccgttaaccgggtttttaaacccggggtttttccccggggggggacccgggggggggtaaacccggttaacgggggggtcggggtaaaacgggggtaacggggaaacgggtaaaccgggttaaccggttcggggtaccggggtaccgttacgggacccgtaaccgtacggtttacgtttccgggttacctttacccgtacgttttccccgttccccggtacgttacttacccggtaacggtaaccttaaggtttaaccggg

SEQ ID NO: 23761 - DNA, 650 bp, Homo sapiens
  misc_feature: GYAE6OF02JF11G.24.35.D02.1.454.CMB.1.raw
  modified_base (204)..(204): a, c, t, g, unknown or other
  misc_feature (204)..(204): n is a, c, g, or t
  modified_base (581)..(581): a, c, t, g, unknown or other
  misc_feature (581)..(581): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggcaccctgtctttgtcctccgagggganagagccaccctctcctgcagggccagtcagtagtgttagcagcagctacttagcctggtaccagcaagaaacctggcctggctcccgaggctcctcatctagtggtcgcgtcccaccgtacgggcccacgtcggccgtccggaccgggtacgacggttccgaaggttgggacgtaggtcggtcgttttaggggaccaaggtaccttaccgtaccttccgtactacgttctaacgtccgtaacgacgaacgttggacgtacccgtaagttacgtttcgacgtagttgttaatttacgttgtacgtgtcgttggtttcgtacccgttccttccttaccgttactcgttaccttcgttttccgtccgtacggttacccgngttacgtcggtacgtataccggaacgtacgtaaccgtggtcggtcgtacgtaccgtaccgtattcccgg

SEQ ID NO: 23762 - DNA, 682 bp, Homo sapiens
  misc_feature: GYAE6OF02IK8R4.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttggggtttgggggagaactgctcagttaggacccagagggaaccatggaacgccccagctcagcttctcttcctcctgctactctggcctccagagaccaccggagaaattgtgttgacacagtctcaggccacctgtctttgtctccgaggganagacgcccaccctctcctgcgacgggccaggccggagttgttagtaagtactaggctacggtaacaacacgtaaacctggaccaggcctaccaggtcctcctctatctatgatcgtctaccaacgtagggtcaccgttcggcccgtccccgtacgtacggttccaaggttcggacgtagggttcgggttcgagggaacctaggttactttccgaactttcgtaccgtaaccgtacgacgtaccgaacgtccgtaaaggtcgtacccgttaggtaaaacgtttcgttttacggtaccggttttaacacgttagttacgaacgtcgtacgttccgttaccgcgtcggaccgttacgttaacggttcggggacggggactaggggtacgaggaacgggacgacgtaacggtgacgtcgtacgacaactgtacttcgtacttcgacttcccgttccgacctacttacgtactacctagttaacgg

SEQ ID NO: 23763 - DNA, 666 bp, Homo sapiens
  misc_feature: GYAE6OF02F4QEU.24.35.D02.1.454.CMB.1.raw
  modified_base (388)..(388): a, c, t, g, unknown or other
  misc_feature (388)..(388): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtctttgtctccgaggggagagacgcccaccctcgtcctggcacgggccaggccggagtgttaagtaacgtacttaggctgggtaacccaaacacgtaaaacctggccaggcctcccaggctcctcacttctatcgattcgtactaccaacgacgggtccactcgggccgtccccgccgtaggttcaagtggcgtagtcgggtcnggacagtctcactcncncgtcngcagtcagagctagagtatttgacggtttactagtgtacgagtcacgtcgttcccgacgttcggacccgtccgttaaccggtttccgggggaccgggggtaccgtacgggggtcggtaacgggacggggtaacgaacgggtaacgttgggtaccggggcttacggacccgtaaccgtacgttcccgtacgtttccgttaaccctacgtttcccttaccccggaccttacgtccgtaaccggtaactaacgttacgg

SEQ ID NO: 23764 - DNA, 1051 bp, Homo sapiens
  misc_feature: GYAE6OF02JVMKZ.24.35.D02.1.454.CMB.1.raw
  modified_base (180)..(180): a, c, t, g, unknown or other
  misc_feature (180)..(180): n is a, c, g, or t
  modified_base (185)..(185): a, c, t, g, unknown or other
  misc_feature (185)..(185): n is a, c, g, or t
  modified_base (283)..(283): a, c, t, g, unknown or other
  misc_feature (283)..(283): n is a, c, g, or t
tcagactactatgtcacgaccggtgctcgatttagcacacgatagttgggtttgggggagggaacgtgctcagttaggacccagagggaaccatggaagcccagctcagctctcttctcctgctactctggcctccagatgccaccggagacattgtgttgacacagtctcagccacctntcttntctcgagggaaatcgcctaccctctccgtagcgacgggctacggtgaccaagtggttacggaagtttagtacgacctggtactacaacaactaaaacngttacggaccgaggtacccgtccccggtaccttccctaccgtacttaccttaggtcggtaacgtacgtactaacttacccgtaaacgtaaccggggccctaaaccgttgggacccaacccgttaccccggaaacggtaaccggttacgggtttaccggaacggttccggtaacgggttaccgggtacggggtttaccgaggggtaaacccgtaacggtttacccgttaccgtaaacccgggttcctaccccggggttaaaccggtacccggttaacggtaccccgtaaccgggttaacccgttaaccggggtaaccggttaccccggttaagggttaaaacccgggttttaagggtttttaaccccgggttaaccggggtttttttaaaccccgttaaccgggtttaacccggtttaacgggtaacccggtttaaccgggtaaccggtttaacccgggttttcccccggttaaacccgggttcccgggtttacccccggggttaaaccccgggttttaaccggggtttttaccccgggggggtacccgggggggttaaccggttaaccggggggggttaaccggggtaaccgggggtaaacggggttaaccggggttaaccggggtaaaccggggtttaaccgggggtaacgggttacccgggtaaccgggtaaccccgggttaacccgggttacctttaacccggggtttcccgtttaaacccggttccgttttaaccccggtacccgtttaaccccccgggttacc

SEQ ID NO: 23765 - DNA, 566 bp, Homo sapiens
  misc_feature: GYAE6OF02HRHQJ.24.35.D02.1.454.CMB.1.raw
  modified_base (158)..(158): a, c, t, g, unknown or other
  misc_feature (158)..(158): n is a, c, g, or t
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (368)..(368): a, c, t, g, unknown or other
  misc_feature (368)..(368): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgngttgacacagtctccaggcaccctgtctttgtctccagggganagagccaccctctcctgcaggccagccggagtgttagtaagtacttaggctggtaccaanagaaacctggccaggctccaggctcctnatctatgatgtctacaacagggtcactggccgtccccgcaggttcagtgcagtggctaggcagacttcactctcacgtnagcagcctagagccctgaagtattttcgcggtttaactactgttacagtcgacgtcgttccgccgtcggccgtacttaaccgtttcgggcgggggtaccgaggggtcggaggaaggacgaacgtaacgtgtgcgttgccgacgtacgtcgtcgttcttactacgtccgttcccgcctactcgtacgtaacagttaacg

SEQ ID NO: 23766 - DNA, 725 bp, Homo sapiens
  misc_feature: GYAE6OF02HF4WW.24.35.D02.1.454.CMB.1.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
tcagactactatgtcacgaccggtgctcgatttagcacacgatagttgggtttgggggaggaactgctcagttaggacccagagggaaccatggaagcccagctcagcttctcttcctcctgctactctggctcccagagaccaccggagaaattgtgttgacacagtctccaggccaccctgtctttgtctccgaggganagacgccaccctctcctgcgagggccagccggagtgttagtaagtacgttaggctggtaccaanacgaaacctcggaccgaggcctcccgaggcctccgtcagtctatgatcgtctaccaacgtacgggtcacgtcggaccgtccccgcgtacgttcgagtcggctagggtggtcgtacgggactacgtccttacgaccttcgtacctaccgtcaacgtccgacgacgttacgacgttccgtacgaaggttacttttaggttaccgtttacgttacgttcggtcgtacgtaccgtacggttcgttcccggtccgttaccggtccgttaccgttaaccgggtttcggggtaacccggggggaccggtacgggggttacgggaacgggtaacgggtaacggtaccggtaaacggttggtcggtaccggttcgccgtaccgttacggttcgttaaccggttccgtttacgtaccgttcccgttacccggtccttaaccgttccgttaacgtaccgtaagtttaacgg

SEQ ID NO: 23767 - DNA, 669 bp, Homo sapiens
  misc_feature: GYAE6OF02HPOUT.24.35.D02.1.454.CMB.1.raw
  modified_base (251)..(251): a, c, t, g, unknown or other
  misc_feature (251)..(251): n is a, c, g, or t
  modified_base (341)..(341): a, c, t, g, unknown or other
  misc_feature (341)..(341): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
tcagactactatgtcacgaccggtgctcgatttagcacacgatagttgggtttgggggaggaactgctcagttaggacccagagggaacatgaagcccacgctcagcttctcttcctcctgctactctggctcccagagaccaccggagaaattgtgttgacacagtctccaggcaccctgtctttgtctccaggggagagagccaccctctcctgcagggcctagccggagtgttagtaagttactaggntcggtaacaacagaaacctggccagctccgaggctccgtacatctatagactgtactccaaacgtagggtccacgtcggccgtcccccgnacggttcaggtggacgtaggtgggtctaggaccaagtctttccncgttacnccaccaagtcacggtccggccctacgtacgttacgtgaagttacgttttagttaccgtacttttaagtttacttacggtacctaaaccgtacttaagttcgggttagaccgttcgaccgttaccgttaaccttacgttttcggaccggaaacggggtaaaccgtaaacgtacgggtaaacgacgttaaacgaaacgttaacgtggttacgcgttaacgcgtaaccgattccttcgtacttacgtccgttaccctttcccgaccttagttacctaacg

SEQ ID NO: 23768 - DNA, 724 bp, Homo sapiens
  misc_feature: GYAE6OF02I7C6T.24.35.D02.1.454.CMB.1.raw
  modified_base (211)..(211): a, c, t, g, unknown or other
  misc_feature (211)..(211): n is a, c, g, or t
  modified_base (421)..(421): a, c, t, g, unknown or other
  misc_feature (421)..(421): n is a, c, g, or t
tcagactactatgtcacgaccggtgctcgatttagcacacgatagttgggtttgggggaggaactgctcagttaggacccagagggaaccatggaaggccccagctcagtcttctcttcctcctgctactctggctcccagagacccaccggaagaaattcgtgttcgacacagtcctaccaggccaccctgtctttgtctccgagggganagacgcccacccgtctccgtgcgtagggccaggccgggagttgttagtaagtacttaggctcggtaaccaacagaaaccgtggaccacggtcctacccgaggcctccgtacactctatgattcgtcctaccaacgtagggtccacgtcggcctccccgcgtaggttcaggtcgacaggtcggtcgaggacagtactcactctcgaccgtnacgcacgacagacgacgtagtaacgttagtttcggtacggttttactacgtcgtacacggtacgtacggtccgttccggccgtccgggtacccgttaaccgtttaccggggtttaccggggggaaccggggggtaaccggtaacgggggtacggggaacgggaagggtaaccggtaacggtaaccggtggtaacgggccgttacggacctacgtacgtttccgttacgtttaccgttaccgttaacccgtttacccgttacccggtaaccttacgttaccgtaacgtaaccgttagttaacgg

SEQ ID NO: 23769 - DNA, 650 bp, Homo sapiens
  misc_feature: GYAE6OF02F0K7C.24.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagaagtacttaggctggtaccaanagaaacctggccaggctcccaggcctcctcatctatgatgtctccaacngggtcactggccgtccccgcaggttcagtgcagtgggctgggacagcttcactctcaccgtcacgcagcctagacgtcctagaagtagttttcgacggttttactacgttcgttacagaccgtacgtccggttccgtacccgttcgggcccgtaccgttaaaccggttttccggggaccggggggtaacccgtagggggttcgggaagggtacgggaacggtaaccggtaaacggttcggtacgggaccgtcggtaccgaacctacgttcgtaccgttccgttaccaccgtttacccgttaccccggccttaacgttccgtacgtaaccgtagttaacgg

SEQ ID NO: 23770 - DNA, 571 bp, Homo sapiens
  misc_feature: GYAE6OF02F4RXX.24.35.D02.1.454.CMB.1.raw
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgcagggccagccggagtgttagtaagtacttaggctggtaccaacagaaacctggccaggctcccaggcctcctcatctatgatgtctaccaacgagggtccacgtggccgtccccgcaggttcagtcggcaggtgggtctgggacagtacttcacttcncaccgtnagcagcctagcgcctgaagtatttgtcggtttactcttgtcagcagtccgttccgctcggccgcgttacgtttccgggacggggtaccgagggtggagaggagacgaacgtggtgcgtgacacctacgtcgttcgttcttacctacgttcccgttcccgtcctacttctacgtaactagttaacg

SEQ ID NO: 23771 - DNA, 650 bp, Homo sapiens
  misc_feature: GYAE6OF02GGG5U.24.35.D02.1.454.CMB.1.raw
  modified_base (312)..(312): a, c, t, g, unknown or other
  misc_feature (312)..(312): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagacgccaccctctcctgcagggccagccggagtgttagtaagtacttaggctggtaaccaacagaaacctggccaggctccgaggctcctcatctatgatgtctccaacngggtcacgtggccgtccccgcgaggttcagtcggcaggtgggtctgggacaggtaccttcactcctacaccgtcagcacgccctagacgtccgtagtaacgttagttttacggtacggttttaactacttcgttacaggtccgtacggtccggtttccgcccgttcgggcccgtacgtttaaccggtttccggggaccgggggtaccggtagggtcgggaaggtaacgggaggaaccgtaaacggtggtcgggactcggccacctacggttcttcgttaccttctaaccgttccgttaccccggtaccttacgtacccgtagtaaaccgtgttaacgg

SEQ ID NO: 23772 - DNA, 700 bp, Homo sapiens
  misc_feature: GYAE6OF02H86CH.24.35.D02.1.454.CMB.1.raw
  modified_base (151)..(151): a, c, t, g, unknown or other
  misc_feature (151)..(151): n is a, c, g, or t
  modified_base (344)..(344): a, c, t, g, unknown or other
  misc_feature (344)..(344): n is a, c, g, or t
  modified_base (626)..(626): a, c, t, g, unknown or other
  misc_feature (626)..(626): n is a, c, g, or t
tcagactactatgtcacgaccggtgctcgatttagcacacgatagttggggtttgggggaggaactgctcagttaggacccagagggaaccatggaagccccagctcagcttctcttcctcctgctactctggctccagagaccaccgganaaattgtgttgacacgagtctccaggcaccctgtctttcgtcctccgaggggagagacgccctaccctctcctcgcgagggcccacgccggagttgttagtaagtacgttaggctggtaaccaacgagaaacctggaccaggcctccgaggtcctcctcatcgtatcgatcgtcctaccaacggtagggtccncggtacgggtcccccggtcccccgacgtagggttccgacggtcggaccgtaggttcgggtacgtcgggaccgagtcttacgacttccttccacggtcacgtccgacgtcccagtacgtaccgtgtaacgtttacgtttcggtccgtttacgtagtcgtacgtacgacgtacggtcccgttccggaccgtcgggtacccggttaccgttaaccgggtttccggggaaccgggggtaccggtaggggtaccggtacggaagggacggtacgacgttgtcggtcncggaccaccgttagcttcggtccttaccgctacccgtttcccgacgttacgtccgtaacgtaccgtagttaacg

SEQ ID NO: 23773 - DNA, 800 bp, Homo sapiens
  misc_feature: GYAE6OF02JL6OR.24.35.D02.1.454.CMB.1.raw
  modified_base (202)..(202): a, c, t, g, unknown or other
  misc_feature (202)..(202): n is a, c, g, or t
  modified_base (733)..(733): a, c, t, g, unknown or other
  misc_feature (733)..(733): n is a, c, g, or t
tcagactactatgtcacgaccggtgctcgatttagcacacgatagttggggtttgggggaggaactgctcagttaggacccagagggaaccatggaagccccagctcagcttctcttcctcctgctactctggcctcccagagaccaccggagaaattgtgttgacacagtctccaggcaccctgtcttgtctcgagggganagacgcccaccctctcctgcgacgggccaggccggtagtgttaagtaagtactaggctaggtaaccaacacgaaacctggaccgaggcctacccaggcctcctctatctatggacttcgtactaccaacgtacgggtccaccggtccggccctcccccggacgtacgggttccaagggtcggtaccgtaggggttcgggtcgtacggggaacctacggtaccttacgtaccgttccgtacccgaccggttacggacgtacccgtaccggtaccgtaacggggacctaccggtttaagtaaacgttttcggttttaacgggttacccgggttttaaccttaccgttggtaacggtacggtaccgttaccggtcccgggtttcccgcccgggtcggtaccccggtttaacgtttaccggggttccggggggaaccgggggtacccgtaagggggttcgggaaacgggtacgggtaaccgggtaaaccgtagggtcggttaccgggctaccggtacctaccgtggtttacccgnggtttaccgtacctaccgtttccccgttccggacctttaacgtccgtaacggtacttaccggttaag

SEQ ID NO: 23774 - DNA, 716 bp, Homo sapiens
  misc_feature: GYAE6OF02H23PR.24.35.D02.1.454.CMB.1.raw
  modified_base (208)..(208): a, c, t, g, unknown or other
  misc_feature (208)..(208): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagacccaccggagaaattgtgttgacacagtcctccaggcaccctgttctttgtcctccgaggggagngacgcccaccctctccctgccgagggccaggccggagttgttaagtaagttacttaggctggtaaccaacagaaacctggccaggcctccccaggtcctcctcactctattgatcgtcctaccaacgtacgggtccacgttcggcccgtccccgacgtaggttccaggtcggacgtaggttcgggtcgtagggactacgtacttcacctctacgtaccgtcgagccacgtcctagacgtcctagtaacgttgtttcggtacgtttctacgtcgtcgacgcgtacgttccggttcccgccgttacgggtacccttaccgttaaccgggtttccggggaccgggggtacccgtagggggtagggagggaacgggacggtaaccggtaacggttgggacgggtacgttaccggaccgtaccgtacgttccgtttacgtttccgttaccgtaccctttcccgttaccccgtaccgtttaccgtacgttaaccggtaacgttacgtttaacgg

SEQ ID NO: 23775 - DNA, 766 bp, Homo sapiens
  misc_feature: GYAE6OF02HJY42.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccgaggggagagagccaccctctcctgcagggccagccggagtgttagtaagtacttaggctggtaccaagagaaacctggccaggcctcccgaggcctcctcagtctaatgactgtccaccaagtcgggtcacgtcggccgtccccgcgtaggtcaggtcggctaggtcgggtctacgggacacggtacttcaacttcctaccgtacccgttacacggcctaacggcccttaagggaccgtacccgttaagggtaaacgttcgttttttacgggtaccgggtttttaaccctaacgttcgttacgaaggttccggtaacggttcccggttaccccgtccgtaccggggttacccgtaccgttttaaacccgggttttcccgggggggacgggggggttaaacccgtaggggggttaccgggaaggggtaacgggtaacggaaccccggtttaaaggtcgggtacggtcttacgggaccctaaccggttacgttccggttacgtttccttaccgaccgttttccccgttaacccgccgttaagttcccgtacgtaaaccgttagtttaacccggg

SEQ ID NO: 23776 - DNA, 686 bp, Homo sapiens
  misc_feature: GYAE6OF02HSOYH.24.35.D02.1.454.CMB.1.raw
  modified_base (384)..(384): a, c, t, g, unknown or other
  misc_feature (384)..(384): n is a, c, g, or t
tcagactactatgtcacgaccggtgctcgatttagcacacgatagttgggtttgggggaggaactgctcagttaggacccagacggaaccatggaagccccagcgcagcttctcttcctcctgctactctggcctcccagccatcaccggaggaattgtgttgacgcagtctccaggcaccctgtctttgtctccgagggtagagacgccaccctctcctgcgagggccagtcagtagtgttagcagcagtcctacgttagccgtaggtaccagcaagaaacctggcctaggcctcccgaggtcctctacgtatcgtagtcggtcgccgtaccacgacgggccaacgtcgggccggtcggacggacgtaggttacgaggtcggngtagggttcggtacgtttggggaacctacggtaacctttcgaaccttcgtactacgttctaacgtccgtaactacggtacgtagggacgtaccgaagttacgttttcggacgttaaggttacgttagtttaccgtggttactacggttacgtttggtttaccggttccccttcgtcccgtttaccgttacgttaccgtttaccgttacgtttccgggtaccgtacgggtttcccagggttaccgtggtacgtacgtaccgaacgtccgtaaggttcggtcggtccgtacgtacccgacttcg

SEQ ID NO: 23777 - DNA, 732 bp, Homo sapiens
  misc_feature: GYAE6OF02IZ8AT.24.35.D02.1.454.CMB.1.raw
  modified_base (198)..(198): a, c, t, g, unknown or other
  misc_feature (198)..(198): n is a, c, g, or t
  modified_base (490)..(490): a, c, t, g, unknown or other
  misc_feature (490)..(490): n is a, c, g, or t
tcagactactatgtcacgaccggtgctcgatttagcacacgatagttgggtttgggggaggaactgctcagttaggacccagagggaaccatggaagcccagctcagcttctcttcctcctgctactctggctcccagagaccaccggagaaattgtgttgacacagtctccagcacctgtcttgcctccgagggganagacgcccaccctctcctgccgacgggccaaggtccggagtgtttaacgtaaacggttacttagggccttagggtaaacccaacgaacggtaaacccgtcgggacccaaggggtcccttaccccgaagggtcccttacccgtacgatttaccgtaattcggaacttcggttaccctaccggaaaccgtaggggttccaaccggttcgggaccctccccgggactaggttccaggtcgcgtaggtcggggctgggacctaggtaccttcgaacctttcggacctaccgggtanacgccaacgtcgtacgacgtcgtagaacgtttcgtttacggttacgttactagttcgtacgacgtcgtacgtccgtaccgccggtcgtccgttacgttacgggtccggggggacgggacggtacgggtacgggacggacgggtaacggtaacgtacggtcggacggtcacggtccgtactacggttcgttcgtaccttacctccgttcccgtaccgcctagttaccgtacgtactacgttag

SEQ ID NO: 23778 - DNA, 632 bp, Homo sapiens
  misc_feature: GYAE6OF02IC0WQ.24.35.D02.1.454.CMB.1.raw
  modified_base (152)..(152): a, c, t, g, unknown or other
  misc_feature (152)..(152): n is a, c, g, or t
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (406)..(406): a, c, t, g, unknown or other
  misc_feature (406)..(406): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagataccactggaanaaatagtgatgacgcagtctccagcccacctgtctgtgtctccgaggggaaancgccaccctctcctgcgagggccagtcagtagtanaagaancaactcttagcctggtatcaacagaaacctggccaggctccgaggctcctnactctatgtatcgtcctaccaacgagggtcacgtcggcccgtccccgacgtacggttcaacgtcgggcgagggttcgggtactgggaactagtaccgttcactcctacnccgttcagacctacgcctaagaccgtcgtaggaacgttgtttacggaccggttttaacacgttgtacacgtcgacgtccgttaccgcgtcggtacccgtacgttaaccggttccggggaccgggggtaccagggggtcggaagtaggacgaccggaggtggtcggtaccgtcgaccctaccgtcgttccgttcgttaccttaccgtaccgtttcccgcccgtaacc

SEQ ID NO: 23779 - DNA, 579 bp, Homo sapiens
  misc_feature: GYAE6OF02ION70.24.35.D02.1.454.CMB.1.raw
  modified_base (201)..(201): a, c, t, g, unknown or other
  misc_feature (201)..(201): n is a, c, g, or t
  modified_base (395)..(395): a, c, t, g, unknown or other
  misc_feature (395)..(395): n is a, c, g, or t
  modified_base (418)..(418): a, c, t, g, unknown or other
  misc_feature (418)..(418): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccagccggagtgttagtaagtacttaggctggtaccaacagaaacctggccaggcctcccgaggctcctcatctatgatgtacctccaacgagggtcacgtcggccgtccccgactaggttcaggttcggctaggtcgggtcgtgggactagtacttcacttctcaccgtnacgcagcctagcgcctagaagtnttttggacgtttactactgtcagcagtccgttccgccgtggccgtcttacggttcggggcggggactagggtggaggaggacggacgtaacggtggtcggcgtcgacctacgtagtcgtcgttcttgtaccgttccttcccgctatcctagtactagtacg

SEQ ID NO: 23780 - DNA, 747 bp, Homo sapiens
  misc_feature: GYAE6OF02HV3EJ.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaagngcccaccctctcctgcagggccagtgagatgttggcagctaacttcgccgtggtaccagacaacgaaccgtcggccgagggccctcccgaggtcccttccctccctctatcgtccgtcgtcctacccgaccgaccgggtcccccgttgggtccgtccccgacggccgttagggttccgggtttcggggtcgggttcggggtccgttggggaactagttacgtttcctacgttctaccgacctacgtaccggacggtcccggcccgtttaccgacggttccgtaaggttaaagttcgttttacgtccgtttaaggttttaacttacggttcgttaccgacggttacctacccgggttaacgaaccgtacccggttcccggtaacccccgtttaccggtttacccggccccggttacggggaacctaccggtacgtacggtaactaccgtaacccgaacggttacggtcggtacggcctaccggaccaccgttattaccgttccgtttactacccgttacgtttccccgttacccgtaccttaccg

SEQ ID NO: 23781 - DNA, 699 bp, Homo sapiens
  misc_feature: GYAE6OF02F0WT9.24.35.D02.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (389)..(389): a, c, t, g, unknown or other
  misc_feature (389)..(389): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtctttgtctccagggganagagccaccctctcctgcagggccagccggagtgttagtaagtcttaggctggtaccaanagaaacctggccaggctcccgaggcctcctcatctatgatcgtcnccaacgngggtcacgtggccgtccccgcgaggttcaggtggcgaggttcgggtctgggacacgtacttcactctcgaccgtnagtccacgcctagacgccgtagaacgtagttttcggtcggtttactacgttgtacgacgtctacgtccggttcccgtcgtcggcccgtacgtttaaccggtttccgggggaccggggggtaaccgagggggtacgggtaacgggaggggtaaccgggaacggtaaaccgttcgggtacgggtaccgtacggtaccgtaacccgtacggtttcccggttcggtttcccgtttaaccgtttaccgtttcccccgtttaccccggacccctttacgttacccggttaacggttaacccttaagtttaaccggg

SEQ ID NO: 23782 - DNA, 716 bp, Homo sapiens
  misc_feature: GYAE6OF02FGJTF.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtctttgctccagggganagacgccaccctctcctgccagggcccagccggagttgttaacgtaagtacttaggcttgggtacccaacagaaacctggccaggctcccaggcctcctcatctatgatgtctccaacagggtcacgtcggacgtccccgctaggttcagtggctaggtgggtctgggacaggtaccttcgactctacaccgtcacgcacgcctagcgcctagaagtattttgaccggtttactacttgtacagcacgtccgtttaccgccgttcgggacccgtaccgtttaaccggtttccgggggaccgggggggtaacccaggggggttacgggaaacgggtaacggggtaacggtaaccgggtaaaccgttcgggttacgggtccgtaacgggtaccctaacccggtaacgtttcccggttacggttaccccttttaccgtaacccgttttccccgtttaccccccgggtacgttaacccgtttcccggtaacgtaaacccgttacggttttaaacccggg

SEQ ID NO: 23783 - DNA, 733 bp, Homo sapiens
  misc_feature: GYAE6OF02JLD0E.24.35.D02.1.454.CMB.1.raw
  modified_base (199)..(199): a, c, t, g, unknown or other
  misc_feature (199)..(199): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (365)..(365): a, c, t, g, unknown or other
  misc_feature (365)..(365): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgagttgacacagtctccaggcaccctgtcttgtctccaggggngagacgccacctctcctgcagggccagccggagtgttagtaagtacgtaggctggtaaccaanacgaaacctggcaggctccagctcctnatctatgattgtcctaccaacgtaggtcaacgttggccgtccccgcgaggttcaggtgccggtagtcggggttacncgggtacacggtacttccgaacgttctcgtaacccgtgaacgtaccgacgtcccggtaagcgccgttagtaaacgttacttttggttaccggtttaaccttacgttcggttaccgaaggtccgtacgttcccgtttaccggtccttacgggttcccggtacgtttaacccggtttcgggggaaccgggggtacccgggttaacgggggtacggtaacgggggttaacggacccgggtaaagttaaccgggtcgggtgggtaccgttagcccgtaccggttaacgttcccggttagttaccggtttaacctaccgttacccgttccccggtaacttacgtccggttaaacgtccttaagggtttaaccg

SEQ ID NO: 23784 - DNA, 768 bp, Homo sapiens
  misc_feature: GYAE6OF02F8Y3N.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcaggccagccggagtgttagtaagtacttaggctaggtaaccaacagaaacctggaccaggcctcccgaggcctcctcatctatgattcgtctcccaacgtacgggtccacgtcgggccgtcccccgccgtaggttcgaggtcggacagggttcgggtccgtggggaaccaggtacctttaccgaaccgttccttacccgacccggttacacgccgtaacgcccttaaggaccgtccgtaggtaaacgttacgtttttcgggaccggttttttaacctacgttcgttacgtacgtacccgtacggttcccggttacccggtcccggttcggtaccccgggtaccgtttaaacccgggttttccggggggacccggggggtaaccggtacggggggttagggtacggaaaggggtaacggtaacggtaaaccgtcgggtacggtcgtaccggaccgtacccgtacgttccgttaccggttccgtttacctaccgtttacccgtttcccccggactttaccggttacctacgtaaaccgtagtttaaccggg

SEQ ID NO: 23785 - DNA, 555 bp, Homo sapiens
  misc_feature: GYAE6OF02G88ZW.24.35.D02.1.454.CMB.1.raw
  modified_base (164)..(164): a, c, t, g, unknown or other
  misc_feature (164)..(164): n is a, c, g, or t
  modified_base (278)..(278): a, c, t, g, unknown or other
  misc_feature (278)..(278): n is a, c, g, or t
  modified_base (288)..(291): a, c, t, g, unknown or other
  misc_feature (288)..(291): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (399)..(399): a, c, t, g, unknown or other
  misc_feature (399)..(399): n is a, c, g, or t
tcagactactatgtcacgaccggtgctcgatttagcacacgatagttgggtttgggggggaagaggaagactgacggtcctcccaggacgttcaggtgctgggcaccttgggcacggggagtgtgtcacaagatttgggctctgggcaccgtgggcatgggggngtgtggtcacgaaagagttttggggctggcctggtacaaacgggtactacgttccgaactataacgttagttacgtagaaggcgggctggacgaagggccgacaataaggcagncgactgcagnnnnaganacgacgcncgngcncanatatntgngtcacagacgacagacgcnananacgncgcncncgacagngnganacgngncngtntcgtagtacgtagtacgtactcncgtcgtgtgttacgtcgacgtcgagacgacgacgacgacgtacgtaacgacgtacgtacgacgacgtcgtccgtccgtacgtccgtaccgtcctaccgacctctacgtacgtacgtactcgcgtcgtcgtcggcggcgacgtacgtagaccgtacg

SEQ ID NO: 23786 - DNA, 774 bp, Homo sapiens
  misc_feature: GYAE6OF02G1YCO.24.35.D02.1.454.CMB.1.raw
  modified_base (200)..(200): a, c, t, g, unknown or other
  misc_feature (200)..(200): n is a, c, g, or t
  modified_base (312)..(312): a, c, t, g, unknown or other
  misc_feature (312)..(312): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctccagggganagacgcccacctctcctgcagggccagccggagtgttagtaagtcttaggctggtaccaacagaaacctggccaggctcccaggctcctcatctatgatgtcctaccaacgngggttccacgtcgggcccgtccccggactagggtttccaggtcggtacgaggttcgggtcgtacggggacacggtaaccttccaactttcctaccgaacccgttcgacggtccacggtaccccttaaggaccgtcccgtaagggtaaacgtttacggttttttacggaccggtttttaaccttacggttacggtacccgtaaggtcccgtaacgggttcccggtttccccggacccggttaccgggacccggttaaccgttttaaaccgggttttccgggggggacccggggggggttaaccccggtaaggggggttacggggaacggggtaacggggtaaccgggtaaaccggtaaacggtttcggacggggttacccgttaggaccctaccggtacgttcgttacggttccttacgtacttcccgttacccgctacgttccgaacgtaactagttaacgg

SEQ ID NO: 23787 - DNA, 733 bp, Homo sapiens
  misc_feature: GYAE6OF02HD81T.24.35.D02.1.454.CMB.1.raw
  modified_base (313)..(313): a, c, t, g, unknown or other
  misc_feature (313)..(313): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagccaccctctcctgcgaggccagccggagtgttagaagtacgttaggctggtaccaacagaacctggccaggcctccaggcctctcatctatgattgtcctccaacgngggtcacgtcggccgtcccgcgtacggttcagtcggctgggtcggtcgtcgggactagtacgttccaacttccgtaccaccgtcacgtccgacgtacccttaggaccgtaccgtaggtaaacgttacgttttttacggtaccggttttacgttaccgttgtaccgtacggacgtaccggttcccgtttaccccggcccggttcgggacccgttaccgtttaacccgttttcggggggaacccgggggtaccgtacgggggtacggaacggggtacggggacggtaacgggtaaacgttcgggtaacggtcgtacgtacccgtaacccggttagttcccggttcgttaccgtttaccgaccgttttaccccgttccccggtaacttccggtttaccctaacggtaaccgttaccgttaagg

SEQ ID NO: 23788 - DNA, 648 bp, Homo sapiens
  misc_feature: GYAE6OF02GP048.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagcccaccctctcctgcagggccagccggagttgttagtaagtacttaggctggtaaccaacagaaacctggccaggcctaccgaggcctcctcatctatgattgtactaccgaacgagggtcacgtcggccgtccccgcgtaggttcaggtcggacgtaggtcgggtacctgggaactaggtaccttcaccttctacgtaccgtacacgccagccctagacgtccgtagtaagtacgttttcggtaccggttttactacgttgtacagccgtacgtccggttcccgccgtacgaccctaacgttaccggtttcggggaccgggggtaccgtaggggtagggaacggagggacggtacgaacgtggtagcgtagaccgacgtacgtcgtacgttccttacgtacgttcccgttacccgactacgtacctacgtacctagttacg

SEQ ID NO: 23789 - DNA, 765 bp, Homo sapiens
  misc_feature: GYAE6OF02IBJVN.24.35.D02.1.454.CMB.1.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
tcagactactatgtcacgaccggtgctcgatttagcacacgatagttggggtttgggggaggaactgctcagttaggacccagagggaacccatggaacgccccagctcagcttctcttcctcctgctacctctggctcccagagaccaccggagaaattgtgttagacactagtctccaggcacctgtcttgtcctcgaggggagagactccaccctcncctncagggccaggccggaagttgttaacggtaaatacgttagggcctagggtaaacccaaacgaagaaaccgtggaccaacgggtccttaccccaggtcctacctcaacttccgtaatgattcgacctaagtaccgtaagtacggggaccctaacgtcggactacctacccaacggtaacgtaggttccgaaggtgggtacctagggtcgggggtactacggggactaccggacttaccaccttcgacaacctagcacggtaactaagcgtaagaccgtcgtaagagttaacttgaacgttaatttacgtacgtagtctaacggacctaaccgtagtaccaaacgttcccgggtaaaccctttaccggttacccgggtaccggaacgggttaacccctacgtaaaaccggttcggaaacccctaaagttaaccccggtaaggaaggttcccgggtaacgttaaccccggttagaacccgttaacccgtaagtttccggaaccgtttcctaaaccaacccgggttttcccccgaacttaacccgg

SEQ ID NO: 23790 - DNA, 720 bp, Homo sapiens
  misc_feature: GYAE6OF02HRQ9K.24.35.D02.1.454.CMB.1.raw
tcagactactatgtcacgaccggtgctcgatttagcacacgatagttgggtttgggggaggaactgctcagtaggacccagagggaaccatggaagccccagctcagcttctcttcctcctgctactctggctcccagagaccaccggagaaattgtgttgacacagtctccaggcaccctgttctttgtctcgaggggagagacgccaccctctcctcgcgacgggccaggccggtagttcgttaagtaacgttacgttaggctcggtaaccaaacgacgtaaaccgtcggaccgaggccctacccgaggtccttcctcgatctagtgtaatcgttccaccgaacgacgggtaccacgtcggccccgtccccgcgtacgggttcaggtcggccgtaggttcgggtcgtacgggacacgtaccttctacctaccgtctaccggtctacgactacgaccgtagacgtacctaggtaacgtttagttttcggttacgttttactacgttgtacgacgtacgtacgttccggttcccgtcgttccggcccgtttaccgttaccggggtttccgggggaccgggggtaccggagggggttacgggacgaaacggggtacggtaaccggttaacgtggtacgtccgcgaccgtccgtaagttcgttcgtacctttccaccgtttcccgtccctcgaacgttccgtaaagtaccgtagttaaccgg

SEQ ID NO: 23791 - DNA, 687 bp, Homo sapiens
  misc_feature: GYAE6OF02I14JD.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcgagggccaggccggagtgttaagtaagtacgttaggctggtaaccaacgagaaacctggaccgaggcctcccgaggcctcctcatctatgatgtctaccgaagcgggtcacgtcggaccgtcccccgcgtaggttccaggtcggacgaggttcgggtctacgggacacgtaccttccgacctcctaccgaaccgtcacgtcacgtccgtaagaccgtccgtaggtaagtttacgttttcggtaccggtttttactacgttcgtacgacgtaccgtacggttcccgttccggaccgttcgggtcccgttacgtttaaccgggtttccgggggaacgggggtaccgaggggtacggaggtaacggaacggtaaccgtacgtggtacgcgtccgactaccgtacgttcgttacgttcgttactaccgtttcccgtaccctaccgtccgttactacgtaccgtattaacgg

SEQ ID NO: 23792 - DNA, 604 bp, Homo sapiens
  misc_feature: GYAE6OF02HBOWW.24.35.D02.1.454.CMB.1.raw
  modified_base (301)..(301): a, c, t, g, unknown or other
  misc_feature (301)..(301): n is a, c, g, or t
  modified_base (401)..(401): a, c, t, g, unknown or other
  misc_feature (401)..(401): n is a, c, g, or t
  modified_base (551)..(551): a, c, t, g, unknown or other
  misc_feature (551)..(551): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagccatcaccggaggaattgtgttgacgcagtctccgaggccaccctgtctttgtctcgaggggagagacgcccaccctctcctgcgacgggccagtcagtagtgtagcagcagtctacttagcctaggtaccagcagaacctggcgtgcctccgagtcctcctntactctagtcggtcgccgtaccgaccgacgggccacggtcggccgtcggcgacgtggttcaggtgcgtaggtcggtcgttaggactagtacttcacttcntactcacgtacgacgtacgtacgtagggtaccgtaccgtaagttacgtttgacgtagttacgttacttacgttcgtctaggtcgtttcgtttccggtcccttccgttaccttcttcgtacgttactacggtttcgaccggttcgtaccgngtacggtcggatacgtctaacgtacgtacgttcggcgtcgtactccgactacg

SEQ ID NO: 23793 - DNA, 798 bp, Homo sapiens
  misc_feature: GYAE6OF02GS5GP.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtcctccgagggganagacgccaccctctcctgcgagggccaggccggagttgttaagtaagttacgttaggcgtggtaaccaacgaacggaaacctcggccaacgggcctcccgaggccttcctcgattctaatgacttcgtacctaccgaacgagggtctaccgtcgggccccgtccccgcggtacggttaccgaggttcggacgttagggtcggggtccgtaggggaccacgggttaccttaccgacctttccgtaccgtaccgtcgtacggtaccaaccggtccgtaacgggacgtaccgttaagggtaaacgttagtttttacgggtaccggtttttaaactaccggttacggtactacggacgtaaccggtccggtttacccgaccggtttccggcccgttaacgtttaccggggtttaccgggggaccgggggttacgacgggggttgggaaggtacgggaacgtaaccggtaacgtcgggacggttacgtccggtaccgtaccgtaactttcggttaccgtttaccgttacggttacccttcccggtttaccccggcccttttaaccgaccgtttaaccggtaaacggttagtttaaccggg

SEQ ID NO: 23794 - DNA, 611 bp, Homo sapiens
  misc_feature: GYAE6OF02F3QWF.24.35.D02.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggcaccctgtctttgctccagggganagagccacctctcctgcagggccagccggagtgttagtaagtacttaggctggtaccaacagaaacctggccaggctcccaggctccncatctatgatgtctcaanggtcacgtggctcccgctaggttcagtcgctaggtgggtctgggactagacttcactctcacgaagtcagcacgcctagacgctagaagtattttgcggttttactacgtgtacgacgtcgacgtccgttccgtccgtcggcccgtccttaaccggtttccgggccggggggtaacccgaggggtacgggtaacgggacgggaacgaaccggtaacgttgggtacggtccgtcgaccgtacctacgttccgttcgttacgttccgtacttcccgttcccgacctacgtccgtacgtaacgtacg

SEQ ID NO: 23795 - DNA, 668 bp, Homo sapiens
  misc_feature: GYAE6OF02G8RLK.24.35.D02.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (609)..(609): a, c, t, g, unknown or other
  misc_feature (609)..(609): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccgganaaattgtgttgacacagtctccgaggcaccctgttctttgtctccgagggganagacgccaccctctcctgcgacggccaggccggagtgttaagtaacgttacttaggcttcggtaaccaaacgtaaggaaaccgtggaccagggccttaccccggaggtcctcctacgtactactacgtgtacgttcgtcctaccgaacggtacgggtcctacggtccgggtcccctaccccggacgttacggttccgacggtcggtaccgagggttcgggtacgtcgggaactacgtaccttcacctttcgaccgaaccgtgacgcgtaacgccgtagcgtacctagtaacgttagtttacggtcgtttaacgtagtctacgcgtacgtccgttccgttccgtccgtcgtaccgtcgttacgggtccggggacgggtacgtagggaggagacggagacgagtcgngcgtcgactactgtcttgtctaccgtacttcccgtccgtctactcgactacgtatacgg

SEQ ID NO: 23796 - DNA, 614 bp, Homo sapiens
  misc_feature: GYAE6OF02FM9DL.24.35.D02.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcgagggccagccggagtgttagtaagtacttaggctggtaccaacagaaacctggccaggctccaggctccncatctatgatgtctccaagngggtcacgtggccgtccccgcaggttcagtggcagtgggtctgggacagtacttnacgttcacaccgtnagcagcctagacgcctgaagtnttttcgcggtttactactgtacaggcngtccgttcgccgttcggcccgtcgttaaccgtttccgggggcggggggtaccgtagggggtcggaaggacgggtacggaaccggtaacggtggtacggcgtaggaccaacctacgttccgttcggttactttaccgactttacccgtccccgtaccgttacttccgtaacgtaactagttaacgg

SEQ ID NO: 23797 - DNA, 589 bp, Homo sapiens
  misc_feature: GYAE6OF02HQOZ1.24.35.D02.1.454.CMB.1.raw
  modified_base (201)..(201): a, c, t, g, unknown or other
  misc_feature (201)..(201): n is a, c, g, or t
  modified_base (354)..(354): a, c, t, g, unknown or other
  misc_feature (354)..(354): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctcgagggganagagcccaccctctcctgcagggccaggccggagtgttagtaagtacttaggctggtaccaacgagaacctggccaggcctccaggcctcctctctatgctgtctcccaccgcggccctggtctcccagccgtggttcgtgggcggtggtcgngggacagtactttcactctccactatcgagcgcctcagtctagattnttncttactttatttctgtactaactactatcggtntacttcgtccttcgttacttcgtttcggccgtaacgggtaacctaacggtaggagtacgtacgaaacgtacgtacgtgtctcgactactacgtctcgttctacgtaccgttcccgttcccgtacctacgttaccgtacgtacgtagttacgg

SEQ ID NO: 23798 - DNA, 757 bp, Homo sapiens
  misc_feature: GYAE6OF02G2POF.24.35.D02.1.454.CMB.1.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtctttgtctccaggggaaancgccaccctctcctgcaggccagtgagaatgtggcagcaacttagcctaggtaccagcagaaacctggcaggctccaggcctccncctctatgctcgtctccaccgacggcccctggtcgtcccagccgtagttccggttggcggtcggtcgtaggactagtagtttccacgtcgtcgtaccgtacgtacgacgacgtccttacgacgtaccctaggtaaacgttagtttttacgggtaccggttttaaccgttacttcggttacgtacgtaccgtacggtacccggtttcccgtcccgttacgggtacccgttaccgtttaaaaccgggtttttccgggggacccggggggtaaccggtaacgggggttcggggtaaacgggaacggggtaacgggaccggttaaacggtacggttacgggtaccgttaccgggacctaacccggtagttacccggttcggtttacctttaacccgtaaccgttttccccgttaccccccggttacccgtaaccgttacccgttaaccggtaaaccgtagtttaaaaccggg

SEQ ID NO: 23799 - DNA, 787 bp, Homo sapiens
  misc_feature: GYAE6OF02IVE3T.24.35.D02.1.454.CMB.1.raw
  modified_base (148)..(148): a, c, t, g, unknown or other
  misc_feature (148)..(148): n is a, c, g, or t
  modified_base (487)..(487): a, c, t, g, unknown or other
  misc_feature (487)..(487): n is a, c, g, or t
tcagactactatgtcacgaccggtgctcgatttagcacacgatagttgggtttgggggaggactgctcagttaggacccagagggaaccatggaacgccccagctcagcttctcttcctcctgctactctgctccagagaccacgganaattgtgttgacacagtctccaggccacccttgtctttgtcctaccgaggggagagacgcccaccctcttccgaggccgacggggtccaaggtcccggggtagttagggtttaaagtaaacggttacctttagggacctttagggaaaccctaaacgaacggttaaaacccgtggacccagggtaccctcccgaaggtcctaccgtcaattcgtaatgacgttcgtcaccgaagtacgggtacacgtcggaccccgtcccgacgtacggtaccgaggtcggtcgtagggtcgggttacgacggtacagtttaccctacaccttcgttaccgaaccgtanaccgacgtacgtacccgtagacgacgtagtaagttacgttttacgggtacgtttactacgttcgtacgacgtacgtacggttccggttaccgtccttacggggtacccgttacgttaaacccgggtttccgggggaaccgggggaccggtaacggggtacgggacgggtaaagggtaaccggaacggttaaccggtggtaccggtgtaaccgccgtaacgtccgggtttactccggttacctacccgtttacgttcccgttaacccggtctacttaccggtaacgtactagtttaacggg

SEQ ID NO: 23800 - DNA, 742 bp, Homo sapiens
  misc_feature: GYAE6OF02HYC2O.24.35.D02.1.454.CMB.1.raw
  modified_base (140)..(140): a, c, t, g, unknown or other
  misc_feature (140)..(140): n is a, c, g, or t
  modified_base (717)..(717): a, c, t, g, unknown or other
  misc_feature (717)..(717): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccaganaccaccggagaaattgtgttgacacagtctccaggcaccctgtctttcgtctccgaggggagagacgccaccctctcccgtgccgacgggccaggccggagttagttagtaagttacgttaggcgtaggtaaccaacgagaaaccgtggaccacggcctccccgaggtcctcctacacttctactgtactcgtacctaccgaacgtacgggtccacggtccggtcccgtcccccggacgtacggttcctaggtcgggcgtacgggttgggtccgtagggacacgttacttccacgtcctaccgtaccgtacacgaccgtacgacccgtaaggtaccgtaccgttaaggtaacgtttacgtttttcgggtaaccggttttacccttagttacgtacgtaccgtaccgtcggttcccgttcccgtccggttaccggtcccgttaccggtttaaccggtttccggggggaccgggggtacccggtagggggtcgggaacgggacgggtaaccggtaacgggtaacgttggtccgagtcgaccgtacgtacgtcgttcgttctcttaccgtccgttacccncgtaacttcgacttacgtagtaacg

SEQ ID NO: 23801 - DNA, 676 bp, Homo sapiens
  misc_feature: GYAE6OF02F62DE.24.35.D02.1.454.CMB.1.raw
  modified_base (446)..(446): a, c, t, g, unknown or other
  misc_feature (446)..(446): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccacctctcctgcagggccagccggagtgttagtaagtacttaggcgtggtaccaacagaaacctggccaggctcccaggcctcctcatctaagtgaatcgtactccgaacgtggtcacgtcggccgtccccgtcgtagggttccaggtcggactaggtcgggttccgtagggacacggtacttcgaaccttctacgaccgtcgaacgtccaacggccctaagaccgtcctagtaacgttnttttcggaccgtttttacacgttcgtacgagtccgtagtccggttcccgtcgtcgggtccctacgttaaccggttcggggaccgggggtaccgtagggggtacgaaggggtacggaacgtaaccgtaacgttggtaccggtcgtacggacctaaccggacgttccggtcgtttaccgttaccgtacgttccccgttaccgccttacgtaccgtacgtaaccagttaacgg

SEQ ID NO: 23802 - DNA, 745 bp, Homo sapiens
  misc_feature: GYAE6OF02GGUZT.24.35.D02.1.454.CMB.1.raw
  modified_base (151)..(151): a, c, t, g, unknown or other
  misc_feature (151)..(151): n is a, c, g, or t
  modified_base (302)..(302): a, c, t, g, unknown or other
  misc_feature (302)..(302): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccgganaaattgagttgacacagtctccaggcaccctgtctttgtctccgaggggagagacgccaccctctcctgcagggccagccggagtgttagtaagtacgttaggctggtaaccaagacgaaacctcggaccacggcctacccgaggcctccncatctatgtatcgtactaccgaacgcggtccacgtcggcccgtaccccgcgtacggttcgagtcggctagggtcgggtctgggaacctaggtaccttccgaactttcgtacccgaccgtacgacgtccaacgtaccgtaaggaccgtacctaaggtaacgtttagttttacggtaacggtttttacctaacgttcgaccgtagtaccgtacggttcccggttaccgtccggttccgggtccccgttaacggtttaacccgggtttcccgggggggaaccggggggtaacccgtagggggggttacgggtaaacgggacggggttaaccggaaccggttaacggttcggggtccggaccgttacgaccgtacccgtaggtttccgtacgttccttactacccgttcccttcccggactaccgttccgtaagaaccttgtaccgg

SEQ ID NO: 23803 - DNA, 768 bp, Homo sapiens
  misc_feature: GYAE6OF02IP24J.24.35.D02.1.454.CMB.1.raw
tcagactactatgtcacgaccggtgctcgatttagcacacgatagttgggtttgggggagaactgctcagttaggacccagagggaaccatggaagccccagctcagcttctcttcctcctgctactctggcctcccagagaccaccggagaaattgtgttgacacagtctccgaggccaccctgtctttgtcctccgaggggagagacgccaccctctcctgcacgggccaggccggagtgttagtaagttacttaggactggtaaccaacgacggaaacctggaccaggtcctacccgaggtcctccgtacactactactcgagttcgtcctaccaacgtacgggtcacgtcggccgtccccgacgtaggttacgacggttcgggcgtaggttcgggtcgtacgggaccgtacgtaccgttacaccgttcgtacccgtaccggtacgaacgaccgacggtcccgtaaggtccgtccgttaaggtaacggtttacgtttttacgggtaccggtttaaccgttaccgttaggtaccgacggtaccgtaccgggtccgtttacccggccgtccgggtacccgttaccgtttaaacccgggtttccgggggaccggggggtaccgtaagggggttacgggacggtaacgggacgtaaccggtaaggttcggcgggtcgtcggaccgtaaccgtcgttccgttccgttaccgttaccgtaccgtttccccgtacccgtaccgtacgttacccgtaagtacctagttaacgg

SEQ ID NO: 23804 - DNA, 630 bp, Homo sapiens
  misc_feature: GYAE6OF02GWL7V.24.35.D02.1.454.CMB.1.raw
  modified_base (204)..(204): a, c, t, g, unknown or other
  misc_feature (204)..(204): n is a, c, g, or t
  modified_base (488)..(488): a, c, t, g, unknown or other
  misc_feature (488)..(488): n is a, c, g, or t
  modified_base (503)..(503): a, c, t, g, unknown or other
  misc_feature (503)..(503): n is a, c, g, or t
  modified_base (584)..(584): a, c, t, g, unknown or other
  misc_feature (584)..(584): n is a, c, g, or t
  modified_base (598)..(598): a, c, t, g, unknown or other
  misc_feature (598)..(598): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggcaccctgtctttgtctccaggggaaancgcccaccctctcctgccagggccagtgagatgttggcagactactacgcctaggtaccagcaagaacctggccaggcctccgaggtcctccctctactatcgtcttgtcctccgaacccgtacgggtccccttgggtcctaccccgagtcccgtaggtttccgacggtcggacgtcggttgggtcctacgggggactacggtaccctttgaccttctaccgaccgtcacgaccacgtccgtagacgtacctagaacgttgtttcgtacgtttactactgtacngtctagtccgttccncgtcgccgtacttacggttcgggccggggtacgtgggacggagcgaacgacgtaacgtgaccggtctacggacgtaacgtnttacgtctcttacncgttcccgtaccgcctacgttccgagtaaccg

SEQ ID NO: 23805 - DNA, 578 bp, Homo sapiens
  misc_feature: GYAE6OF02G9MIJ.24.35.D02.1.454.CMB.1.raw
  modified_base (202)..(202): a, c, t, g, unknown or other
  misc_feature (202)..(202): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccagccaccctgtcttgtctccaggggaaangccaccctctcctgcagggccagtgacaatgttaggagttgttagctggtatcaacacaaacatggccaggcctccccggctcctcatctatgatgcatccaatacgggccactggcactcccaagacaggttcagtggcnggtgggtctggggacngacttcactctcaccatcacgccgcctccagtctgtaagtatttgacttacttttactttcgttgttactaactacttagtgtctacgttcggtacccttccgttactacgttttcgggaccgtacggggtaacccaaacgttggaagtacttacgaaaccgtacgtacggtggtacctcgaccgacctactcttcgtacttacctattcccttccccg

SEQ ID NO: 23806 - DNA, 723 bp, Homo sapiens
  misc_feature: GYAE6OF02H56GO.24.35.D02.1.454.CMB.1.raw
  modified_base (234)..(234): a, c, t, g, unknown or other
  misc_feature (234)..(234): n is a, c, g, or t
tcagactactatgtcacgaccggtgctcgatttagcacacgatagttgggtttgggggaggaactgctcagttaggacccagagggaaccatggaaaccccagcgcagcttctcttcctcctgctactctggctcccagccatccaccggaggaattgtgttgacgcagtctccaggcaccctgtctttgtctccgaggggagagacgccaccctctcctgcagggcagtcagngtgttagcagcagctactagcctggtaccagacagaaccgtggcctcgcctcccgaggtcctcctcacttcgtagtcggtgccgtccaccgagggccacgtcggcgtcgacggacgtaggtcgaggtcggactacggtggttccgtttagggaccgtaggtacctttcgaaccctttcgtaccgtaacgtacgtactccggaaacgtacggtaccgttacgggaacccggtaaccgtaaggttacgttttacggaccgttaaggtttacggttaacgtttacgttcggttacctaggttaccgtttcgggtttccgttcccctttaccgttaccccgtttaccgttaagttcccggtttaaccgtttccggttttacggacccggttacgggtttacccgtacgggttcggtaacgggattaaccgtaacggtaacggttacgacggtttcggacgggtctacccggtaacccttaccgtatttcccgg

SEQ ID NO: 23807 - DNA, 803 bp, Homo sapiens
  misc_feature: GYAE6OF02G3OMR.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgccctaccctctcctgcgacgggccaggccggtagtgttagtaacgttacgttaggctagggtaaccaacgagtaaaccgtcggacctaacggcctcccgaggcctccgtactataccttatcgtacttcgtacctaccgaacgtacgggtacaccggttcggtccccggtacccccgtaccgtagggttaccctagggtaccgggcgtacgggttcgggggtccgtaacgggaccgtaacgggttacctttaccgaccgtttccgtaccgtaccggttacgacgtccgaaccgtccgtaacgtacgtccggtaagtaaacggtttacgtttttcgggttacgttttaaccgttacgttcggtacgtacgtacgtaaccggtccgtttacccggtcccgttcgggtacccgttacggtttaacccgggtccgggggtaccggggggtaccgttagggggtaccgggaaggggtacggtaacggtacggtaaacgggtcggtaacgggtcttacggccgttaacgtgtccggtttacgttccttaccgcgttttcccctacccggtaccttacgttccgtaacgtaacgttggtaacg

SEQ ID NO: 23808 - DNA, 591 bp, Homo sapiens
  misc_feature: GYAE6OF02GP75A.24.35.D02.1.454.CMB.1.raw
  modified_base (204)..(204): a, c, t, g, unknown or other
  misc_feature (204)..(204): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccagccaccctgtctgtgtctccgaggggaaangccaccctctcctgcagggccagtgagaatgttggcagcaacttagcctggtaccagcagaaacctggccaggctcccaggctcctcctctatgctgtctccaccacgggcccctggtcgtcccagcctaggttcgttgggcggtggtcgtgggactagtactttcgactctcactatcgacggccgcctccgagtctagtaagttattttgcttactttattttcctgttaccaactacttagttggtcgtactcggtcccttccggtaccttacgttttggacccgtaggggaccctaaacgtggaagactacgaaacgtacgtggtacgcgtacgaccacctaatcgttcgtcttactaccttccgttaccccgctacttaccg

SEQ ID NO: 23809 - DNA, 643 bp, Homo sapiens
  misc_feature: GYAE6OF02FQZHR.24.35.D02.1.454.CMB.1.raw
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcaccctgtctttgtctcaggggagagagccacctctcctgcagggccagccggatgttagaagtctaggctggtaccaacagaaacctggccaggctcccaggctccgtcatctatgatgtctaccaacgnggggtccacgtcggccgtccccncgaggttcaggtcggctaggtgggttcgtggacagtacttcactcgtacacgtcagtcacggtcctaacgacgtcctaggtaacgtacgtttttcggacggttttaactacgttcggtcgacggtacctacgggtcccgtttccgcccggttcggtcccgttaccgttaaccggtttccgggggaccggggggtaccgtagggggtacgaagggaggacggtaacgtaccgtggttggacttccggactacgagtttcgtcgtttctactacgttcccgttcccaccgttactaccgtacgaccttagttacgg

SEQ ID NO: 23810 - DNA, 655 bp, Homo sapiens
  misc_feature: GYAE6OF02GYMF3.24.35.D02.1.454.CMB.1.raw
  modified_base (314)..(314): a, c, t, g, unknown or other
  misc_feature (314)..(314): n is a, c, g, or t
  modified_base (635)..(635): a, c, t, g, unknown or other
  misc_feature (635)..(635): n is a, c, g, or t
tcagactactatgtcacgaccggtgctcgatttagcacacgatagttgggtttgggggaggaactactcagttaggacccagagggaaccatggaagccccagctcagcttctcttcctcctgctactctggctcccagagaccaccggagtaaattgtgttcgacacagtcctccaggccaccctgtctttgtctccgaggggagagacgcccaccctctcctgcgagggccaggccggagtgttagtaagtacttaggctggtaaccaacacgaacctggccacggacctcccgaggcctccgtctatctangtactgttacctaccgaacgtacggtacacgtcggtcccgtccccgcgacggttcgacggttcggcgtaggtcgggtcgtacggacagtaccttcgaccttctaccgaccgtcacgtccacgacctagacgtacgtagattacgttttcgtacgtttactcttagcagacgtacgtccgtccgcgtcgcccgtcgttaccggttcggggacggggtacgagggtggaggaaggacgaaccgtagtacgggtcgagtaccgcgtacctgtcgtcggttcttaccgacccgtttcccgttaccccgacgttactaccgttaanaaccgttacgtagttaccgg

SEQ ID NO: 23811 - DNA, 855 bp, Homo sapiens
  misc_feature: GYAE6OF02HLQ9C.24.35.D02.1.454.CMB.1.raw
  modified_base (202)..(202): a, c, t, g, unknown or other
  misc_feature (202)..(202): n is a, c, g, or t
tcagactactatgtcacgaccggtgctcgatttagcacacgatagttggggtttgggggaggaactgctcagttaggacccagagggaaccatggaagccccagctcagcttctcttcctcctgctactctggcctcccagacgaccaccggaagaaattgtagttgacacagtctcagcacctgtcttgtctcgagggganagacgccacctctcctgcgaggccagtgaagtattggttcggacacgtactaacgttagccgtaggtaccagactaacgaacctggaccgacggcctacccgacggtcccttaccctcctacttatcggtccttcgttccctacccgaccggtaccgggcccccgttagggtcccgtaccccgtacggtacccgttacgggttccggggtttcggggccgggttacggggttacccggttacggggaccttacgggttaacctttcccggttaaccgttccgtaacccgtacctacgttaacccgaagggtaccttagggtacggttaaccggacgtaccgggttaacggttaaacgtttacggttttacggtacgttttaaacgttttacgtttaaccgttcggttaacgttacggttaacccgttaacggttaaccgtaaccgttaaccgttacccggtaccccgtttaaccgggttttaccccgggacccggttacccgggtaacccgtaccggttaaccgttaacggtaaccctaacggtaacccgtaaaccggttacgtcgggttaaccggtcggtaaccgtaacctaccggtacgttaccgttcgttacccgtccttaccgttacccgtccctacggtcttaaccgg

SEQ ID NO: 23812 - DNA, 658 bp, Homo sapiens
  misc_feature: GYAE6OF02F5MGW.24.35.D02.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (316)..(316): a, c, t, g, unknown or other
  misc_feature (316)..(316): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
tcagactactatgtcacgaccggtgctcgatttagcacacgatagttgggtttgggggaggaactgctcagttaggacccaggagggaaccatggaagccccagctcagcttctcttcctcctgctactctggctccagagaccaccggagaaattgtgttgacacagtctccaggccaccctgtctttgtctccagggganagagccacctctcctgcgagggccagccggagtattagtaagtacttaggctaggtaaccaanagaacctggccaggctcccagcctcctcatcgtatgatcgtctccgaacgngggtccacgtcggcccgtccccgcgtaggttcaggtcggcgtaggtcggtcgtagggacaggtaccttnacctttccncgtaaccgtcgaagcctacggcctaggactccgtagtaagttcgttttgtaccggtttactcgtgtccagtccgacgttccgttaccggcccttacgggccttaccgttaacgggtttcgggggaccgggggtaccgaggggttcggaacggtacggggaataaaccgggtcgttacgggcgtaccgtacggtaccaaccggtgtttcgacggttttcaccttaccgttcccgtccgtaccagttaccgacgtactagttacgg

SEQ ID NO: 23813 - DNA, 806 bp, Homo sapiens
  misc_feature: GYAE6OF02FR35N.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgccaccctctcctgcgagggccaggccggagtgttaagtaagtacttaggctggtaaccaacaacgaaaccctggaccaggcctaccccgaggtcctcctcatctatcgattgtacctacccgaagtcgggtccacgtcgggcccgttaccccggccgtaaggttccgaggtcgggacgtaggtcggggttccgtacggggaactacgtaccgtttcccaacgtttcccgtacgtacccggtacgacgtacccgaacgggtaccctaaggtaccgtaccgtaggtaaacgtttacggtttttacggtacggtttttaaccgttacgttcggtaccgtaacggtccgtacgttcccggttacccgtcccgttccgggtacccgtaccgtttaaccgggttttcccggggtaccgggggggtacccggtaacggggggttacgggtaacggggtacggggaacgggttaaccgggtaaccggttagggttacgggtaccgtcggtacccgaccgtaaccggttccgttaccggtttaccgttaccggtaccttcccgttaccccgtaccttaccgttaccgtacgtaacgtacggttaacgg

SEQ ID NO: 23814 - DNA, 827 bp, Homo sapiens
  misc_feature: GYAE6OF02IGLC5.24.35.D02.1.454.CMB.1.raw
  modified_base (208)..(208): a, c, t, g, unknown or other
  misc_feature (208)..(208): n is a, c, g, or t
  modified_base (329)..(329): a, c, t, g, unknown or other
  misc_feature (329)..(329): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagaccacggagaaattgtgttgacacagtcctcgagccacccgtgttctttgtacctccgaggggacngacgccctacctctcctgcgacgggccaggccgtagtagttagtaagttacgtaggtcgtacgtacgtaaccacgaaacgtacgccgagaccgtccgtacgcgtcctctactctaacgttnacgttactccttacccaacggtacgggttccacgtccggtaccctacccccggtcccgtacggttttacggacgtaccgggttacgacggttccgggggttacgtaccgggtaaccggaacgttccgtaacccttcccgttaccctacgggtaacccttaccgggataaccgggcccctaccggtaagtacccggttaaccgtacggtttaaacgtacggttttacgttaacgtacgtttacggttaacgtttaccgttacgtacgttaccgaacggtaccggttaacgttaccgtaaccgtaaccgttaccgtacccgttaacccttacggttaaacttttacccgtaacggttttaccggtacccggttaccgggaaaccgtacgtacgtaaccgtagtacccgtaaacgtaccggtaacgtaaacggttcggtaaccggtacgtaaccggttccgaaccttccggttacctttccggttaccttacgttaccccg

SEQ ID NO: 23815 - DNA, 939 bp, Homo sapiens
  misc_feature: GYAE6OF02HE0FX.24.35.D02.1.454.CMB.1.raw
tcagactactatgtcacgaccggtgctcgatttagcacacgatagttgggtttgggggagaacgtgctcagttaggacccagagggaaccagtggaacgccccagcctcagcttctctcctcctgcttactcgtggcctcccagtacgaccaccggagaaattgtgttcgactacagtctaccaggccaccctggtcctttcgtcctaccgagggggactacggaccggtaccctaaccccgtccgtcccgtcgaccgaaggggtccccaacgggtcccgggtaggtttagtttaaacggtaaacggtttaaccgttaacggggtacctttacggggaaaaccctaaaaacgtaacggtaaaaaccccgtttcggggaccctaacggggtacccgttaccccgaaggggtccccttacccgttacccgtaccgttaacggtccgtacccgttccggttcctaccccgtaaccggtaccggggtacccccgttgggtaccgttaccccaacgggtaccgtaacgggttttccggttcggggtcccgggttcgggttaccggtacgggggtaacctacggtaccgtttacgaccgtttcacccgttacacgtccgaacgtcccggtaccctaccgtaacgtcctacggtaacgttacgtttcgtacgtttaccgtacgtaccgtcgacgtcgtacgtccggttccgtcgtacggtacgtcgttaaaccggttcggggaccggggtactacggggtacgggaacggacggtaaaccggtaacggtaccggttacggtacggtaccgttacgaacccgtaaccgttcgttacccggtttacggttacccgttccgttaaccggtttccccggttacccgacggtttaccgttacggtaccgttaaccgtaacggttaacccggtttacgaaccggttaccggg

SEQ ID NO: 23816 - DNA, 604 bp, Homo sapiens
  misc_feature: GYAE6OF02IG123.24.35.D02.1.454.CMB.1.raw
  modified_base (203)..(203): a, c, t, g, unknown or other
  misc_feature (203)..(203): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
tcagactactatgtcacgaccggtgctcgatttagcacacgatagttgggtttgggggaggaactgctcagttaggacccagagggaaccatggaaaccccagcgcagcttctcttcctcctgctactctggctcccagccatcaccggaggaattgtgttgacgcagtctccaggccaccctgtctttgtctccgagggganagacgcccaccctctccctgcagggccaggtcaggtgtgttagcagcagctacttagcctggtaccagcagaacctggcctggctccgaggcctcctcactctagtggtcgccgtccgaccgcggccacgtcggcgtcgcggacgtggtcgagtcggcaggtggtcgtttggacacgtacttcacctctcactcacgtccgacgtacgacgtggacgacccgtaagtntttcgacgtagtnttacgttacgtgtcgtcgtcttggtttccgtcccttcgttccctccgttacgttctaccgtttacgtttccggccgttacgggttccgacggttcgtacggtaacgtactacgaacggttacgtacggtcggtcggttacctcgtaccaccgttgttccg

SEQ ID NO: 23817 - DNA, 906 bp, Homo sapiens
  misc_feature: GYAE6OF02JWGHA.24.35.D02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccggagtaaattgtgttgacacagtctcagcacctgtcttgctcgagggtnagacnccaccctntcctgcgcggccaggccggtagttgttaagtaacgttacgttaggcgttacggtaaccaacgaacggaaacctcggaccgacggtcctcccgaagtcctcctacattcctagtgtacgtcttcctacgaacgtggtacctccggtcggcccgttccccggacgtacggttacgagggtcggaccggttagggtcgggttaccggtacggggtacctaccggttaccttacccgacgtttaccccgaccggtcccgttaacgaaccgtacccggtacggtacccgtaaacgggtacccgttaccgggttaacgtaaacggtttttacggtttttcccgggttaaaccgtttaacgtttaccgtggttaccgtaaacggttcggtaacccgggtttccccggttccgtaacccgggttccggggttaaccccgtttccgggttttaaaccccgggggtttacccggggggggacccggggggtttaaaacccggtgggggtttaacccggggtaacgggggttaaccgggtaaaccgggtaaccgggtttaccgggtcgggttaaccggttccgaaccggttaaccccgctttaaccgggtttccgtaccgtttttaccgtacccgtttaacccgttccccgggttaacccgtcgtaaaccgtttacggaaccggttaaaccggtttgttaaaccggg

SEQ ID NO: 23818 - DNA, 855 bp, Homo sapiens
  misc_feature: GYAE6OF02G4D5C.24.35.D02.1.454.CMB.1.raw
tcagactactatgtcacgaccggtgctcgatttagcacacgatagttggggtttgggggaggaactgctcagttaggacccagagggaaccatggaagccccagctcagcttctcttcctcctgctactctggcctacccagagacccaccggagaaattgtgttgacacagtctccaggccaccctgttcttgtctccgaggggagagacgccaccctctcctgcgagggccaggaccggtagtagttaaggtaacgttacgtagggctacgggtaaccaaacgaacgtaacccgtcggacccgacggtcctacccgaggtccctacctactattctaatacggtattacgtcctaacccgaacggtacgggtaccaccggttaccgggaccccgtacccccggtacgttaacgggttccgacgggttccggacggttacgggttacggggtccgtaacggtaaccgaacggttacccttccgtaaccctccgtaccgtaaaccggtcaacggtcccgaagttacccgtaggtacccgtacgtaacggtaacgtttacgttttacggttaccggtttactacgtttacgtaacgtacgtaccgtaccggttccgttacccgtaccggtcggtacccggttacccggttaccgggttaccggggggtaccggggggtaacggtacggggggtacggtaacggggtaacgggtaacgggtaccgtaaacgggttcggtacgggtaccgtaccggtacctaccggtacggtttccgttacggttaccgttacccgtaccgtttaccccggtcccgtacgttaccgttaccgtaacgtaacgttaccggtttaaccgg

SEQ ID NO: 23819 - DNA, 665 bp, Homo sapiens
  misc_feature: GYAE6OF02HV5AK.24.35.D02.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (568)..(568): a, c, t, g, unknown or other
  misc_feature (568)..(568): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccacggagaaattgtgttgacacagtctcaggcaccctgtctttgtctcaggggtanagagccacctctcctgcaggccagccggagtgttagaagttacttaggcttggtaccaanagaaacctggaccaggcctccgaggcctcctcatctatgacttgtacctaccgaacgtacgggttcacgttcggtccgtcccccggctaggttcaggttggcgtaggtgggtcgtgggactagtacttcactctcgaccgtcacgtacacgtcctaagaccgacccgaagttacgttttcgtaccggttttactacgtcgtacgtacgcgtacgtccgttccgccgttaccggccgtaccgtttaacggttccggggtaccggggggacgtacggggtacgggacggaagggacggtacgaacgttcggnggtccgtgtcccacgtacgttcgtacggttccttacgtaccttcccgttccccgtaccgtaccgttccgttaccggtaaacttacgttagttaccgg

SEQ ID NO: 23820 - DNA, 666 bp, Homo sapiens
  misc_feature: GYAE6OF02FZT0Y.24.35.D02.1.454.CMB.1.raw
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
  modified_base (541)..(541): a, c, t, g, unknown or other
  misc_feature (541)..(541): n is a, c, g, or t
tcagactactatgtcacgaccggtgctcgatttagcacacgatagttgggtttggtggaggaactgctcagttaggacccagagggaaccatggaagccccagctcagcttctcttcctcctgctactctggctcccagagaccaccggagaaattgtgttgacacattctccaggcaccctgtctttgtctccgaggggagagacgccaccctctcctgcagggccaggccggagtgttaagtaagtacttaggctggtaaccaacagaaacctggccaggcctcccaggcctcctcatctatgtatgtcctaccaacgagggtccacgtcggccgtccccgccgtacggttcaggtggactagggttggggtctagggacngaccttcactctcaccgtnacgtcacgcctagacgccgtagtaacgtagttttcggtacggttttactaccgttagtaccgtacgtacgtacggttcccgttcccggtcccgtcgggccgttaccgttaacggtttccgggggaccggggggtaccgngggggtacgggagggtaaggacggtaacgtacgtgggtacgcgtacgaccgtaccgtgtaccgtttcgttacgttacctcgtttacccgttcccgtaccgtacgtttaccgtagtaaccttacgg

SEQ ID NO: 23821 - DNA, 793 bp, Homo sapiens
  misc_feature: GYAE6OF02F1VB9.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagagccaccctctcctgcagggccaggccggatgttagaagtacttaggctggtaccaacagaacctggccaggcctcccgaggcctcctcatctagtgactgtacctaccgaacgtagggtccaccgttcgggccccgttcccccggcgtaagggtttccaggttcgggccagggttcgggtaccgtggggaaccaaggtaaccttccgaaccttccgtaccgaaccggttccaaggtcccgaacggtcccgtaagggtaccgcccgttaaggtaaacggtttagtttttccgggtaaccggtttttaacctacggtttcgtaccgtaacgtaccggtaccggttcccggtttcccgcccgttccgggacccgttacgtttaacccgggtttccggggggacccgggggtacctaggggggttacggacggggtaacgggtaacggtaaccgggtaacgtcgggttacggccgttacggacccgtaaccgtacgtttccgttaccgtttacccgttaccgtaccctttcccggtttaccccccgtacgttaacccgttacgttaacccgggtaacttagggttaacccgg

SEQ ID NO: 23822 - DNA, 582 bp, Homo sapiens
  misc_feature: GYAE6OF02F8W0G.24.35.D02.1.454.CMB.1.raw
  modified_base (318)..(318): a, c, t, g, unknown or other
  misc_feature (318)..(318): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgctccgaggggagagagccaccctctcctgcagggccagccggagtgttagtaagtacttaggctggtaaccaacagaaacctggaccaggcctcccgaggcctcctacatctatgatgtacctccgaangggtcacgtggccgtcccgcgtagttcagtggcaggtcgggtctgggacacgcttcactctacacgtcacgcacggtcctagacgtccgtagaacgttcgttttcggacggttttaactacgtgtcacgtcgacgtcgttaccgcgtcggccgtacgttacgttcgggacggggtacgagggtgagaggagtacgtagtggtagcgtgacgactgtcgtacgttctctacgttccgttcccgctacgttccgatacgtatacgg

SEQ ID NO: 23823 - DNA, 794 bp, Homo sapiens
  misc_feature: GYAE6OF02HPP24.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctccagacgaccgacggaagtaattgtgtgacacgtagtctccgagcctaccctgttctttgtcctacggaggggagacgacgccctacccttccgtctgacgacggccacggccggtagttagttaaggtaagttacgttaggcgtacggtaaccaacgaacgtaaccgtggccgacggtccctacccgtaacggtcctacccgtacgtacttaccgttagttagtaacgttcgttacccgtaacccgaaggttaccgggtactaccggtaccgggtaccccgtcccccggtaccgttaacggttaccgacggttcggacgtacgggttcgggtcgtacgggactaacgtcgttacctaccgtaccgttaccgaccgttacacgtacccgtacgtaccgtaagccgtaaccgtaaggttaacgttttacggttttaacggttacccgttttaaacgttacgttacgttacgacggtaccgtacggttcccggttacccgtccggtaccggtaccccgttacgtttacccggggttaccggggaccggggtacggttaggggtacgaggtaacggacgtaacgtacgtggaccgtgaccgctacgtcgttgttcttacgtaccgacgtttccgtaccctctacgtcgtaatacgtagtacg

SEQ ID NO: 23824 - DNA, 923 bp, Homo sapiens
  misc_feature: GYAE6OF02HQ30T.24.35.D02.1.454.CMB.1.raw
tcagactactatgtcacgaccggtgctcgatttagcacacgatagttgggtttgggggaggaactgctcagttaggacccagacggaaccatggaagccccagcgcagcttctcttcctcctgctactctggcctccagactaccactggagaagtagtcatgacgcagtctccagccacctgtctgtcgtactcgaaggggaatcgccctacctctcctgcgacggtacctgtacgaagaagttcggttggacaggtcttaacgttacgtccgtacggtaccgagtacaacgtaaccgtcggtccacgggtccctacccgacggtccttacccgtacctctacgtcgtccgttgtcccttacccgaaccggaccgggttccccgtcggttacccgtacccgtacggtaccggttacggggtttacgggttcggggttccgggttcgggggttaaccgttacgggggtaaccgttaaacgggtttccgttttaacccggtacccgtttacccgtaacccgttaaacccgtttaaacgggtcccgtaaacccggggttcccccgggttcccggtttacccggttaaccggttaccgtttaaacggggtttaaacgtttaaccggtttttccggtaaccggtttttaacgtttttaaccgtttttaccgtttaccggtttaaccttaaaccgttaacgttacggtttacgggtttaccgtaccggttaccgttaccccggtttaccggtttaacccggtttaaccgttttacccgggacccggttaacccggggtaaacccgtttaaacgggtacggtaacgttaacccgttaaacgtaaacccgttacggttacggtaccggtacgtacccgcctaaaccgtcgttaacgtcttccgttacgtaccttcccgttacccgtaccg

SEQ ID NO: 23825 - DNA, 868 bp, Homo sapiens
  misc_feature: GYAE6OF02JARXV.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctccagacgaccaccggagaaattgtgttgacacagtcctcaggccacccttgtctttgtcctaccgagggagtagacgtcccacccgttcctcccgtgccgacggggcccaaggtccggtaggttggtttaacggtaacggttaccgtttaggaccgttacggtaacccaaagtaaccggtaaaccgttcggacccgtaagggccctaccgacggtcctacccgtacgaccttactacgtgtacgttaccgtaccgttacccgaaggtacgggtaccgtaaccggttcgggtccccgtaacccccgtacgtacgggtttacccgaacgggttgggacccggttaagggtccggggttaccgtaggtaacccgtaaggttacccttccgtaaccgtttcccgtaccgtaccggtactaacggtacgacccgtaccgtaacgaccgtaccgtaacggtaacgtttacgttttacgggttaccgttttacgttaacgttcgtaaccgtacggtacgtaccggttccggttacccggtccgttaccggcccggtttaacgttaccgggttacccgggggtcggggaaccggttacggggttacggaacggttacgggcgtaaccggtaaggtcggtaacgtcggtcgaccggttacctagtcggttaccgttaccgttaccgtacgttccccgttacccggtaccttacctacggtaacccgttagaccgtttaccgg

SEQ ID NO: 23826 - DNA, 857 bp, Homo sapiens
  misc_feature: GYAE6OF02GKD8S.24.35.D02.1.454.CMB.1.raw
  modified_base (204)..(204): a, c, t, g, unknown or other
  misc_feature (204)..(204): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtctttgtcctccgagggganagacgcccaccctctccgtgcagggccaggccggagttgttagtaagtacttaggctcggtaaccaacacgaaacctggccacggcctacccgaggcctcctcactctatgactcgtacctaccgaacgacggtacacgtcggacccgtccccgcgacggttcaggtcggcgtaggttcgggtacgtacggacacgtacgttccgaacttccgtaccgtaccgtacagtccgaacggttcccgtaaggacgtacccgttaaggtaaaccggtttacgtttttttacgggtaccggttttttaaacgttaaccgttgggttacccgtaacggtacccgtaaccggtttccccggtttccccggtacccgggttacccggggttaacccccggttttaaacccgggttttaaaccccgggggttttacccgggggggacccgggggggggttaaacccggttaccgggggggtacggggtaaacggggtaccgggggtaaacggtaaacccgggggttaacgttaggggtacccgggttccgttaccgggaaccctaaccgtaccggttaccgtttaccggtttccttaccgtacccgtttacccgttccccgtaccgttaccgttacctaaccgggtaccttaaggtttaccgg

SEQ ID NO: 23827 - DNA, 777 bp, Homo sapiens
  misc_feature: GYAE6OF02FNG4X.24.35.D02.1.454.CMB.1.raw
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagacccaccggagaaattgtgttgacacagtctccaggccaccctgtctttgtctcgaggggagagacgccaccctctcctgcgacgggccaggccggagttgttacgtaaggtacttacggtacgtcggtaccgaacaacgaacgtaacggtcgaccggcgtacccgcgacgtccgtcctactcttatgtagtagtccgtaccaacgtacggtacgccgtacggtccggtcccccggacccgtacggttacgtacgtacggtcggcggtacggggttcgtacggacggacgtacttccgtactcctaccgtaccgtaccgtacgacgtaccgcgaacgtacgacgtacccttagggaagttaaggtttttccgtacgggtttaccttacgttcgtanaccggngtaccggttcttacccggtccgttacgtccggacccgttttaaccggttccgggggtaccggggaccgggtagggtcggggtaaggtaaccggggacgtaaccgggtttacgaccgggtttgggcccttacgggacctaacccgtttccgttagttcccgttttacccttcgttacccgttttacccgttccccccggtaccttaaggttaccccttaacggtaccggtttaaa

SEQ ID NO: 23828 - DNA, 762 bp, Homo sapiens
  misc_feature: GYAE6OF02GCRYO.24.35.D02.1.454.CMB.1.raw
  modified_base (202)..(202): a, c, t, g, unknown or other
  misc_feature (202)..(202): n is a, c, g, or t
  modified_base (278)..(278): a, c, t, g, unknown or other
  misc_feature (278)..(278): n is a, c, g, or t
tcagactactatgtcacgaccggtgctcgatttagcacacgatagttgggtttgggggaggaactgctcagttaggacccagagggaaccatggaagccccagctcagcttctcttcctcctgactactctggctcccagacgaccaccggagaaattgtgttgacacagtctccaggcacctgtctttgctccgagggganaggacgccaccctctccgtgcgagggccaggtccggagttcgttaagtaaggttacttaggcttacggtaaccaanagaaacctggaccaggccttacccgaggccttcctacattcctagtacgattcgtacttacccgaaacggtcgggttacctacggtcgggtacccccgtacccggaccgtacgggtttaccaagggtccggtacggtagggtttcgggaccggtagggtaacacggttaccttaccgtaccgttaccgtaccgtaccgtaacgacgtacccgaacgtaccggtagtaccggtacctagtaaacggtttacctttttacgggtccgttttaactacggcgtttacacggtccgacgtccggtttcccgacgtggtcccctaagtttacccgggttgggggaccgggtacgtgggggtagaccgggtaggtaataccggggtaattcgggcgtaccgttagaccctttacggacgtttcggtccggttttaccagtaacccgtttccctaccggtccttataccccgtagtaaacccgtgtttacg

SEQ ID NO: 23829 - DNA, 666 bp, Homo sapiens
  misc_feature: GYAE6OF02HIVPO.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagacgaccaccggagaaattgtgttgacacagtctccaggcaccctgtctttgtctcgaggggagagagccaccctctcctgccgagggccaggccggagtgttagtaacgtacttaggctacggtaaccaagacgaaaccgtggaccaggtcctcccgaggtcctcctacatctatgatgtactaccaacgacgggtcacgtcggcccgtccccgacgtacggtttcaaggtcggactagggtcgggtactgggactagtacttcacttcctacaccgtacgacgcacgccgtagctccgtagtatacgttttacgacgtttactacgtgtacgacgtcgtacgtccgttaccgccgttcggccgttacgttaacggtttccggggaccgggggtacgtagggggtacggaaggtacgggaacggacgtaacggtcggtacgggcttacggaccaccgtcgttcgttcggttaccttacgtccgtttcccgtcccgtactacgttaccgtacgtaacctagttaacgg

SEQ ID NO: 23830 - DNA, 833 bp, Homo sapiens
  misc_feature: GYAE6OF02GWAMR.24.35.D02.1.454.CMB.1.raw
  modified_base (210)..(210): a, c, t, g, unknown or other
  misc_feature (210)..(210): n is a, c, g, or t
tcagactactatgtcacgaccggtgctcgatttagcacacgatagttgggtttggggggaactgctcagttaggacccagacggaaccatggaagccccagcgcagcttctcttcctcctgctactctggctcccagactaccacgtggagaaatagtgatgacgctagtcctcagccctaccctgtctgtcgtccgtccgaaggggaanacgccaccctcgtccgtgccgacggcctagtacctagagttaagtaaacggaacgtacctaaacgttacgttaacgccgtaggttaacctaaccaaacggtaaccgtaaaaccggtacggtacccgaccggtacccgtaccccggtaacggtccccgttccttacctacgttaacgtttacggttaacgttactttaaccgttaccggaacggaaccggtaccggtcccgttaacggttccggttaccgtaccccggtacggtaacccgttacggttaaccgacggtaggtaccggtagggttcggggtacgtacggggaactacggtacgttactacccgttcacccggtaactcgacgacgtcgtacgttcgacgtactacgtcgtaagttaacttacggtttcgtacttacgttttaccgttagtaccgtacgtagtacgtaccgtacgaaacggttaggtaccgccgggttaccgtcccgagtttacccggttaccggttcggggaaccggttaacgggtacggtaacgggcggttaaacgtaccggttaaacccggaaacggttacggttacggtaccgggttaaccgtccgggtaacctaaccgttccgtttaccgg

SEQ ID NO: 23831 - DNA, 639 bp, Homo sapiens
  misc_feature: GYAE6OF02F0H0X.24.35.D02.1.454.CMB.1.raw
  modified_base (262)..(262): a, c, t, g, unknown or other
  misc_feature (262)..(262): n is a, c, g, or t
  modified_base (413)..(413): a, c, t, g, unknown or other
  misc_feature (413)..(413): n is a, c, g, or t
  modified_base (517)..(517): a, c, t, g, unknown or other
  misc_feature (517)..(517): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagaaattgtgttgacacagtctccaggcacctgtctttgtctccaggggagagagccaccctctcctgcagggccagccgggagtcgttagtaagtacttaggctggtaccaanagaaacctggccaggctcccaggctcctcatctagtcgatcgtcctacccaacgacgggttccacgtcgggcctccccggctacgggttcaggtcggctaggtcgggtcgtgggacagtacttcgactgtccacgtcaagcagcctaggcnccgtagtaagtattttgcggtttactactgtctagcgtacgtccggttccgccgtcggtcccgtcgttaaccggtttccggggacggggggtacccgtaggggnggacggtagggaacggtacggtaacgtcgggtcggtcgtccgacgtaccgagttccgttacgtttcttcccgtaacttcccgttaccccgcttaaccgtaccgtaccgtaacctattaacgg

SEQ ID NO: 23832 - DNA, 680 bp, Homo sapiens
  misc_feature: GYAE6OF02FFZ07.24.35.D02.1.454.CMB.1.raw
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
  modified_base (317)..(317): a, c, t, g, unknown or other
  misc_feature (317)..(317): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccacggagaaattgtgttgacacagtctccaggcaccctgtctttgctccgagggganagagccaccctctcctgcacgggccaggccggagttgttagaagtacttaggcttggacccaanagaaacctggaccaggcctcccgaggcctcctcatctatgatcgtctaccaangggttcacgtggccgtccccgactaggttcaggtgccaggtcggtctcgggacacgtaccttcacctcgtccaccggtcacgtcacggtccctaggacgccgtagtaagtagttttcgtaccggttttacgtacttcggtacacggtcgtacgtccgttaccgtcccgttcggcccgtaccgtttaaccggttttccggggacccggggggtaccgtagggggtacggaacgggtacgggacgtaaccggaacgttgggtacggtccgtacggaccaaccgtacggttccttcgttacccgtttaccgtaccgtttaccccgttacccgccttacgttaccgtacgtaaccgtagttaaccgg

SEQ ID NO: 23833 - DNA, 859 bp, Homo sapiens
  misc_feature: GYAE6OF02FYMFX.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgtgacacagtctccaggccacccgtgttctttgtcctacgaggggagagacgccctaccctctccgtcgaccgagggcccacggccgggtagttaggttaacggttaacgtacgttaggtccgtacgggtaacccaacgaacgtaaacccgtggaccgacggcctacccgaggccttcctacactctactagtactcgtcctaccgaacgtacgggttaccacggtccggcccggtcccccgacgtacggttaccgtaggtcggtacgtacgggtcgggtacggacgggactaacggtaccttacgaaccttccgtaccgtaaccggtacgacgtccgaacgtacctaacggccgtacgtaagaacgtttaggtttcggtacggttttaactgtacggtacctacggtctaacgttccggtttcccggacttaccgggaccttaaaccggttaaccgggtttaccggggggaccgggggttaacggtacggggttacgggaacgggtaaggggtaaccggtaaaccggtaaaggggttccgggttaacgggccccggggttacgtaccccgttaaaaccggtcggttttaacccggttacgttttaccccgttaccgttacccgttttaccccgttaccccccggttaacggttaacccgtttaccgttaaacccggtaatttaacccggtttaaccgggg

SEQ ID NO: 23834 - DNA, 743 bp, Homo sapiens
  misc_feature: GYAE6OF02GXTVZ.24.35.D02.1.454.CMB.1.raw
  modified_base (202)..(202): a, c, t, g, unknown or other
  misc_feature (202)..(202): n is a, c, g, or t
  modified_base (374)..(374): a, c, t, g, unknown or other
  misc_feature (374)..(374): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtcttgtctaccgagggganagagccaccctctcctgccgagggccaggccggagtgttaagaagtacttaggctacggtaaccaacagaaacctggccgaggcctccgaggcctaccccatactatgtactgttccctaccaacgtacgggtcgacgtcgggtcccggtcccccgccgtacgggtttccgnggttacgggaccgtaggttcgggttcgtcggggaactaggtaccttccgtacttctaccgacccgtcagaccgacgtaccgaggtacgaccgttacggtaagttacgttttacggtaccggttttaacgtacgttcgtaccgaacggtccgtacggtcccgttcccggtaccgtccgggtacccgttacggtttaacccgggttccgggggtaccggggggtaaccgtgggggtacggagggtaacgggtaacggaaaccggtcgttggtcggtccgtaggtccctaccgtacttccgtaaccggtttcttccgtaaccttcccgttacccgtacccgtagttcccgtaagaacttacgtaggttacgg

SEQ ID NO: 23835 - DNA, 914 bp, Homo sapiens
  misc_feature: GYAE6OF02FYULY.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacgagtctccaggcaccctgtctttagtcctccgaggggacaggacgcccacccttctccgtgaccgagggcccaggccggtagtgttaacgtaagtacgttaaggcgtacggtaacccaaacgacggtaaaacccgtggaccgaacggacctacccgagggacccttaccgcctattccgtaatcggtattcgttcctaccgaaacgtacgggtccaacgtcgggccgttacccccgactaacggtttacaacggtggacgtaggtcgggtccgtagggacctacggtaaccttccacgttcgtaccgtaccgtcgaacgcctaacggtacccgtaaggtacgacccgttaacggtaaacgttacgtttttaccggtaaccgggtttttaaacctttaaccggtttcggttaaccgacgggttaaacgtaccgggttacccggtttccccggggtacccgttccggggaacccccgttacccgggttttaaacccgggttttcccggggggaacccggggggggttaacccggtaacggggggttaccggggaaacggggtaaccgggggtaaacgggtaaaccgggtaaaccggttacgggttaaccggggtacgttccgaccgttaacccgtaccggtttacggttaccggtttacccgtttaaccgttaccgtttaccccggttttacccccggtacccgttaaccgtttacccggtaacggttaaacgtaaccggtttaaccggg

SEQ ID NO: 23836 - DNA, 768 bp, Homo sapiens
  misc_feature: GYAE6OF02HG7Z2.24.35.D02.1.454.CMB.1.raw
  modified_base (205)..(205): a, c, t, g, unknown or other
  misc_feature (205)..(205): n is a, c, g, or t
  modified_base (692)..(692): a, c, t, g, unknown or other
  misc_feature (692)..(692): n is a, c, g, or t
tcagactactatgtcacgaccggtgctcgatttagcacacgatagttgggtttggggaggaactgctcagttaggacccagagggaaccatggaacgccccagctcagcttctcttcctcctgctactctggctccagacgaccaccggagaaattggtgttgacacagtcctaccaggccacctgtctttgtcctcgagggganacgacgaccgacccttctccgtcgccgagggaccaggtcccggtagttacgttaacggtaaacgttaccgttagggtcctacggtaacccaactaaggaaaccctggaccctaggtccctaccgaggtcctccgtacattctagtgtactacgtcctccgaaacgtcgggtcaccgtggaccccgtccccgagtaggttcaggttcggccgtaggttcggtcgacggtactacgtactttaccacgttctaccgtaacgtcgacgactacgtacctaggaccgtacgtaggaacgtttacgtttacggttacgtttaacgttacgttacgtacgtacgtacgtacgttccgttaccgtccgtcggtaccgtacgttaaccgggtttccggggacgggggtacccggtaggggtacgggaacgggtacgggaacggtaaccggtaacggttacggacggtacgtccggacctaaccgtccggtttacnccggtttacttaccgtaccgttaccccggttacccgtccgtaaccgttaccgtaacgttaccttaacggttaaccg

SEQ ID NO: 23837 - DNA, 1077 bp, Homo sapiens
  misc_feature: GYAE6OF02G3HCR.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtcttgtctccgagggagagacgccaccctctcctgccacgggccaggcccggtagtcggttttaagtaaacgttacgttttaacgggcgttacgggtaaacccctaaaaccgtaaacggtaaaaaccccgttcggggaaccccgaaacggggtcccctttaccccccggaacgggggtacccctttacccccgttaccgtaaaccgttcctttaaagttcgggtaacgtttcggtttaccccgttaaacccccggaaaaccgggtaaccgggggttaaccctaacccgggttaccggggttccccccggtttaccccccccgggacccggttaaccggggttttcccgaagggtttcccgggggttgtaaaccggggttcggggggttacccgggttacggggaaaccgtaaccgggtaaccccgttttaccgtaacccccgtttcccgttaccccgtaaccgggttacccgacccggttacccgtaaccgtaccccggttaacggggtaaccgtaacccgtttaggggtaaacgttttacggttttttaccggacggggttttttaaccccttacgttacgttacccgaaggtccccgtaaccggggttccccgtttaccccggggtacccgttcccggggtttaacccgtaacccgggtttttaaaccgggttttaccggggggggaccccgggggggtacccggttaggggggggtacccggggtaaagggtaaaccgggggtaaccggtaaccggggttaaacggttcgggttaacggggcccttaacgggtcccctaaccgtacggttcccggtttcggttacccttacccgtttcgttccccgtacccctcggttaacctcggttaacgtaccggttagttaacggg

SEQ ID NO: 23838 - DNA, 789 bp, Homo sapiens
  misc_feature: GYAE6OF02HYLU2.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctccagagaccaccggagtaattgtgttgacacagtctccaggcacctgtctttgtctccgaggggagagacgcccaccctctccgtgcgacgggccagtagaactaagttaggttaagggtaagtttacggttacgtccgttagggttactaccaaaacgaactaaaacgagtacggaccgacgggtacccctcccccgggtcttacccctaccgacttaccgttacgttagacgttcgacctacgttacccgaaacgggtaccgggaccctaagtccggacctaaccgtaccccgaaggtaaaccggtcggttaccgtaggggtacggtaccgttaggggtacggggttaccgtagggggtaaaccctagggtaccctttacgtaccgttaccctaccggacctacgtacgtacggtacgtaggtacggtaacggaccggtaccgttagggttaaacttacggttttacgtaacgtttaacggttttaacttacgttacgtactacggtaccgtacgtaacgtaacgtacgtaccggtacctacggttccgacccggtacgtaccgacgtaaccgtgacctagtaccgaacggtacggttcggtacggccgtagcccttaacgtacgttaccgtacgtactttacgaccttcccg

SEQ ID NO: 23839 - DNA, 720 bp, Homo sapiens
  misc_feature: GYAE6OF02HE5RE.24.35.D02.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagagccaccctctcctgcaggccaacggngtgtagtaagtacttaggctggtaccaacagaacctggccaggcctcccgaggctcctctatctagtgatcgtcctaccgaaacgaggggtaccaccgtcgggcccgtcccccgcgtacggtttccaggtcggcgtaggtgggtactggggacaggtacctttcgacctctccgaccgtcagcgacgccgtagcgcgttaggaagttacgtttttcggtaccgttttaactcgttacgtacacgtcgtaacgtcccggttccgaccggttcggacccgttacgtttaaccgggtttccggggggaccgggggttacgtaggggggttacggaacggtaacggggtacggtaaacggtacgttagggttccgggccttaccgggacctacccgtagttccggttcgttcccgtttaactaccggtttccccgttaccccggtacttaaccgttaccgtaaccggtaaaacctacggtttagttaaccggg

SEQ ID NO: 23840 - DNA, 791 bp, Homo sapiens
  misc_feature: GYAE6OF02F02I6.24.35.D02.1.454.CMB.1.raw
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
tcagactactatgtcacgaccggtgctcgatttagcacacgataggttgggtttgggggaggaactgctcagttaggacccagagggaaccatggaagccccagctcagcttctcttcctcctgctactctggctccagagaccaccggagaattgtgttgacacagtctccaggcacctgtctttgctcgagggganagcgccacctctccngcacggggccaggccggtagtcgttagtaaacgtcttaggcttaggaacccaagaacgaaaccgtcgggacctacgggacctacccgtacggcctacctacacgttacttaactcggtacgttcgttccgtaaccaacggtacggggttaccaccgttccgggaccggttcccccggacgtacgggttccgaacgggttcgggacgtacggttcggggtaccgtagggggaactacgtaccgtctaacgttcgtaccgacgtacgtacgtacgacgtaccgacgtacgtacctagtaagttacgttttcggacggttttaacctagttcgtacgactccgtacggtaccgtcccggtccgtcggggtacctaccggtttaacggttccgggggaaccgggggtaccggtagggggtacgggaacggtaccggggtaacggtaacggttaccggtacgggtcgggtaccgtacggccgtaaaccgcgggtttcccttacggtttccgttaaccgttaccgtttacccggttacccgtacccttacggttacttaaccgggtaacttaaccggttacggg

SEQ ID NO: 23841 - DNA, 772 bp, Homo sapiens
  misc_feature: GYAE6OF02HKASW.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggagagcgcccaccctctcctgcagggcctaggccggtagttagttaaggtaaacgtacgttaacgggcctaagggtacccaaacgtaacgaaaaccgttgggacccaggccctaccccgaaggtcctaccttacaacttcctaagtggaacttcggttaccctaccgaaacggtacggggttaccaccgttaccggggaccccgtcccccggtacgtacgggttccgaggttcgggacgttacgggtcgggtcgtacggactacgtacttcgacttcgaccgacgtacgtcgacgtacgcctaggacctcgtagtaagttacgtttacgtacgtttaactacgttagtacgtacgacgtacggtaccgttccggtccgttcgtaccgttccgttaaccggtttccggggtaccgggggtacggtaacggggtacgggaacggtacgggtaacgtaccgggtaaacggtcgggtaacggtcgtacggtccgtaaccgtacgttcgttcgttaccgttacttaccgtttcccgttaccgtaccgtaccttaccgttacgtaacgttagttaacggg

SEQ ID NO: 23842 - DNA, 843 bp, Homo sapiens
  misc_feature: GYAE6OF02H3LS6.24.35.D02.1.454.CMB.1.raw
  modified_base (185)..(185): a, c, t, g, unknown or other
  misc_feature (185)..(185): n is a, c, g, or t
tcagactactatgtcacgaccggtgctcgatttagcacacgatagttgggtttgggggaggaactgctcagttaggacccagagggaaccatggaagccccagctcgagctttctcttcctccgtgctactctggcctcccagcctagtccgaaccgggtagtaattgtggttgacgcagttccnccgaggcctacctgttccttttagtcctaccggaggggactacggacgtcccctaacccttctcccgtggacccgaggggtaccctggttaccgagtagttcggtagaccgagcgagtccttaagttcgcgttacgtacagacacgtaactcggtacgtcggcctacccgcggtaccttccgtactacgttcgttacggttcgggtcgtcccgtttacccgaccggtacccgggtcccttacgggtacggtaccgggtcggtacccgggtacgtaacggtttcgtacgggtacgggtaccgtaggttcgggttcggttaacggacgtacggttacctcgtacgttaccctaggtactcggtaagtacccgacgtaaccgtaggacgggtaccgtaaccgtagttcgttaccggtaacgttaacggttattttaaccgttcggttacgtacgttacggtttcgttacccggttttccggttaccctaacccgttttccttacggtaaccgtttccgtttaccgttcggtttaaccgtacggttacccgggttacgttaccgggtccggtaataccggtacggtttaaccggtaacgggttaccgttacggggttaccgggtaaccgttaccggtacccgttaccgtaacctttacccgg

SEQ ID NO: 23843 - DNA, 811 bp, Homo sapiens
  misc_feature: GYAE6OF02IERKF.24.35.D02.1.454.CMB.1.raw
  modified_base (123)..(123): a, c, t, g, unknown or other
  misc_feature (123)..(123): n is a, c, g, or t
  modified_base (357)..(357): a, c, t, g, unknown or other
  misc_feature (357)..(357): n is a, c, g, or t
tcagactactatgtcacgaccggtgctcgatttagcacacgatagttgggtttgggggaggaactgctcagttaggacccagagggaaccatggaagcccccagctcagcttctcttctcctnctactctggctccagagaccaccggataaattgtgttgacacagtctccagcccaccctgtctttagtcctaccgaagggaaacgagccctaccctctcctcgcgacgggtccaagtgaactaattcggttaaaggagttagttacggccttacggtataccaaactaaacgtaaactacgtcggaccgtaacggaccccgtccccggccttccctacctattacctcgtagtntactctacgtaccaagtacgggcctaggtcgcactaccgacgtacgtacgttacgtacgtcggacgtacgggtgttacggtacgggtacagttacgttacgtacctactacctaaccgagttaaccgaggttaccgtaggtacggtaacggtacggaccgtttaacgggtaaagttttacgttacgtacgtttaacgtttttaacgttaccgtttaacggtacttaaccgtaccggtttaacccggtaaggtaaaccgtaacccggtttcccggttaaacccgtttacccgggttaccccggttaccccggggttacggggaaacccttaaccgggaccggttaaccgggtaactaaaccgtaaccgttaaacggtaactacgggtgtaccgtactaccggtaccctactttaccgtaccggtttacctacgttacccgtccctttaaccccgg

SEQ ID NO: 23844 - DNA, 916 bp, Homo sapiens
  misc_feature: GYAE6OF02JGVQY.24.35.D02.1.454.CMB.1.raw
  modified_base (210)..(210): a, c, t, g, unknown or other
  misc_feature (210)..(210): n is a, c, g, or t
tcagactactatgtcacgaccggtgctcgatttagcacacgatagtttgggtttgggggaggaactgctcagttaggacccagagggaaccatggaagccccagctcgagcttctcttcctcctgctactctggcctcccagacgacccaccggagaaattgtgttcgacacagtcctcaggccaccttgttcttgtctaccgagggtanaggacgtccacccttctcccgtagcgacgggccacggccggagttgttaacgtaacgtacgtaggtcgtaggtaaccaacgaacgaaacccgtcggaccgaccggtacctacccgtacggtccttccgtactacttaccgttagtacggttaattccgttacctaacccgtaaacggtacgggtttaccacggttcccggtccccggtacccccggtaccggaccgggttttacacgggtttcggagttacggggttacggttcgggttaccggaccgttaccggtacctttaccggacctttacccggacccgttaacggtttccgaaccgaccgttaacgggtcccgtaacgaaccggttacccgtaaggttaaacggtttaaccggttttcgtttaacccgggtttaaaccttccgtaggttcccgtaaacgtccggttacgggttacccgttacccggtccccggttaaccggttccccgtttaaccgggttaacccgggtttccgggggggaaacggggtacccgtagggggtaacgtaacgggtagggaaccggtacgggttaaaggttccggtacgtacggtacccgtaccgtaccgttacgttttcccggtcggttttaaacgtccccgttacgtttaccccggttacccgtaccttaagttaccccggtttaacgtaacctttcccggggttaaacg

SEQ ID NO: 23845 - DNA, 697 bp, Homo sapiens
  misc_feature: GYAE6OF02G95IR.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccggagaaattggtgttgacacagtctccaggcaccctgtctttgtctccgaggggagagacgcccaccctctcctgcgacgggccaggccggagttggttaagtaacgttacgttaggacctaggtaaccaacgaacgaaaccgtcggaccgaacggcctaccccgaggtcccttcccgtcacttactattgtacttcgtacctaccgaacggtacggttccgtaccggtccggccccgtcccggtcgtacggttcgaggtcggcgtacgggtcggtcggtacggacgtacgttacgtccgtaccttacgtaccgaccgtcgacgcacggtacacgtcgtacgtagtaacgtttgtttaccggtaccgtttcgtactcgtacgtcgacgtcgtcccgttccgcgtcgaccgttcgttacggtccggggacgggtacggtaggggtacgaggaggtacgaacgtcggtggtcgtacgtccgactaccgatttcgtacgtttcctaccgtccgttcccttaccgaccttcgacgtactacgttagttaccgg

SEQ ID NO: 23846 - DNA, 273 bp, Homo sapiens
  misc_feature: GYAE6OF02G184V.24.35.D02.1.454.CMB.1.raw
  modified_base (250)..(273): a, c, t, g, unknown or other
  misc_feature (250)..(273): n is a, c, g, or t
tcagactactatgtcacgaccggtgctcgatttagcacacgatagttgggtttggggggaagaggaagactgacggtcctcccaggagttcaggtgctgggcaccttgggcacgggggaggtgtgtcacaagatttgggctcgtgggcaccgtgggcatgggggagtgtgtcacaagatttgggctgccgtggtccaaggactacttccacatagtagtctgagccggggctgggccaaggcgacatagnnnnnnnnnnnnnnnnnnnnnnnn

SEQ ID NO: 23847 - DNA, 728 bp, Homo sapiens
  misc_feature: GYAE6OF02JATSE.24.35.D02.1.454.CMB.1.raw
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
tcagactactatgtcacgaccggtgctcgatttagcacacgatagttgggtttgggggaggaactgctcagttaggacccagacggaaccatggaagccccagcgcagcttctcttcctcctgctactctggctcccagatacccactggagaagtagtcatgacgtcagtctccagccaccctgtctgtgtctccgaaggggaanacgcccaccctctcccngcgacgggccagtgaagtaattggtgcagctaagttcgcctcggaccagtcaacgaaccgtcgccaaggccctccgaggtcctacctcagttctatcgggtatacgtccagcgacgggccaccgtgtcgtacccaggtccgtaggttacgagttggacgtaggttcgggtcgtagggactaaggtacgtttccgaacttccgtacctaaccgtcttaccagtacctaggttacccggtcggtacgaccggttacgttacgggaaagttttacggtttttccgtagttttaacggtttttaaagtaccgtttaccgtaaccgggtacttacgaccggtaaccttaaacggtaggtaccgtaaccgggtcggtacccggtaccttccggttaacgggttaccggggacgggtaaccggggtaaacccgtagggggtaccggtaagtaacccgttaacggaaacggtaaccgtcgggttaccggtcgtacgaccggttacccgtaagg

SEQ ID NO: 23848 - DNA, 750 bp, Homo sapiens
  misc_feature: GYAE6OF02H9D0E.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctcccagacgacccaccggagaaattgtgttgacacagtcctccgaggcctacccttgttcttttcggtcctccggaggggagagacgccctaccctctcccgtgcgacgggccaggccggtagtagttagtaagtacgttaggctacggtaaccaacaacgaaacccgtggacccgaggtccctcccgacggtcctcctctatacctatggtaacttcgtacctaccgaacgtcgggtacacgtcggtcccgtccccgacgtacggttcgaggtcggcgtagggtcgggtcgtaggactagtacttcgactcctacgaccgtcacgtccgacgtccgtagacgtcgtaagtaacgtttacgttttcggtacgtttactacgttgacgtacgtacgtacggtcccggtttcccgaccggtacggtacccgttaccgggtttaccggggtcccgggggaacggggttacccggtaagggggtcgaacggggtacggaacggttaacgttacggtgggtaccggtacgtacgaccgttacgtcgttccggtttcttaaccggtccttacccgtttcccgtacccttacgtacgtttaccgaagttacctaggttaacgg

SEQ ID NO: 23849 - DNA, 1016 bp, Homo sapiens
  misc_feature: GYAE6OF02IUTFS.24.35.D02.1.454.CMB.1.raw
tcagactactatgtcacgaccggtgctcgatttagcacacgatagttgggtttgggggaggaactgctcagttaggacccagagggaccatggaagccccagctcagcttctcttcctcctgctactctggctcccagagaccaccggagaaacttgtagttgacacagtctccaggcaccctgtctttgtctccgagggagagacgcccacccgtctccgtgaccagggccagccggagttagttaagtaagtacgttacggcttcggtaaccaacacggtaaaccgtggccgaaggtcctacccgaggtaccttccgtactactaccgtagtcggacttcgttacccgtaacccgtaaccggtacgggtttaccaaccggtttccggaccccggttcccccgtacccggttaacggtttcgaacggttacggtaccgtaggggtttaccgggtcggtaaccgggtaaccgaacggttacccgttacgtaacccgtttccgtaaccggtacccgttaccgaacggtaccgtaaccgggtacccgttaacgggtaaccgttacccgttaagggttaaacggttttaaccgttttttgggttaaacccgggtttttaccctaaccggttttgaaacccggtccgttaaaccggggtaccggtttcccggggtttaaacccccgtccccgggttttacggggttaacccccgtaacccggggttttttaaacgggtaccccccggggggggtacgggggggtttaaacccggtaacccgggggttaaagggggttaaaacccgtaacgggggttaaccggtaaaaccccggggtttaacggtttacccgggggtacttaaacccggggtccggtaaaccccgttaacgtaccgggttttacccggtttcggtttaacccccgggtttactaacccccgggtttttcccgttaacccccgggtaacttttacccggtaacccggtttaacggtttaaaccccggtagtttaacccgggg

SEQ ID NO: 23850 - DNA, 706 bp, Homo sapiens
  misc_feature: GYAE6OF02IARDJ.24.35.D02.1.454.CMB.1.raw
  modified_base (173)..(173): a, c, t, g, unknown or other
  misc_feature (173)..(173): n is a, c, g, or t
  modified_base (204)..(204): a, c, t, g, unknown or other
  misc_feature (204)..(204): n is a, c, g, or t
  modified_base (330)..(330): a, c, t, g, unknown or other
  misc_feature (330)..(330): n is a, c, g, or t
  modified_base (573)..(573): a, c, t, g, unknown or other
  misc_feature (573)..(573): n is a, c, g, or t
  modified_base (616)..(616): a, c, t, g, unknown or other
  misc_feature (616)..(616): n is a, c, g, or t
  modified_base (636)..(636): a, c, t, g, unknown or other
  misc_feature (636)..(636): n is a, c, g, or t
tcagactactatgtcacgaccggtgctcgatttagcacacgataggttggggtttgggggaggaactgctcagttaggacccagagggaaccatggaagccccgagctcagcttctctttcctcctcgctactcttggctccgagacgaccacggagaaattggtgttgacanagtctcaggcacctgtctttgctcgaggggngagacgccacctctcctcgcgaggccaggccggtagtgtttagtaagtacgttggtcgtaggtaaccaacgtaacgaaaccgtcggaccgtaacggcgtacccgtacggaccttaccgacaccttntacgtcggaattcgtaccgtaaccgaacggtaagggtccctaacggtaccggtccgtaccccggtacgtaagggttaccgcgggtacggcggtaggttacgggcggtaggtaacgacggttacttccgacttaccgtcgtaaccgtcgaacggacctggaccgtagaccgtacgttagtaaacggtttaggtttaccgtacgtttacgtattcggtacctagcgtacgtccgcgtcggttacnccgtacgttaccggtacgggtacgggacgacgggtaggacggngtacgaagtcgtcgacgggngtacgcgttaccaggttcgtaccgtcttaaccgtcgttaccctcggtactacgtactgtacttaggtacg

SEQ ID NO: 23851 - DNA, 708 bp, Homo sapiens
  misc_feature: GYAE6OF02G0Q4E.24.35.D02.1.454.CMB.1.raw
  modified_base (203)..(203): a, c, t, g, unknown or other
  misc_feature (203)..(203): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagataccactggagaagtagtcaatgacgcagtctccagcccacctgtctgtgtctccgagggganagacgcccacccttctcctggcacgggccagtcaggagtgttagcgagcagtctacttacgccgtggtaccagcaggaacctggcctggcctcccgaggtcctcctctactctagtcggtcgtccgtaccgaccgacgggcctacgtcggaccgtcggaccggtacgtacggtacgacggtggtacgcggttcggtacgtttggggaactacggtacttcgacttcgtactagtaccgacgttaccggaacgtacggtaccgttagggaaccggacccggtaaagttcgtttacggacgtaacgttacggttagttccgtaggtaccgtacgttcgtttaccggtttccggttacccttccgttacccttacgtttaccttacggtttaaccgtttaccggttttaccgaccgggtttaaccgggttaccgtcgggtaccggtttacggaacgttaccgtaacggtacggtaccgtacgttcgggttacgtaccggtagtacccg

SEQ ID NO: 23852 - DNA, 581 bp, Homo sapiens
  misc_feature: GYAE6OF02GAEHW.24.35.D02.1.454.CMB.1.raw
  modified_base (276)..(276): a, c, t, g, unknown or other
  misc_feature (276)..(276): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (410)..(410): a, c, t, g, unknown or other
  misc_feature (410)..(410): n is a, c, g, or t
  modified_base (440)..(440): a, c, t, g, unknown or other
  misc_feature (440)..(440): n is a, c, g, or t
  modified_base (489)..(489): a, c, t, g, unknown or other
  misc_feature (489)..(489): n is a, c, g, or t
  modified_base (517)..(517): a, c, t, g, unknown or other
  misc_feature (517)..(517): n is a, c, g, or t
tcagactactatgtcacgaccggtgctcgatttagcacacgatagttgggtttgggggagggaactgctcagttaggacccaggagggaaccataggaagccccagctcagccttctcttcctccttgctactctggctcccagagaccaccgggagaaattggtgttgacacagtctcccaggccaccctgtctttgtctccaggggagagagccaccctctccgtgcgagggccagccggagttgttagtaagtacgttaggctggtaaccaanagaaacctggccaggcctcccaggcctcctcatctatgatgtccnccaangggtcactggcctccccggcaggttcaggtggcaggtgggtctgggacagacgtttcacgtctcaccgtcaagcacgcctagcncctgagtatttgtcgtttatacgtgtacgngcacgccgttccgccgtggcccgtactacggttcgggccgggggtacgngggtggacgagggacgacgtaacgtggnggcgtcgcactgtccgtgttctcgtccttccgtccccgtcttacgtccgtacgtactagttacg

SEQ ID NO: 23853 - DNA, 758 bp, Homo sapiens
  misc_feature: GYAE6OF02JDDOV.24.35.D02.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (279)..(279): a, c, t, g, unknown or other
  misc_feature (279)..(279): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
tcagactactatgtcacgaccggtgctcgatttagcacacgatagttgggtttgggggaggaactgctcagttaggacccagagggaaccatggaagccccagctcagcttctccttcctcctgctactctggctcccagagaccaccggagaacttgtgttgacacagtctccaggctaccctgtctgtgtctcgaggggaancgtccacctctcctgaccgacgggcctaggtnagtaatggtggacacggactaacgttacggtcctacggtaccngtaccaacgtaacccgtcggtaccggacgccgttaccccgaggtcccttaccctcctacttacgttcgactccgtctacccgaccggacgggtccccgtaggtccgtcccgacgtaccggttcggtcggggttcggtacgggtgggtttccggagggaccgtaggttacctttcaccgttcctacgaccngttaccnccggttacccggcctaccgtacgttacgtacggttaagttaccgttttagtacctttacttttagtttccgttaacgtacctaacttacgttacggttacggttacggtaccgttcggtaccccgtttaccttaccgttaaccggttttcggacccggtacggtaaccgacgttaacgagttaaccgtaacgaacgttacgtacgggttacgtaacgtccgtacgtacctacgttcctttaccgtaccgttcttaccgtccctttaccgtcccttacttacg

SEQ ID NO: 23854 - DNA, 876 bp, Homo sapiens
  misc_feature: GYAE6OF02GF5S7.24.35.D02.1.454.CMB.1.raw
tcagactactatgtcacgaccggtgctcgatttagcacacgatagttgggtttgggggaggaactgctcagttaggacccagagggaaccagtggaagccccagctcagcttctcttcctcctgctactctggctccagagaccaccggagtaaattgagttgacacagtcctccgaggccaccctgttcctttcgtcctaccgaggggagacgacgcccctacccgtcctcccgtcggcgacgggccgaacggtccgggtaaggttaggtttaacggtaaacgttaccgtttacgggtccgttacgggtaaccccaaaacgtaacggaaaccccgttagggaccccgtaacggtcctaccccgaacggtacccttccctactacttcttagtacgtacgttccgttacctacccgtaacggtacggtccgtaccggtaccggggtcccccgttacccccggtacggtacggtttaccgacgggttaccggtcggtacggggttcgggtaccgggttacgggaacctacggttaaccttaccgtacccgttaccgtacccgaccgtacgaaccgtccgaaccgttaccgtacggtaacgtacgtagttaaacgtttcggtttacgttaccgttttaacgtcgttaccgtcgtaaccgccggttaccgttcccggttcccgtacggttaccgtacccggttaccggttaccggggtttccgggggaccggggtacgggtacgggtacgggagggtaaccggaacggtaccgggtacgtacggtcgactacggtaccctaacggtcttccggttcgttaacccttccgtacgttccccgttaccgccgttacgtaccgtacgttaacgtaccgttacg

SEQ ID NO: 23855 - DNA, 851 bp, Homo sapiens
  misc_feature: GYAE6OF02HX73J.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctcccagacgaccaccggagaaattgtgttagacacagtctccaggccaccctgttctttcgtctccgaggggagagacgcctaccctctccgtagcgacgggccaggtccggagttagttaacgtaagtacgttaggcttacggtaccaaacgaacgaaccgtggacctaggacccttccgaaggtcctacctcacttaccgtagtacgtaacttcggtaccctaacctaaccggtacggtcctaccggtaccggtccccggtaccccgtcgtacgggtttacgacggttcggtactacggggttcggtaccggtacgggtaacctacggtttaaccttaccgtacgtttccccgtaaccgtacccgttccgaacgtccgtaacggtcccgtaaagggtcccgtaccggtttaggttaaacgtttccggtttttaccgggtaaccgttttaacgtaccgttacggttcgaacggttcggtaaccgttcccggttcccgtacgtacccgggttcccggttaaacgtttacccgggggttcccggggggtaccggggtacccggtaggggtaccgggtaaaggtaccgggtaacgggtaccgtaacgggttccggcgggttaccgttacccggacacggtttcggtaacgtttcggttaccttacgttaccgttccccgttccgtacgttacctaacggttcagtttaccggttaacgg

SEQ ID NO: 23856 - DNA, 733 bp, Homo sapiens
  misc_feature: GYAE6OF02FTWWO.24.35.D02.1.454.CMB.1.raw
  modified_base (203)..(203): a, c, t, g, unknown or other
  misc_feature (203)..(203): n is a, c, g, or t
  modified_base (714)..(714): a, c, t, g, unknown or other
  misc_feature (714)..(714): n is a, c, g, or t
tcagactactatgtcacgaccggtgctcgatttagcacacgatagttgggtttgggggaggaactgctcagttaggacccagaggaaccatggaagccccagcgcagcttctcttcctcctgctactctggctcccagataccactggagaagtagtcatgacgcagtctccagcccacctgtctgtgtctccgaggggaaangcccaccctctcctgcgtagggccaggtcgagtaatcggttggcagcaacgtttagccgttaggaccgagccaacggaaacctggaccgaggtccctcccgaggccccttactccctatactcgcgttacgtccctccggaacgccgggtccctcggttccggtaccccacggtccgttaacggtttcggttcggtcgggttgggttccgagggtaaccgtaagtaccgttttaccgacgttaccgcctaaacctctacggaacccgggtttcgtaccccgtaccggtacgtttaccggtaacggaaacgttttatttacccgtacgttttaaccgttttaagtttccgtacggtaaccttaaccgtaagttacgttggtacgtacgttcgtacccttaccgttaaccgttacgtttcggaccggtaacggtaaaccgtacgtacggaagtaaccgtacgaagtaacacgggtctacgcgtaaccttacgagttccttacctccgtttaanaccgtttcctaccctaccg

SEQ ID NO: 23857 - DNA, 830 bp, Homo sapiens
  misc_feature: GYAE6OF02GUU79.24.35.D02.1.454.CMB.1.raw
  modified_base (201)..(201): a, c, t, g, unknown or other
  misc_feature (201)..(201): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccacctctcctgcgagggccaggccggagtagttagtaagtacttaggacttacggtaaccaacgaagaaaccgtcggaccaagggcctccccgaacggccttacccgtcattctatgtatcgtacctacccgaacgtaacgggtaccaccgtacgggccccgtaccccggaccgtacggttacgagggttcggacggtacgggttcggggttacgtacggggactaaaccggttacgttcctaacgttacccgttaccgtaacccggttcgaacggtaccgacgggtacccttaacggaacccggtaccgttaacggtaaacggttttacggttttttacgggttaccggtttttaacctaccgttcgggttacctaacgggttacctaaccggggttccggtttaccccggccggttaccgggtacccggttaaccgtttaacccgggggtttaccgggggacccgggggggttaaccggtagggggttacggggaacgggtacgggaacggtaaccggttacggtacgggtacgcgtacggacctaccggtagttcgttacgttcctacgttaccgttcccgttacccgtcttaacgttaccgtaacgtaccgtagttacgg

SEQ ID NO: 23858 - DNA, 773 bp, Homo sapiens
  misc_feature: GYAE6OF02F2N71.24.35.D02.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggccaccctgtctttgtcctccagggganagacgccaccctctcctgcagggccagccggagtgtataagtactggctgtaccaanagaaacctggaccaggcctccagcctcncatctatgatcgtctacaaacgcgggtacacgtcggacccgtcccgaccgtaggttccgaggtcggcgtaggttcgggctacggactaaggtccttcgactttccgacgtaccgtactacggaccgtacgtacctacgggacgtacccggttagtaaacgggtttacgtttttacgggtaccgggtttttaacctaacgttcggttacgtaacggtccgttaaccggtccggtttacccgcgttccgggaacccgttaccggtttaaccggttaccggggggggccggggttaacccggtaggggttacggggaaaccggtacgggtaaccgtaacggggttaacccttggggtaacccgttcggtaccggtaccccgaagttaccgttccggtttaccggttacccgtttactaaccccgtttttccccggtacccgttacccttacggttacccgttaacggttaaacttcccggtttaacgg

SEQ ID NO: 23859 - DNA, 884 bp, Homo sapiens
  misc_feature: GYAE6OF02HUMCN.24.35.D02.1.454.CMB.1.raw
  modified_base (239)..(239): a, c, t, g, unknown or other
  misc_feature (239)..(239): n is a, c, g, or t
  modified_base (394)..(394): a, c, t, g, unknown or other
  misc_feature (394)..(394): n is a, c, g, or t
  modified_base (482)..(482): a, c, t, g, unknown or other
  misc_feature (482)..(482): n is a, c, g, or t
  modified_base (768)..(768): a, c, t, g, unknown or other
  misc_feature (768)..(768): n is a, c, g, or t
tcagactactatgtcacgaccggtgctcgatttagcacacgatagttgggtttgggggaggaacgtgctcagttaggacccagaggaaccatggaagcccagctcagcttctcttccgtcctgctactctggcctccagacgaccaccgggaagaaatttggtcgtttaggaaccaccgaaggtcctaccgacgggcctaccccgttggtccttttcggtccttccgaaaggggggtanaggaccgtccctaaccccgttctcccgttggccagggggcccaaggtcccgggaagttgttaacgaagttacgttacgggcttacggtaccaaccgtaagaaacccgtcggaccgaggtccgtaccgacggtcctccctacgtactaccgttagngttacgtcggttaccaccgtaaaccgacgggttccaacgttccggtccccggtacccccgccgttagggttacccaaggtcccgggtntaaccggggtggggttacggcggaacggtacgtaccttacgccgttccgttaaccgaacccgggtttccaaggctaaccggtcgaacgtcgtaccgtaagtaacgttacgttttcggttacgttaaccgttgttacggttaccgaagtccggtacttacccggggttcccttaccggtccggtcccgtaccggtttaacgttttcccgggggaacgggggggttaaacccgttcggggggtaagggaacccggtaggggtaaaccggtacgtaaacccggggtttntcgggggaaccgtccgaacggtccccgtaagttccggtacgttcccttaaaccgtcgtttccccggttaacccgacttttaccggaacccgtttaggacccgtaatttaacccggg

SEQ ID NO: 23860 - DNA, 686 bp, Homo sapiens
  misc_feature: GYAE6OF02FGMVS.24.35.D02.1.454.CMB.1.raw
  modified_base (214)..(214): a, c, t, g, unknown or other
  misc_feature (214)..(214): n is a, c, g, or t
  modified_base (311)..(311): a, c, t, g, unknown or other
  misc_feature (311)..(311): n is a, c, g, or t
tcagactactatgtcacgaccggtgctcgatttagcacacgatagttgggtttgggggaggaactgctcagttaggacccagagggaaccatggaacgccccagctcagcttctcttcctcctgctactctggcctcccagatgccaccggagacatttgtgttgacacagtcctccagccctaccctgttctttgtcctccgaaggggaaacncgccaccctctcctgcacgggccagtcgactaatggttaggtagttgttacgccgtaggtactcaaacaacaaactgtcggccacggcctccccggntccctctacttctactgatcgactactacaacgtcggaccacgtcggactaaccgtccccgaagtacgtacggttacacggtggtaccgtagggttcgggtcgtacgggaactacgtaccttccgtactcctaccgaacctactacgaacgtcgtaggttacgacgtacgtaccgtaagtaacgttacgtttacgactttaaggtttactcgttacgacgtacgaccgtaaccgagtaacccgtacgtcccggtacccgttaccggtttcccgggaccgtacgtaccgagtaccgtacgactaccgtaacccgtaacgtacgttcggtacgcctacgtacccgtacctacgttcctacgtttacctccgtacccg

SEQ ID NO: 23861 - DNA, 800 bp, Homo sapiens
  misc_feature: GYAE6OF02IBNQJ.24.35.D02.1.454.CMB.1.raw
  modified_base (489)..(489): a, c, t, g, unknown or other
  misc_feature (489)..(489): n is a, c, g, or t
tcagactactatgtcacgaccggtgctcgatttagcacacgatagttgggtttgggggagaactgctcagttaggacccagagggaaccatggaagccccagctcagcttctcttcctcctgctactctgctccagacgaccaccggagaattgtgttgacacagtctccaggcacccttgttctttcgtcctccgaggggacagacgtcccaccgtctaccgtgacgacgggcctaggccggtaggttcgttaagtaacgtacgtagtcgtacggtaacaacacggaaccgtggaccaggccgtacccgtaggtctacctcgtaactcgtagtcgtaacttcggttacccaaccgtaacggtcggggttacacggtcggtcccgttacccgaccggttaggttcgacggtcgggtcgtaagggttcgggttacggaacggtacgacgttacccgtttcgaccctttacgggtccaaccggggtttacncggtaccgaccggttccgttaacggtccggttaaccgttaggtaaacgtttcccggtttttacggttaaccggttttacaggttccgtcggtaaaccggtcgtaacgtttcccggttacccggcggttaccgaccgtttacggttaccggggtccgggggtaaccggggtcggtaggggacggtacgggaacggcggttaacgtcggtcggtacgacgttcgaccgttaacgtccggttcgttcttccggtaccgttaccgttcccggttccggaacgttaccggttcgtaacggttacctaagggttacg

SEQ ID NO: 23862 - DNA, 970 bp, Homo sapiens
  misc_feature: GYAE6OF02IV357.24.35.D02.1.454.CMB.1.raw
tcagactactatgtcacgaccggtgctcgatttagcacacgatagttggggtttgggggaggaactgctcagttaggacccagagggaaccatggaagccccagctcagcttctcttcctcctgctactctggcctccagacgaccaccgggaagtaaattggtgttagacgactagtcctaccgagggccacccgttgttcttttacggtcctccggagggggagaggacgaccctacccttccgtcctggaccgacgggaccacggccggtagttacggtttaaggtaagttacgttaggtccttacggttaaacccgaacgaaccgtaaccgtcgggtaccgacggtaccctacccgacggtcctaccttctaacttcgttatcgtattacgtaccctaaccgaacggacggttccaaccggtccggtaccccggacccccgtacggtaccggttactacgggtcgggtacgtacggggtcgggttaaccggacggtacgtaacccggttacctttaccgacctttaccgtacccggtaaccggtaccggtaacgtacccgtacggtaaccgttacccgggtaacgtaccggtttaacggtaacggttttaaccggtttccgggttttaaaccggtttaaacggtttaccttaaccgggttacggaccggttacccgttaccgggttaccccgggttttacccgccgggtttacccggggtaccccggtttaacggggtttttaacccggggttaccggggggaacccgggggggtaacccgggttaacggggggtacgggtaaacgggggacggttaaccgggttaaccgggtacgggttcgggtacggtaccggttaccgggaccttaacggttccgttaccgggtttcgtttaacccggttacccttaccgttccccgtacgttacctacggtaaccgtttaacgtacggttacgtttaaccgg

SEQ ID NO: 23863 - DNA, 974 bp, Homo sapiens
  misc_feature: GYAE6OF02F4I7G.24.35.D02.1.454.CMB.1.raw
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (299)..(299): a, c, t, g, unknown or other
  misc_feature (299)..(299): n is a, c, g, or t
tcagactactatgtcacgaccggtgctcgatttagcacacgatagttggggtttgggggaggaactgctcagttaggacccagagggaaccatggaagccccagctcagcttctcttcctcctgctactctggctccagagaccaccggagaaattgtgttgacacagtctccaggcaccctgtctttgtctccagggganaganccacctcgtcctgcagggccaggccggagtgttaagtaacgtacttaggcttaggtaaccaacgaagaaacctggccaggctcccaggcctccncactacgtactgaacttgtacctaaccgaacgtagggtccaacgtacgggtcccgttacccccgacgtacggttaccgtaaggtcgggtacacgggttaggggtccgtaggggtaaccagggttaaccctttaccgaacctttacccgtaccgtaacccgttcgaacggtaccaaccgggtacccttaaagggaccggtacccgtttacgggaaaaccgtttaagttttttaccggggtacggttttttaaaccgtaccggtttaccgtttacgtaaaccggtaccgtaaccgggtttaccccggtttacccggtaccccggtttacgggtaaccccggtttaacccggtttaaaacccggttttttacccggggggggaaccccgggggggggttaaacccgtaacggggggggtttaaccggggtaaacgggggtaaaccgggggttaaacgggtaaacccgggtaaaaaccggtttcccggggttaacggggtaacccggtttaccggggaacccgtaaacccccggttaacggttttaccccgtttacggttttaaccccgttttaaccgttaacccggtttaccccggttttaaccccccgggtaccccgttaaaccgtttaaccccggttaaaaccggttaaaccccgttaacgggtttttaaaccggg

SEQ ID NO: 23864 - DNA, 809 bp, Homo sapiens
  misc_feature: GYAE6OF02IGTGL.24.35.D02.1.454.CMB.1.raw
  modified_base (217)..(217): a, c, t, g, unknown or other
  misc_feature (217)..(217): n is a, c, g, or t
tcagactactatgtcacgaccggtgctcgatttagcacacgatagttgggtttgggggaggaactgctcagttaggacccagacggaaccatggaagccccgagcgcagcttctcttcctcctgctactctggcctcccagactaccactggagaagtagtcagtagaccgcagtcctccaagccctacctgtctgtgtcctaccggaaggggaaanacggccctacccgtcctccgtcgacgagggacctcggtaaggagtaattcggttggaccagaccgtaacgtaccgccgtacgtaccgtacgaccgtaacgtaaccgtcggaccgacggtcctaccgacggtcctaccgtcctacgttatcgtctcgtacctccgaccggtaccggtcccgtggtaccgccccgtacgaccccggttagggttttccggacgggtacccgggttggggtaccggttaacggggacgttaccgttacgtttacccacgttacccgtaacacccgtcgtaaccgccggtcccggtaccctcgtagggtaccgtacgtaaacggttctttacgtagttttacccttttacgtttccgtacgtttacccgtaaactacgttggtacgtacgttaccgttccgttcccgtaccgttacggtttaccggttttaccggaacccgggttaccgggtaaaccgtaacgggaagggtacctaaacggtacctaacgggttaccgtacgggtacgcctacggtaaccctacgtccgttacggttccgttaccgttaccgtacccttaccggtcccgtaaccgg

SEQ ID NO: 23865 - DNA, 809 bp, Homo sapiens
  misc_feature: GYAE6OF02HR34M.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggcctccagacgaccaccggagtaaagttgtcgttagacactagtcctaccgacggacctacccttgtctttcgtccttccgagggggaagagacgcctaccctcgtacctcgcgacggccaggaccggtagttagttaaggtaacgttacgtaggcgtacggtaaccaacgacggtaacctcggaccgtacggtccctaccgaggtccctacctactagtactagtacgtaattcggttaccacccggtaaggtaccgggttacaccggtccgggtacccccggtcccccgaggtttaccggttacgacgggttcgggaacgtgggggttccggttaccgggacggtaacgtaccgtacctttaccgacctttacgacccggtaaccgtcgaacgacccgtacggtaccgtaggtaccgttaccgtaggttaaacgtttacgttttcggttaccgtttaacgttacgttacgtacgcgtacgtaccggtccggttccgtaccgttcggtacctacggtttaccggtacggggtcgggtacggtaggggacggacggtacggacgtaacggtacgtacggagtaccgtacgacccgtacgtacgttaaggttccctaacgttccgtaccgtttcccgtaccgttacctacggttacggtaactaccggttaagttacgg

SEQ ID NO: 23866 - DNA, 786 bp, Homo sapiens
  misc_feature: GYAE6OF02JNRRH.24.35.D02.1.454.CMB.1.raw
  modified_base (200)..(200): a, c, t, g, unknown or other
  misc_feature (200)..(200): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctccagagaccacggagaattgtgttagacacagtctccaggcctacctgtctttgtctccgaggggnagacgccacctctcctgcgacgggccacggccggtagttgttaacgtaacggttacgttacggacgttacggtaacccaaaacgtaacggtaaaaccgttcggaccgtaacggtccctacccggaacggtccttacccgtactacgttaccgtagtacgacttcgtacctaccgaagtacgggtaccacggtcggaccccgtaccgtcgtaggtcacggtcggacgtgggtcgggtccgtacggaactcgtaccttactaccgtcgtccgtaaccgtacgtccgcgtaaccgtcgtaacgtaccgtaccgtagtaaacgtttcgttttacgacgtttaagtttacgtcttcgggtacaccggtaccgttggtaacgtaactacccggttggaccccgtttagtaccgggtacccgtacgggtaaccctaacgggttacctagggttaaccctacccgttaaccgggaaacttaccgggtttacggccggtcccgttaagccccgttaaacttcggaccgtttccgttacccgtttataacccccttccgggtttacccaacggtccgtttaagtacccgttaacgg

SEQ ID NO: 23867 - DNA, 712 bp, Homo sapiens
  misc_feature: GYAE6OF02F3LKR.24.35.D02.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (327)..(327): a, c, t, g, unknown or other
  misc_feature (327)..(327): n is a, c, g, or t
  modified_base (406)..(406): a, c, t, g, unknown or other
  misc_feature (406)..(406): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagagaccaccggagaaattgtgttgacacagtctccaggcaccctgtctttgtctccgagggganagagcccaccgtctcctgcagggccaaggccggagttgttagtaagtccgttaggctaggtaaccaagagtaaacctggaccaggcctccgaggccttaccncatcatgatcgtctaccaacgnggtcacgtggaccgtcccgcgtaggttcagtcgacgaggtggtaccgtgggactaagtacttcgactcgtcgaaccgtnacggtccaacggccttagaagtcccgtagtaacgttagttttacgtacggtttaacttacgttagtacgtacgtaccgtacgttccggttaccgtccggtacggtacccttacggtttaaccggtttaccggggtaccggggggtaaccgtaagggggttacggaagggtacgggtaacgtaacgggtaaacgttcgggttggaccggtacgaccgtacgtaacgttcgtacgttaccggttaccttaaccgttcccgttaaccccgtacctaacttcccggttaacgtaaccgttaggttaacgg

SEQ ID NO: 23868 - DNA, 814 bp, Homo sapiens
  misc_feature: GYAE6OF02JJEMV.24.35.D02.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggcctcccagtacgacccaccggagtaaacttgtgttgacacagttctccaggctaacctgtctttgtctcgagggganagngccacctctccgtgacgagggccaggcggtacgttgttaagtaacgtacgttaggcgtacggtaaccaaactacgaaaccgtcggccacggtcctccgtacggtcctccgtcgactctagtgacgttcgtaccgtaacctacgtacggtctaccggtcggtcccgtccccggtactaccggttcgtacgggtggtacgtagggtcggggttaaccgtcgggtaaccgtaggttaccttccgtaaccgttaccggttacccttaccgggtaccgtaccgggtacctaaccggtcccggttaaagacccgtccggttaacggtaacggttttaacggttttccgggttaacggttttaccgtaacgttacgtcgtaacgtaccggtacgttacccggttcccgtaaccggtccgggtaacccgtcgtttaacccgggttccgggacgggggtaccggtaacggggttcgggtacgggaacggtacgggtaaccggtaacggttcggtacggtcgttccgaccgtccggtaaccgttccggttactttcggtaccgttaccgttaccgttccgtaccgtactccggtaacgtacgttacgtacgg

SEQ ID NO: 23869 - DNA, 795 bp, Homo sapiens
  misc_feature: GYAE6OF02FQFNP.24.35.D02.1.454.CMB.1.raw
  modified_base (167)..(167): a, c, t, g, unknown or other
  misc_feature (167)..(167): n is a, c, g, or t
  modified_base (235)..(235): a, c, t, g, unknown or other
  misc_feature (235)..(235): n is a, c, g, or t
  modified_base (300)..(300): a, c, t, g, unknown or other
  misc_feature (300)..(300): n is a, c, g, or t
tcagactactatgtcacgaccggtgctcgatttagcacacgatagttggggtttgggggaggaactgctcagttaggacccagagggaaccatggaagccccagctcagcttctcttcctcctgctactctggctcccagagaccaccggagaaattgtgttgacanagtctccaggcaccctgtctttgtctccgaggggagagagccaccctctctgcaggccagtcggagtnttagtaagtacttaggctaggtaccaacgacgaacctggaccagctaccaggcctcatatactangatgtctaccaagaagggtcacgtggaccgtccccgtcgtacgttcgtaggtcggacgtacggtacggggtctagggaacctaggtaccttcgaacgtttccgactacccgttacgacgactacggtacccttaaggtaccgtaccgtaacggtaagttaacggttttcgggttaaccggttttaacttacgttacggttaccgaaaggttcccgtaacggttaccggttttaccgggacccgtttacccgggtcccgttaaccgttttaacccggggttttccggggggtaacccgggggggttaaaccgggtacgggggtttaacggggaaccggggttaacggggaaccggtaaccgggttaacggttacgggttaccggtaccgggtaccggtacgtaaccgtagtttcccgggttaccgttacccgtttactacccgttttacccgtacccggttaccgtaaccttacgtacggttaaccaagttaccgg

SEQ ID NO: 23870 - DNA, 749 bp, Homo sapiens
  misc_feature: GYAE6OF02H04YX.24.35.D02.1.454.CMB.1.raw
  modified_base (397)..(397): a, c, t, g, unknown or other
  misc_feature (397)..(397): n is a, c, g, or t
  modified_base (709)..(709): a, c, t, g, unknown or other
  misc_feature (709)..(709): n is a, c, g, or t
tcagactactatgtcacgaccggtgctcgatttagcacacgatagttgggtttgggggagaactgctcagttaggacccagagggaaccatggaagccccagctcagcttctcttcctcctgctactctggcctccagagaccgaccggaagaaattgtgttagacacagtctccgaggccacccttgttctttcgtctaccgaggggagagacgccctacctctccgtgaccgacgggccacgggtcccggtagttacggttaacgttaaagtacgttacgggtctacgggtaccaaacgagtaaacccgtggacccaggtccctacccgaggtccctcctctaagtcctaagtgactcgactactacgagtaaccggccaacgtcggactaaccnccgtaacgtacgtagggttccacgggttaggaccgttaggtcgggttctaacgggacctacggtttaccttacctaacgttccgtaacctacgtaacgttccggaaagtcggttacggacgtaacggtacgtccgttaagtaacgtttgtttacgaacgtttaagtttacgttcgtaagttccgagtaccgtacggttacaaaccggtcctcgtaacccggtttcgtacccgggacccttaagggaccttaaccggcttaccggactttaacgaccgtaacgtatttccggggaacgttccacgaccgttancctttaccggtgtacccttagggtccttcccggtcctaac

SEQ ID NO: 23871 - DNA, 739 bp, Homo sapiens
  misc_feature: GYAE6OF02HSLS3.24.35.D02.1.454.CMB.1.raw
  modified_base (372)..(372): a, c, t, g, unknown or other
  misc_feature (372)..(372): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagacgaccaccggagaaattgtgttgacacagtctccaggccacccttgttctttgtcctccgaggggagagacgcctaccctctccgtgcgagggccaggccggtagttggttagtaacgttacgttaggtcgttcggtaaccaacgaacgtaaccgtcggaccgtacggtccctacccgaggtcctccctctatactagtcgtagttcgtcctaccgtaacgtacgggtaccncgtaccggcccgtccccggtcgttaccggttcaggtcggcgtagggtcggtgacggtactacgtactcgactcctacgaccgtgacgtcgacgtcgtacgacgtccgtagtaacgtttacgtttacggttccgtttaataccgtcgtacgacggtacgtaccgtccggttcccggcgtcgtaccgttacgtttaccggggtccggggaccgggggtaccgtaggggtacggaacggaaccgggtacgtaacgggttacggtgggtaccgacggtccgaccgtaccgttggtccgttccgttacttaccggttacccttcccggttacccttacgtacgtttaaccgaaggttactacggtttaacgg

SEQ ID NO: 23872 - DNA, 914 bp, Homo sapiens
  misc_feature: GYAE6OF02JCZGN.24.35.D02.1.454.CMB.1.raw
tcagactactatgtcacgaccggtgctcgatttagcacacgatagttgggtttgggggaggaactgctcagttaggacccagagggaaccatggaagccccagctcagcttctcttcctcctgctactctggctcccagacgaccaccggagaaattgtgttgacacagtctccgagccacctgtctttgtcctaccgaggggagagacgtacccgacccgtacttcccgtggaccgtacggggcccaaggcccgggtaaggttcgtttaacgtaaacggttaaccgtttacgggtacctttacgggtaaacccaaaacgtaaacggtaaaaccccgtgggacccgtaacggtccccgttaccccgtaagggtcccttcccttaacgtaacgtttactaagttacgtaacgttcgttacccgtaaaccgaaacgtacggggtttaccaaccgggttccggtaccccggtacccccggtacgttaagggttccgaaggttaccgggaccgttaagggggttcgggttaccgtaggggaacctaaacggtcctttacgacccgtttacgtaccgaaccgttgaaaccggtccgaacggttacccgtaagtaccggtacccttaaaggtaaacgttttacggttttaccgggttaaccggtttaactaaacggttcgtaacgtaggtaccctaacggttccgttcccgacgtaccggtacccttaacggtttaccggtccgggggaacgggtaccggttaggggtacggtaaacggacgggttaaaccggaccggttaaacggttgggtaacgttaccggaccgttactaaccgttcgtttaaccggttgttacctttaaccgtaccgttcccgttacccgccgtaagttaccgtaacgttaacgtcggtttaacgg

SEQ ID NO: 23873 - DNA, 628 bp, Homo sapiens
  misc_feature: GYAE6OF02FE9LC.24.35.D02.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
  modified_base (404)..(404): a, c, t, g, unknown or other
  misc_feature (404)..(404): n is a, c, g, or t
tcagactactatgtcacgaccggtgctcgatttagcacacgatagttgggtttgggggaggaactgctcagttaggacccagagggaaccatggaagccccagctcagcttctcttcctcctgctactctggctcccagagaccaccggagaaattgtgttgacacagtctccaggcaccctgtcttgtctccagggganagngccacctctcctgcagggcccagccggagttgttagaagtacttaggctggtacccaacagaaacctggccaggctccccaggccttccgtcatctatgatgtctaccaacgngggtcactcggccgtccccgcaggttcagtggcagtcggggtctgggactaggcttacgacctctccaccgtcagcacgccctagacncgtagagtacttttgacgttaagtttacttactcgttcgaacgtcctaccgttagacctaacgtcggtccctacgtttcccgggcccttcgggacctacgtacgtacggactacgtaccaaacgtacgtcgtacgtcgtcgaccgtaacccacgttaccgttcgttaccttaccgtaacctttccccgttaccccgaccttaccgtttacgtaccggtaaaccg

SEQ ID NO: 23874 - DNA, 740 bp, Homo sapiens
  misc_feature: GYAE6OF02JHDTX.24.35.D02.1.454.CMB.1.raw
  modified_base (516)..(516): a, c, t, g, unknown or other
  misc_feature (516)..(516): n is a, c, g, or t
tcagactactatgtcacgaccggtgctcgatttagcacacgatagttgggtttgggggaggaactgctcagttaggaccagagggaaccatggaagccccagctccagcttctcttcctccgtgcttactcctggcctcccagacgacccgaccggagaaagttgtgttgaacactagtctccgacggcaccttgttctttgtcctcgaggggagagacgtcccacccttcgtctcgcgaacgggtccgaacggccggtagttacgtttaagtaaccgggttaaccgttagggtaccgtaccgggttaaaccaaacgaacggtaaacccgtacggtaccgtaacggtcctaccccggaaggtcctaccgttacgacgttacgtaagtacgggtattaccggtacctaaccgaacggtaacggttctacgggtccggtacccgtccccgtacgtacgttaccgtacggcggtacgagggttccggaggtcggacctagtaccgtcgtacctcgtacncgtacagcgaacgtcgtagcgtacgtaagtacgttgtttacgcgtttaactgtacgactaacgcgacttccgttcgtccggtccgtacgtaccgtttaacgggtccggggacggaagggtacggttaacgggcgtaagggtaacctagtacgtcggtaacgcgtcgacttacgtacgtcttaggtctacggccttcgaccctagtctaggaccttagacgtcgg

SEQ ID NO: 23875 - DNA, 627 bp, Homo sapiens
  misc_feature: GYAE6OF01DBAPE.24.41.D08.1.454.CMB.1.raw
  modified_base (369)..(369): a, c, t, g, unknown or other
  misc_feature (369)..(369): n is a, c, g, or t
tcagactactatgtcacgaccggtgctcgatttagtcacgcgagaaagggaaagggtctgtgaagccttcacagaccctgtccctcacttgcactgtctctggtggctccatcaatagtggtacttactattggagctggatccggaagcccgccgggaagggactggagtggattggccatatctacgccaatgggagaaccaggtacaacccctccctccagagtcgagtcaccatttcactggacccgtcaagaccaattgtccctgagtctgaattctgtgaccgccgcagacacggccacttatactgtgcgagagaggcgcagtggccgcaactaagtcgtttctactattatggtatggacncctggggccagggaccacggtcaccgtctcctcacgcctccaccaacggcccacgtcggtccttccccctcggccacccctcctccgaacgacgccacctcgtcggggccacgtacggccggcccgtcgggcctcggccgttagggtccgaaacgggtaccttaacccgtttccctaaccgtacgtttaacggttacggttcccgttacggtacgggtacccgggggtaccgttcggggaccgtaacggggtacccgg

SEQ ID NO: 23876 - DNA, 611 bp, Homo sapiens
  misc_feature: GYAE6OF02J07BG.24.41.D08.1.454.CMB.1.raw
  modified_base (339)..(339): a, c, t, g, unknown or other
  misc_feature (339)..(339): n is a, c, g, or t
tcagactactatgtcacgaccggtgctcgatttagtcacgcgagaaagggaaagggtctgtgaagccttcacagaccctgtccctcacttgcactgtctctggtggctccatcaatagtggtacttactattggagctggatccggaagcccgccgggaagggactggagtggattggccatatctacgccaatggggagaaccaggtacaacccctccctccagagtcgagtcaccatttcactggacccgtccaagaaccaattgtccctgagtctgaattctgtgaccgccgcagacacggccacttatactgtgcgagagaggcgcagtggccgnaactaagtcgtttcactattatggtatggacgcctggggccgagggaccacggtcaccgtctcctcagcctccaccaacgggctcactcggtccttcccctgcccaccctcctcccaacgacgccacccgtcgtacgggggcctaccgacggccggcccgtcgggcctcgcccgttcggtaccgaacgggtacccgtaccgtttacccaccgtacgttaacggttacgttccgttacggacggtccggggtccgtcgggaccgtaaccgggg

SEQ ID NO: 23877 - DNA, 588 bp, Homo sapiens
  misc_feature: GYAE6OF02ICP9U.24.41.D08.1.454.CMB.1.raw
  modified_base (409)..(409): a, c, t, g, unknown or other
  misc_feature (409)..(409): n is a, c, g, or t
tcagactactatgtcacgaccggtgctcgatttagtcacgcgagaaagggaaagggtctgtgaagccttcacagaccctgtccctcacttgcactgtctctggtggctccatcaatagtggtacttactattggagctggatccggaagcccgccggggaagggactgggagtggattggccatatctacgccaatgggagaaccaggtaccaacccctcctccagagtcgagtcaccatttcactggaccctcaagaccattgtccctgagtctgaattctgtgaccgccgcagcacggccacttattactgtgcgagagaggcgcagtggccgcaactaagtcgtttctacttattatggtatggacgtccgtgggggccgagggaccacgggtcacggtctcctcngccctccaccaacggccactcggtccttccccgtgccaccctcctccaacgacgcaccgtctcgggggccacgacgccggcccgtgggcctcgcccgtggtccgaacgggtaccttaccgttcccaactacgtacgttacgtcgtaggacggcggggaccgtcgggaccgagggtccgg

SEQ ID NO: 23878 - DNA, 869 bp, Homo sapiens
  misc_feature: GYAE6OF02JHWC5.24.41.D08.1.454.CMB.1.raw
  modified_base (286)..(286): a, c, t, g, unknown or other
  misc_feature (286)..(286): n is a, c, g, or t
tcagactactatgtcacgaccggtgctcgatttagtcacgcgagaaagggaaagggtctgtgaagccttcacagaccctgtccctcacttgcactgtctctggtgctccatcaatagtggtacttactattggagtctggactccggaagccccggcggggaagggctgggagtggattggccatactctacgaccaagtgggaacaaccaggtaccaaccccctccaccaggactacacgtcacctatttcaccttcggaccctacaaagacctattccgtcccngagttactagaactttcgagtcgaccgtccgcaacggacctaccggccttaacgtttaacttctacggtacggacgaaggtaacggacggtccgagtaacgggttccggcccgtaactaaaacggttacggtttaccgtttaacttaacctttaagttaacgtttcggggtaacttacggggtacccgtccggtacgggggtaccggtaaccggggtacctaccgggtacccgtacccggttctcccgtaccgtacccgtacccgtaccgtaacccgaaccgggtaccctacgtacccggttaccccttccccggacccgggtaccctaaccccgttccccgaacccgtaaccgtaccgtcccgtaacccggttcccgggtaccggggacccttacccgggaccgggtaccccggtccggttccgggtaccggttacccggtacccgggttaccggtacccggaaccgttaacccggtttaaccgtacccgttaaacggtaccgttaacggttaacccggtttacgtaccggggtaccggtaccggggtacccggtaacgggtaccgggtaccggtaaccggg

SEQ ID NO: 23879 - DNA, 291 bp, Homo sapiens
  misc_feature: GYAE6OF01BKVNQ.9.22.B11.1.454.CMB.1.raw
  modified_base (288)..(291): a, c, t, g, unknown or other
  misc_feature (288)..(291): n is a, c, g, or t
tcagtgatacgtctcacgaccggtgctcgatttagacgacagctcagggattcctgaccgtttctctgcctccaagtctggctcgtcagccaccctggccatcaccggactccagactggggacgaggcccattattactgcggaacatgggattacaggttgagtgttggggctttcggcggagggaccgagctgagcgtcctaggtcagcccaaggctgccccctcggtcactctgttcccgccctcctcagacgtatcactgagcgggctggcaaggcgcatagnnnn

SEQ ID NO: 23880 - DNA, 291 bp, Homo sapiens
  misc_feature: GYAE6OF01DCMT3.9.22.B11.1.454.CMB.1.raw
  modified_base (289)..(291): a, c, t, g, unknown or other
  misc_feature (289)..(291): n is a, c, g, or t
tcagtgatacgtctcacgaccggtgctcgatttagacgacagctcagggattcctgaccgtttctctgcctccaagtctggctcgtcagccaccctggccatcaccggactccagactggggacgaggcccattattactgcggaacatgggattacaggttgagtgttggggctttcggcggagggaccgagctgagcgtcctaggtcagcccaaggctcgccccctcggtcactctgttcccgccctcctcagacgtatcactgagcgggctggcaaggcgcatagnnn

SEQ ID NO: 23881 - DNA, 292 bp, Homo sapiens
  misc_feature: GYAE6OF01EUIPG.9.22.B11.1.454.CMB.1.raw
  modified_base (288)..(292): a, c, t, g, unknown or other
  misc_feature (288)..(292): n is a, c, g, or t
tcagtgatacgtctcacgaccggtgctcgatttagacgacagctcagggattcctgaccgtttctctgcctccaagtctggctcgtcagccaccctggccatcaccggactccagactggggacgaggcccattattactgcggaacatgggattacaggttgagtgttggggctttcggcggagggaccgagctgagcgtcctaggtcagcccaaggctgccccctcggtcactctgttcccaccctcctcagacgtatcactgagcgggctggcaaggcgcatagnnnnn

SEQ ID NO: 23882 - DNA, 510 bp, Homo sapiens
  misc_feature: GYAE6OF01DW4IY.9.22.B11.1.454.CMB.1.raw
  modified_base (482)..(482): a, c, t, g, unknown or other
  misc_feature (482)..(482): n is a, c, g, or t
tcagtgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgcggccccaggacagagggtcaccatctcctgctctggaaacctcaccaacattgagagcaattatgtttcctggtaccagcagctcccaggaagacgcccccaaatcctcatctatgacaatgaataaacgacctcaggattcctgtaccgtttctctgccctcaagtctggctcgtcagccaccctggccatcacctgacctccagacgtgggacgacggcccattatactgacgaacagtgggattacgaggttgagtggttgggcgtttcgggcggtagggaccgngcgtgagtcgtctaggcagcccgaacgg

SEQ ID NO: 23883 - DNA, 631 bp, Homo sapiens
  misc_feature: GYAE6OF01ASIAR.9.22.B11.1.454.CMB.1.raw
tcagtgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgcggccccaggacagaggtcaccatctcctgctctggaaacctcaccaacattgagagactaattatgtttcctggtaccagcagcctcccgaaggaacgacgacccccaaactcctacatctatgaacaatcgaataaaaccgccctacgaagggtactttcctacgtaccgtttctcctcgcccttaccaagtccgtcggaccttccggtacaacgccccaccccgtcggacccaactcccgaaccggtacctacccgaaggtaccggtcgggggaaccacgggtccctaagttacttacgtcggacgaacgtagtcgggtaattacgtagggttagtaggttggttcggggtcgtttacggggacgggtacggggtaccggaggtcgttaggaggtcccgttaccgtaagggtccaacggccccgaagggtccccg

SEQ ID NO: 23884 - DNA, 708 bp, Homo sapiens
  misc_feature: GYAE6OF01EG1FW.9.22.B11.1.454.CMB.1.raw
tcagtgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgccggccccaggacagagggtcaccatctcctgctctacggaaacctcaaccaacattgagagactaattatcgtttcctggtaccagcagcctacccgaaggaacgaccgacccccctaaactccctacactctaatacgaacaatcgaaactaaaccgtaccctagaacgggtacttcctcgtacccgtttctcgtcgtaccctaccgtaagttccgtcggtcctccgtaccaccggtaccccaccccgttggacccctaacgtacccgtaacccgggtacctacccgaacggtaccggtacgggggaccctaaccgggtcccctaatttaacgtaccgtggaaccggaaactaggttacggggtaactttaacggtagggttaggtaggttggggtttacgggggtaccgttttaccgggggacggggaacgggtacccggtagggtccgtacgggtaacggtcccggttacccgtaggggtaccaaccgggtccccgtaaaggggtcccccg

SEQ ID NO: 23885 - DNA, 311 bp, Homo sapiens
  misc_feature: GYAE6OF01C8YMF.9.22.B11.1.454.CMB.1.raw
  modified_base (291)..(311): a, c, t, g, unknown or other
  misc_feature (291)..(311): n is a, c, g, or t
tcagtgatacgtctcacgaccggtgctcgatttagacgacagctcagggattcctgaccgtttctctgcctccaagtctggctcgtccagccaccctggccatcaccggactccagactggggacgaggcccattattactgcggaacatgggattacaggttgagtgttggggctttcggcggagggaccgagctggagcgtcctaggtcagcccaaggctcgcccctggtcactctgttcccacctctcagacgtatcaactgaagcgggctggccaaggcgccatagnnnnnnnnnnnnnnnnnnnnn

SEQ ID NO: 23886 - DNA, 751 bp, Homo sapiens
  misc_feature: GYAE6OF01DIU7P.9.22.B11.1.454.CMB.1.raw
tcagtgatacgtctcacgaccggtgctcgatttagacgacagctcaggggagctctgcttcagctgtgagcgcagaaggcaggactcgggacaatcttcatcatgacctgctccctctcctcctcacccttctcattcactgcacagggtcctgggcccagtctgtggtgacgcagcccgccctcagtgtctgcggccccaggacagaggtcaccatctcctgctctacggaacctcaccaacattgagagctaattatgtttcctggtaccagtcagcctacccgagggaacgacgacccccaaactcctcactctactgaaccaatagaactaaaccgaccctagacgggtacttccgtagtacccgtttcctctcgtccctacctaacgttccgtggtaccttcggtaccaccggtacccctaccccgttcgggacccctaacgtacccgaaccccgggtaccttccccgaagggtaacccggttcggggggaacctaccgggtaccccctaagttttaaccgttaacgtcgggaacccgggtaaacgtaggttaacgggggtaactttaaccggtaggggtttacggtacggggtttacggggtttcggggggttcccgttttaccggggggaccggggtaacgggggtaaccccggtagggtaccgttacggggacggttaccccgggtttacccgttaagggggttaccccaaaccggggtcccccggtaaagggttcccccggg

SEQ ID NO: 23887 - DNA, 666 bp, Homo sapiens
  misc_feature: GYAE6OF01C8T1B.9.22.B11.1.454.CMB.1.raw
  modified_base (317)..(317): a, c, t, g, unknown or other
  misc_feature (317)..(317): n is a, c, g, or t
  modified_base (384)..(384): a, c, t, g, unknown or other
  misc_feature (384)..(384): n is a, c, g, or t
tcagtgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgccggccccaggacagagggtcaccatctcctgctctggaaacctcaaccaacattgagagctaattatgtttcctaggtaccagcagcctaccgaggaacgacgacccccaactcctcatctangaacatgaactaacgaccctcgaagggtacttccctagtaccgtttctcgtcgtcctaccaagttcncggtctcgtcacgtccctacccgtgaccctactccgaacccggacctaccgaggtaccggtacggggaccgaccggtaccctaagtttaaccgttacgtcggaaccgggtaaactagggttacgggtaactttaaccggtagggtttggaacgggtttcggggtttacgggggcccgtttttcgggggaccggggtacgggggaacccggtacgggtccgttacgggaccgttaccggttacccggttacggtaccgaaccggcccgtaacgggtcccccgg

SEQ ID NO: 23888 - DNA, 295 bp, Homo sapiens
  misc_feature: GYAE6OF01DP794.9.22.B11.1.454.CMB.1.raw
  modified_base (273)..(273): a, c, t, g, unknown or other
  misc_feature (273)..(273): n is a, c, g, or t
  modified_base (289)..(295): a, c, t, g, unknown or other
  misc_feature (289)..(295): n is a, c, g, or t
tcagtgatacgtctcacgaccggtgctcgatttagacgacagctcagggattcctgaccgtttctctgcctccaagtctggctcgtcagccaccctggccatcaccggactccagactggggacgaggcccattattactgcggaacatgggattacaggttgagtgttggggctttcggcggagggccgagctgagcgtcctaggtcagcccaaggctcgccccctggtcactctgttccccaccctcctcagacgtatcactgagccgggntggcaaggcgcatagnnnnnnn

SEQ ID NO: 23889 - DNA, 652 bp, Homo sapiens
  misc_feature: GYAE6OF01A7HSA.9.22.B11.1.454.CMB.1.raw
tcagtgatacgtctcacgaccggtgctcgatttagacgacagctcagggggagctctgcttcagctgtgagcgcagaaggcaggactcgggacaatcttcatcatgacctgctcccctctcctcctcaccctttctcattcactgcacgagggtcctgggcccagtctgtggtgacgcacgcccgccctcagtgtcgtcgccggaccccgagggaccaggacgggtccaaccactcctcctgcctacgtacggaaacctccaaccaacagttacggagacgtactaattacttcgtttaccgtcggtaccagaccacgccgtacccgaaggaaccgaccgaaccccctaaactcctactattactacacgaactatacgtaacaaaccgcctaggacggtactaccttcgtaccttctacgtctcctacagtcgtcgtcctacgtcaaccgccgtacccgtcgacccacgtacccgaaccggtacctcccgaagggtaccggtacgggtaaccgaccggtaccctaagtttaccgtacgtacggacgtaacgtagtacggtacgtacgtagtggtaggtcggttgggtcgttcgggaggtacggagacggtcaggtcgacgtacgtacggtaccgacgtacgtacggtcccg

SEQ ID NO: 23890 - DNA, 298 bp, Homo sapiens
  misc_feature: GYAE6OF01A31BP.9.22.B11.1.454.CMB.1.raw
  modified_base (259)..(259): a, c, t, g, unknown or other
  misc_feature (259)..(259): n is a, c, g, or t
  modified_base (288)..(298): a, c, t, g, unknown or other
  misc_feature (288)..(298): n is a, c, g, or t
tcagtgatacgtctcacgaccggtgctcgatttagacgacagctcagggattcctgaccgtttctctgcctccaagtctggctcgtcagccaccctggccatcaccggactccagactggggacgaggcccattattactgcggaacatgggattacaggttgagtgttggggctttcggcggagggaccgagctgagcgtcctaggtcagcccaaggctgccccctcggtcactctgttcccaccctcctcagacgtntcactgagcgggctggcaaggcgcatagnnnnnnnnnnn

SEQ ID NO: 23891 - DNA, 722 bp, Homo sapiens
  misc_feature: GYAE6OF01CVH5C.9.22.B11.1.454.CMB.1.raw
  modified_base (192)..(192): a, c, t, g, unknown or other
  misc_feature (192)..(192): n is a, c, g, or t
tcagtgatacgtctcacgaccggtgctcgatttagacgacagctcaggggagctctgcttcagctgtgagcgcagaaggcaggactcgggacaatcttcatcatgacctgcctcccctctccctcctcctacccttctcattcactgcacgagggtcctgggcccagtctgtggtagacgcagcccgccctnagtcgtctcggccggccccaggacaggacggtcaccatcctctgtcctacgtacggtaaaccctcaaacctaactattgaaggtacgactaaatttattcgtttaccttagggtaaccctagccacgtcctacccgaaggtaacgaacccgacccccctaaatccctacattacctaagtcgaacaatacgaaactaaaaccgtacccctaggtaacgggtacttcccgtacgtttaacccgttctcgtaccgtaccgtacctaagtccgtcggtcctccgtaccaccgtccctacccgtccggaccctactacccgaaccgacctaccgacgtacggtacgggaccgtaccgtacccgtaacttaacgttacgtacgtaacggtaacgtaggttacggtacgttaacgtagggttggtaggttcggggttacgggtcggtttaccggggcgggaacggggtacggacggtacgtcgggtacggtcccggttaccggtaggacccgtaccggacccggaacggttccccg

SEQ ID NO: 23892 - DNA, 903 bp, Homo sapiens
  misc_feature: GYAE6OF01C7EPQ.9.22.B11.1.454.CMB.1.raw
tcagtgatacgtctcacgaccggtgctcgatttagacgacagctcaggggagctctgcttcagctgtgagcgcagaaggcaggactcggacaatcttcatcatcgacctcgcctcccctctccctcctcctacccttctctattcacgtgacacgacgggtccgtcgggaccctagtcgtggtaggtcgaccgccgacgcccgtccctgtagttcgtccgtcggcccggaccccgaggacgagggacggtaccaacctactcctccgtacgtcctaccgtaaccggtaaaccctaccaaacctaacgtagttacgaagtacgtaactttaactttagtttaccgtttaccgtacggtaccgacgtaccgtaaccgtcccgtaaccggaacggtaaacccgaccccgtaaacccccctaaccttccctaactaacgtttacctaacggtaacctaaacgtaacgtaaaccgtaaaccgtaaaccccgttacccgtaacggtaaacggttccctttacccgtttaaccggttaccctttccgtcctacccgtaccctaaccggtacggttccgtccggttaccgttaccgacccgtacccgtacccctacggtaccggtaccctaccggtaacccgtacccggtaccgttaccggacgggtaaccggggtccggaaaccgttcccggtaactttacggttaacgtaccggtacgaaccggtaactagggttacgtaagttacggttagggttcgggttaagggtttcgggtttaaccggggtccggggttaaccgggggaccgggttaacgggaccgggttacgtcgggtaacccgggttacggttaccccggttaacgggacgggttacccaaccccgggtacccggtaccggttccccccggg

SEQ ID NO: 23893 - DNA, 975 bp, Homo sapiens
  misc_feature: GYAE6OF01DHH36.9.22.B11.1.454.CMB.1.raw
  modified_base (916)..(916): a, c, t, g, unknown or other
  misc_feature (916)..(916): n is a, c, g, or t
tcagtgatacgtctcacgaccggtgctcgatttagacgacagctcaggggagctctgcttcagctgtgagcgcagaaggcaggactcggacaatcttcatcatcgacctcgcctcccctctccctcctcctacccttctctacttaccactcgaccgaccgtacgggttcccgtcgggcccctagttcgttggtggtacgaccgcgacgcccgtccctcgtaggtcgttccgcggacccggaccccgagggaaccgtacgggtaaccgggtacccaccttacttcccgttccgtacggtaccttaccgtaaccggtaaaccccttacaaacccgaacgttagttacggaacgtacgtaacgtttaaatttcgtttaccggtttaccgttaacggttacccaaggtaccgtaacccggtccccgtaaaccgggaaaccgggtaaacccgggaaccccgtaaccccccgttaaccttacccgtaccttaacttaccgtaacgtaaccgtaaacgtacgttaaacgtaaacccgtaaacccggtaacccgttacgggtaaccgggttaccctttacccggtaacccggttttcccgttaccgttaaccccgtcccgttaacccgttaaccgttaccggtttacggtcggttaccctacccggtacccgtaacccggtccccgtaacccgttccgaaccgtcccgtacccggtaaaccggtcccgttacccgggaacgggttaaccccgggacggggttaaccggtaacccgttaaccgtttaagtttcccttaaccggggtaaccaaccgggttaaggttacggttaacgggtacgtttaacggggttacgggttacggttaggggttttcggtacccgggggttacggtttaccgggaaccgggggtagtacccgggntacgggtcggtaccgtccggttaaccgtcggacccacgggttcccggacgttccccggg

SEQ ID NO: 23894 - DNA, 820 bp, Homo sapiens
  misc_feature: GYAE6OF01DW7SM.9.22.B11.1.454.CMB.1.raw
  modified_base (270)..(270): a, c, t, g, unknown or other
  misc_feature (270)..(270): n is a, c, g, or t
  modified_base (351)..(351): a, c, t, g, unknown or other
  misc_feature (351)..(351): n is a, c, g, or t
tcagtgatacgtctcacgaccggtgctcgatttagacgacagctcaggggagctctgcttcagctgtgagcgcagaaggcaggactcggacaatcttcatcatcgacctcgcctcccctctccctcctacctacccttctctacttcactcgacacggtacgggtcccgtcgggccctagttcgtggtacggtacgaccgccgacgccccgtccctgtagttcgtccgtcggcccgcccgaggacgaggcggtaccacctactcctccgngtccttacggacgtaaccctcaaccgtaactagtagaacgtacgtaactttagtttacgtttcgttaccgtacggtaaccncggtacgaccgtacccgaacccgggtaaaggaacccgtaacccccgtaacccccttaatcccttactaagttactaaacgtacgaaactacgtaacgtaaaccgtaacccgtaccgtacgggtaacgttacttaccgtaccgttaccctttcgtcctacccgtaccgtaacggtaccgttccgtccgttcgtacccgaccctacccgacccctaccggtcgtacctacccgtaccggacccgtaccgtacggtaacgggtcggaacggggtaccctacggttcttaacgttacgtcgtacggaactcggtacgttacgtacgttacggtgggttacggttacgggttcgggtttaaccgggtcgggtaaccggggtacggggtaccggtacgtcggttcggtacccggtaccggttcccggtaacgggttaccgtaaccgggccccggttaaccgcccggttcccccgg

SEQ ID NO: 23895 - DNA, 878 bp, Homo sapiens
  misc_feature: GYAE6OF01AOZR9.9.22.B11.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
tcagtgatacgtctcacgaccggtgctcgatttagacgacagctcaggggagctctgcttcagctgtgagcgcagaaggcaggactcgggacaatcttcatcatcgacctgcctcccctctccctcctcacccttctctacttcactgcacgagggtccgtcgggcctagtctggtggtgacgcacgcccgcctgngtntcgcgcccggcccaggacacggacgggtccaccgactcctccgtcgccgttacgtaaccggaaacccttaccaaccgtaacgtagttacggaacgtagtaaccttaatttacgtttccggttttaccggtacggtacctacgccgaaccggtacccgtaccccggaaaggggaacccaaccccggtaccccctaaaacccgtcctacgttactactacgtaacgaaacctaagtaaccggaaacctaaacccggtaccgtacgtaacggtacctttcgttacggtacccgtttcctccggtacctaccgtacggtacgtccgtcggtaccttaccggactacccgtaccgtacccgtaccgggtacccctacggccccgtaacccggtaccgtaccggaaccgggttaccgggacccggggaccgtaccgttaccgtttaacgtttaacccgttacgggtaccgtaaaccgggtacggtttaacggggtacgtttacgggtttacggtaaccggggtttgttaaccggggggtttccgggttgggggtttaccccggggttagggggaccccggggtaaacgggtacccggttacgggtcgggttacggttacccgggtacggttacccggtaacccgggtaacccggacccgggtaacccggtcccgggttcccccgg

SEQ ID NO: 23896 - DNA, 677 bp, Homo sapiens
  misc_feature: GYAE6OF01AXYNZ.9.22.B11.1.454.CMB.1.raw
tcagtgatacgtctcacgaccggtgctcgatttagacgacagctcagggggagctctgcttcagctgtgagcgcagaaggcaggactcgggacaatcttcatcatgacctgctcccctctcctcctcacccttctcattcactgcacgacgggtcctcgggcccagtctggtggtcgacgcacgcccgccctcgagtgtcgtcgccggcccaggacaggacggtcaccatcctctgccgtcgtacggaacctacgaacctaactagtagaagacgtactaagttagttcgtttaccgtcggtaccagaccagaccgtaccgaagggaacgacccgaccccaactcctacgtactacgtatacgaactaagtacgacctaaaccgcctagacggtacttcgtacgtaccttcttcgctcctacgtacgtacgtcgacgttcctacgaccaccgtccgtaccgactacctaccgaaccggtaccgtacgtaccgtacgggacgggtaccggacgtacctacgttacttacgtcggtaacgacgtacggtaggttacgttaactgggttacgtcggtttagggtacgggttccggtttacgggacgggtacgggtaccggagttcggacggtacgtccggttacggtaaccgacgggaaccggtaccggtcgtacccggg

SEQ ID NO: 23897 - DNA, 811 bp, Homo sapiens
  misc_feature: GYAE6OF01B3J68.9.22.B11.1.454.CMB.1.raw
tcagtgatacgtctcacgaccggtgctcgatttagacgacagctcaggggagctctgcttcagctgtgagcgcagaagcaggactcggacaatcttcatcatgacctgcctcccctctcctcctccacccttctcattcactgcacgacggtcctggcccagtctgtggtcgacgcacgcccgacctcgagtcgtcgtcggcccggaccccaggacgaggtacggtaccaccgtactcctccgtcgtcctacgtacgaaaccctcaacccaattacgttaggaacgtacgaacttaagtttacgtttccgtttccgtacggtaccacgtaccgtacggtaccctacccggaaacggtaacccgaaccccgaccccctaaacctcctacaacttacgtacgtacgaaactaacgtaacgtaaacgtaaacccgtacccgtaagtacgggtaacctttcccgtacgtttacccgtttctccgtctaccctacgtaacgtcgtacgtccgtcgtaccgtacccgtacccgtaccgtaccgacccgtaccgtaaccccggtaacccgtacccgtacccgtacgggtacgggaccgggtaacggtaccgtaccgttaacttacgtaccgtacggaacgtacgtacggtacgttaacgtacggttagggttacgttacgggtttcgggttacggggtaccggttaccgggggtacgggtaccgggtaccggtacgggttccggtacgggtaccccggttacggttacccggtacgggtaacccgtaacccgggtcccggtaaacccgggtcccccgg

SEQ ID NO: 23898 - DNA, 781 bp, Homo sapiens
  misc_feature: GYAE6OF01BKV10.9.22.B11.1.454.CMB.1.raw
  modified_base (162)..(162): a, c, t, g, unknown or other
  misc_feature (162)..(162): n is a, c, g, or t
  modified_base (235)..(235): a, c, t, g, unknown or other
  misc_feature (235)..(235): n is a, c, g, or t
  modified_base (729)..(729): a, c, t, g, unknown or other
  misc_feature (729)..(729): n is a, c, g, or t
  modified_base (739)..(739): a, c, t, g, unknown or other
  misc_feature (739)..(739): n is a, c, g, or t
tcagtgatacgtctcacgaccggtgctcgatttagacgacagctcaggggagctctgcttcagctgtgagcgcagaaggcaggactcgggacaatcttcatcatgtacctcgcctcccctctccctcctcctacccttctcattcactgcacgtcgggtccncgggcccagtcgtggtggtcgaccgcgtacgcccgccctcgtagtcgtccgtcgcccggacccgagggaacgnggtacggtccacctactccgttccctgtcctaccgtacggtaaaccctcctaacccgaattagttaggaaccgtagtacttaacgtttacgttccggttttaccgtaacggtaccccaggaccctacgtacccggtaaccgaacgggtaacgaccccgtaacccctaaccgtccctacgtacgttacgtaaacgtagaaaccgtacggtaaacgtaaaccgtaaacccgtacccgtaacggtacgggttaacccttcccggttaaccgggttccctttaccgctacccgtacctaccgtacgtcccgtgtacccgtacgtcgacccgtccccgtaccgtacaccgtaaccctaccggaccctacccggtagaccgggtacggtaccgggcctaacggtccctttagtacgtccggaaccgagtaacgtagggttaagttccggttaagtccgggttgtacgtggggttccggtcggtacggggtgaccggtagnggttaccggngtacccggtcggtcgtacggacctacgtccggcggttccccg

SEQ ID NO: 23899 - DNA, 293 bp, Homo sapiens
  misc_feature: GYAE6OF02GD25H.9.22.B11.1.454.CMB.1.raw
  modified_base (288)..(293): a, c, t, g, unknown or other
  misc_feature (288)..(293): n is a, c, g, or t
tcagtgatacgtctcacgaccggtgctcgatttagacgacagctcagggattcctgaccgtttctctgcctccaagtctggctcgtcagccaccctggccatcaccggactccagactggggacgaggcccattattactgcggaacatgggattacaggttgagtgttggggctttcggcggagggaccgagctgagcgtcctaggtcagcccaaggctgccccctcggtcactctgttcccaccctcctcagacgtatcactgagcgggctggcaaggcgcatagnnnnnn

SEQ ID NO: 23900 - DNA, 291 bp, Homo sapiens
  misc_feature: GYAE6OF02GS3WL.9.22.B11.1.454.CMB.1.raw
  modified_base (289)..(291): a, c, t, g, unknown or other
  misc_feature (289)..(291): n is a, c, g, or t
tcagtgatacgtctcacgaccggtgctcgatttagacgacagctcagggattcctgaccgtttctctgcctccaagtctggctcgtcagccaccctggccatcaccggactccagactggggacgaggcccattattactgcggaacatgggattacaggttgagtgttggggctttcggcggagggaccgagctgagcgtcctaggtcagcccaaggctgccccctcggtcactctgttccccgccctcctcagacgtatcactgagcgggctggcaaggcgcatagnnn

SEQ ID NO: 23901 - DNA, 292 bp, Homo sapiens
  misc_feature: GYAE6OF02IY63Q.9.22.B11.1.454.CMB.1.raw
  modified_base (287)..(292): a, c, t, g, unknown or other
  misc_feature (287)..(292): n is a, c, g, or t
tcagtgatacgtctcacgaccggtgctcgatttagacgacagctcagggattcctgaccgtttctctgcctccaagtctggctcgtcagccaccctggccatcaccggactccagactggggacgaggcccattattactgcggaacatgggattacaggttgagtgttggggctttcggcggagggaccgagctgagcgtcctaggtcagcccaaggctgccccctggtcactctgttcccaccctcctcagacgtatcactgagcgggctggcaaggcgcatagnnnnnn

SEQ ID NO: 23902 - DNA, 605 bp, Homo sapiens
  misc_feature: GYAE6OF02IID2B.9.22.B11.1.454.CMB.1.raw
  modified_base (364)..(364): a, c, t, g, unknown or other
  misc_feature (364)..(364): n is a, c, g, or t
tcagtgatacgtctcacgaccggtgctcgatttagacgacagctcagggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgcggccccaggacagagggtcaccatcctcctgctctggaaacctcaccaacattgagagcaattatgtttcctggtaccagcagcctcccgaggaacgacgcccccaaactcctacatctatgacaatgataaaccgaccctacgaggacttcctagaccgtttctctcncctccaagtctgcctcgtcacgcccacctcggcccatccacccggtacctacccgacggaccgttacggggaaccgacgggacccctaagtttaacgttactcggacgggtaactagtacgggtaattaccgtaggttgaggttggtttacggggtcgttttcggggacgggtaacgggaccggtaggcgttaggacggtccggttaccgtagggtaccacggtaccccgaagggtccccg

SEQ ID NO: 23903 - DNA, 289 bp, Homo sapiens
  misc_feature: GYAE6OF02IC037.9.22.B11.1.454.CMB.1.raw
  modified_base (287)..(289): a, c, t, g, unknown or other
  misc_feature (287)..(289): n is a, c, g, or t
tcagtgatacgtctcacgaccggtgctcgatttagacgacagctcagggattcctgaccgtttctctgcctccaagtctggctcgtcagccaccctggccatcaccggactccagactggggacgaggcccattattactgcggaacatgggattacaggttgagtgttggggcttttcggcggagggaccgagctgagcgtcctaggtcagcccaaggctgccccctggtcactctgttcccaccctcctcagacgtatcactgagcggctggcaaggcgcatagnnn

SEQ ID NO: 23904 - DNA, 699 bp, Homo sapiens
  misc_feature: GYAE6OF02HWXQD.9.22.B11.1.454.CMB.1.raw
  modified_base (638)..(638): a, c, t, g, unknown or other
  misc_feature (638)..(638): n is a, c, g, or t
tcagtgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgcggccccaggacagaggtcacatctctgctctggaaacctcaccaacattgacgagacaattatgttcctggtaccagcagctccgaaggaagacgaccccaaactcctacatcctatcgaacaatgaataaaccgaccctagaacgggtactttcccgtacgtacccgttttctactcgtacccttacccgtaaacggttcgttcggtaccttacggttccaaccgtccccctaaccccgtgggtacccctaattacccggaacccggtaaccctcccgaacggtaaccgggttacgggggaacccgaaccgggtacccctaaatttaaccgttaacttacggggaccgtaaaacgtagttagggtaacttaacgggtagggtttcggtaaggttcgggtttacggggttccttttcggggaccgggtaacgggttaacccggnggtaccgttggaacggttccggtaccgttagggtacccgacggtaccccgtaaggtccccg

SEQ ID NO: 23905 - DNA, 700 bp, Homo sapiens
  misc_feature: GYAE6OF02JHAK8.9.22.B11.1.454.CMB.1.raw
tcagtgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgccggccccagggacagagggtcaccatctcctgctctggaaacctcaccaacattgagagcaattatgttcctggtaccagcagctcccaggaagacgcccccaaactcctcatctatgaacaatgaactaaaccgaccctcgaagggtacttccgtgtacccgttttctactcgtccctcctaagtcctggtctccgtcacgcccacccctcggccactaccgaacccggtacctcccgaggtaaccggttcgggggaaccgaccggtacccctaagtttaaccttaccgtacgggaccggtaaaccgtagttacggggtaacttttaacggtaagggtttacggtagggtttacggggttttcgggggttaccgtttttaccgggggaccgggggttaacggggtaaccccgggtagggtacccggttacgggaacgggtccccgggtttacccggttaacggggtttacccgaaccgggtacccccggtaaaggggtcccccgg

SEQ ID NO: 23906 - DNA, 294 bp, Homo sapiens
  misc_feature: GYAE6OF02GAEXJ.9.22.B11.1.454.CMB.1.raw
  modified_base (291)..(294): a, c, t, g, unknown or other
  misc_feature (291)..(294): n is a, c, g, or t
tcagtgatacgtctcacgaccggtgctcgatttagacgacagctcagggattcctgaccgtttctctgcctccaagtctggctcgtcagccaccctggccatcaccggactccagactggggacgaggcccattattactgcggaacatgggattacaggttgagtgttggggctttcggcggagggaccgagctgagcgtcctaggtcagcccaaggctcgccccctcggtcactctcgttccccaccctcctcagacgtatcactgagcgggctggcaaggcgcatagnnnn

SEQ ID NO: 23907 - DNA, 569 bp, Homo sapiens
  misc_feature: GYAE6OF02G1R32.9.22.B11.1.454.CMB.1.raw
  modified_base (317)..(317): a, c, t, g, unknown or other
  misc_feature (317)..(317): n is a, c, g, or t
tcagtgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgccggccccaggacagagggtcaccatctcctgctctggaaacctcaccaacattgagagcaattatgtttcctggtaccagcagctcccaggaagacgccccaaactcctcatctatgacaatnataaacgcctcgaggacttcctgtaccgtttctctgtcctaccaagtctggctcgtcacgcccacccgtggcctacgtccaccggtacctcccgaggtaccgtggggaccgacggccctaatttatacgtcggaccggactagtgggtaattacggaggttgaggttggttcggggtcgtttcggggacgggaacgggtaccgaggtcgtggagtccggttcggtacggtaccgacggtcccgaaggtcccg

SEQ ID NO: 23908 - DNA, 619 bp, Homo sapiens
  misc_feature: GYAE6OF02FS97I.9.22.B11.1.454.CMB.1.raw
tcagtgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgcggccccaggacagagggtcaccatctcctgctctggaaacctcaccaacattgagagctaattatgtttcctggtaccagcagcctcccaaggaacgacgacccccaaactcctacatctaatggtaataagtaactccggccctcgacggggtcccctaggaccgtattcctcgtcggacctccgaacgtcgtcggcctacccgtcacgtccctccccgtggacccattccacgttcggggtccttcgacgggtctaggacgggtatgggaggtccttagtaatttaacttacgtcggtaccctaaccgttcccgtaagtcgaaccgtacgccgacgtccgtaggaacggtaaggtttggttacgggttaagttccggggacgggtaccgggaaccgtaacggcgtaccggtaccgttacccgg

SEQ ID NO: 23909 - DNA, 685 bp, Homo sapiens
  misc_feature: GYAE6OF02FXS03.9.22.B11.1.454.CMB.1.raw
tcagtgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgccgccccaggacagaggtcaccatctcctgctcgtagaacctcaccaacattgagagactaattattcgtttcctggtaccagcacgcctacccgaggaacgaccgacccccaaactccctacacttctactcgaactaatacgaaactaaaccgtaccctaggaacggtacctttcctacgttacccgtttctacgtcgtccctaccgtacgtccgtcggtcctccgtaccgacgcccctacccgtcggacccacttacccgaacccggtacctcccgaaggtacccggttggggaacccgacggtaccccttaagtttaaccgttaccgtacgggaaccggaactaagggttcgggtaaactttaccggtaagggttggtaacggttggggtttcggggttaccgtttcggggacgggtaccggggtaaccggacggtccgtaggacgtcccggtacgtacggttaccgacggtacccggtaggtccccg

SEQ ID NO: 23910 - DNA, 625 bp, Homo sapiens
  misc_feature: GYAE6OF02GHHY1.9.22.B11.1.454.CMB.1.raw
tcagtgatacgtctcacgaccggtgctcgatttagacgacagctcagggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgccggccccaggacagagggtcaccatctcctgctctggaaacctcaccaacattgagagcaattatcgtttcctaggtaccagcagcctccaggaacgacgacccccaaactcctacactctatacgaacaatgaataaaccgaccctacgaacgggtacttcctcgtaccgttttctcgtcgtccctacctaagttccgtcggtcctcgtacacgccctacccgtcggaccactccgacccgtacctccgagtacggacggggaaccgacgaccctaatttacgttacgtcggtaccgaactagtacggtaagttacgtaggttagtaggtacgggtttcggggtcgtttcgggaccgggtaaggggtacccgagggccgtaggacgtaccggttaccgttacgggtccacggaccccggtaggtccccg

SEQ ID NO: 23911 - DNA, 915 bp, Homo sapiens
  misc_feature: GYAE6OF02J3NX4.9.22.B11.1.454.CMB.1.raw
tcagtgatacgtctcacgaccggtgctcgatttagacgacagctcaggggagctctgcttcagctgtgagcgcagaaggcaggactcggacaatcttcatcatcgacctcgcctccctctcctcctctacccttctcacttcactcgccacgcgggtcctcggccctagtctggtaggtacgaccgcgacgcccgtacccttgacggtcgttccgtacggcccgggaccccgaggtaccgacgggtacgggttaccaaccgtacttccgtaccgtacggtccttaccgtacggtaaacccttaccgaaacccgttaactacgtttaggaacgtaccggtaacctttaaaaccgtttgtttcccgggttttacccgttaacggtaaacccgtccgtaccgtaccgaccccgttaacccggaaaacggggttaacccgaaccccgttaacccccctaaaaaccgttttcccgaaacctaccgtttactaaaccgtacgggtaaacctaaacgtaaccgggtaaaacctaaaccccggtcccgtaccggggtaaaccgggttcttttaccccggtaacccggtttaccggtttttacccgtaccgttaacccgtaacccgttaacgggttaaccgttccggttaccggtacccgtaccggtacccgtacccgtaccccgtacccggtaccgtacccgtaccggtacccggtaacccggtaaccgtaccggtaaccgggtaccggtaccggtaccgttaccgtaacgtacgttacgacgtacgaacgtacgtaggtacgtacgttcggtaggttcgtagggttcggtacgggtcgtacgggacggtacggtcggacgttaccggtacggtaccggtacgttaccggaccggtaccgtacccgggtacggtccgtcccgg

SEQ ID NO: 23912 - DNA, 801 bp, Homo sapiens
  misc_feature: GYAE6OF02GBH8E.9.22.B11.1.454.CMB.1.raw
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
tcagtgatacgtctcacgaccggtgctcgatttagacgacagctcaggggagctctgcttcagctgtgagcgcagaaggcaggactcgggacaatctcatcatgacctgcctcccctctccctcctcacccttctcattcactgcacagggtcctggcccagtctggtggtcgacgcacgccgaccctgagtgtctcgccggcccaggacaggnggtccacctatctccgtncctcgtagaaccctcacctactatgagagactaattcttcgttcctaggtaccagtaccgtacgtaccgtacccggaagggtaaaccgacccgtaaccccctaaaccgttcctacctacgttactaattacgaactaagtacgtaaacctaaaccgaccctacggtaacgggtacctttaccgtacgttaacccgtttctacgttaccggtcccttacgtaccggttccgtacggtccgttacccggtacgaccccgtaaccccgtccccggtaccggtaaccctaaccggtaccccggtaacccggtaccgtaaccccggtaaccggtaccggggtacggggtaaccccggaccgtacccgttaaacggttttaaccttacggacgggtaaccggtaacggttaacggtaccgggttagtttaaccgggtaaggttagtcggggttagggtttccgggggtttacggttaccggggagggttaacccggggaacttccgggtacggttacggtaacggttcccgggtacgttacggggttaccacccgggtaccggacgggtaccccg

SEQ ID NO: 23913 - DNA, 729 bp, Homo sapiens
  misc_feature: GYAE6OF02GMFUC.9.22.B11.1.454.CMB.1.raw
tcagtgatacgtctcacgaccggtgctcgatttagacgacagctcagggggagctctgcttcagctgtgagcgcagaaggcaggactcggggacaatcttcatcatgacctgctcccctctcctcctcacccttctcattcactgcacagggtcctgggcccagtctgtggtgacgcacgccgccctcagtcgtctggccggccccaggacaggacgggtcaccatctcctgcctcgtacgtaacctccaaccaacattcgagagactaattattcgtttccgtggtaccagtcacgccgtacccgaggaacggaccacccccaaacgttccctacgactcctatacgtaactaacgtagtaaacctaaacccgtacccctacggtaacggttaccttacccgtacggttaacccgttttctccgtccgtacccttaccgtaacgttcgtcggtccgtcgtacctaccgccctacccggtacgtacctacgaccgaacccgtccctaccggacggtaacgggtccggggtaccgaaccggtccttaattaccgtacgtaccggacggtacagggttacggtaacgttacggtacgggtttgtaacggggttcgggttacggggttaccgttaccgggggacgggtaacggggtaacccggtaggtcggttacggtaccgggtacgtacccggttaacgggccgtacccggacccggtaacggtccccgg

SEQ ID NO: 23914 - DNA, 313 bp, Homo sapiens
  misc_feature: GYAE6OF02I5QOI.9.22.B11.1.454.CMB.1.raw
  modified_base (287)..(313): a, c, t, g, unknown or other
  misc_feature (287)..(313): n is a, c, g, or t
tcagtgatacgtctcacgaccggtgctcgatttagacgacagctcagggattcctgaccgtttctctgcctccaagtctggctcgtcagccaccctggccatcaccggactccagactggggacaggcccattatactgcggaacatgggattacaggttgagtgttggggctttcggcggagggaccgagctgagcgtcctaggtcagcccaaggctgccccctggtcactctgttccccacccctctcagaccgtatcactgagcggggctggcaaggcgcatgnnnnnnnnnnnnnnnnnnnnnnnnnnn

SEQ ID NO: 23915 - DNA, 903 bp, Homo sapiens
  misc_feature: GYAE6OF02H9LBI.9.22.B11.1.454.CMB.1.raw
tcagtgatacgtctcacgaccggtgctcgatttagacgacagctcaggggagctctgcttcagctgtgagcgcagaaggcaggactcgggacaatcttcatcatgacctgctcccctctcctcctccacccttctctattcactgcacgacggtcctgggcccagtctggtggtgacgcagccgccctcagtgtctgccggcccaggacaggacgggtcaccatctcctgtctacgtcggaacctcacctaacattgagtagactaattatgtttactcggtacctagcagccttaccgaagggaacgtaccgacccccaaacgttccactacttaccgtaatacgtaactaaacgtcgaaaccggtaaaaaccgtaccccgttacgtaaacggggtaaccttttacccgtaacggttacccgtttttacgtaccccgttacgtacccccttaaacccgttaacggttacccgtttcggggttacccgttacgggtttaccgtaaccccgggtacccctaaacccccggggttccgtacccgtaaaccgttaccccggaaaccccgggttaccgtacccgtaacgggtaacccgggtttacggggaaacccgggttaacgggtacccccgtaaagttttaaaccggttacggtaccgggtaaaccggtaaaccgtaggttaaacgggttaccgttaaaccgggttaaacgggttacggttaaacgggttttacggggtacggggtttccccgttttacggggggtaacccgggttaaccgggggtaaaaccccgggttggtaacccggtttaccgggaacccgggtttacccggtttaaccgggttaccggggttaccccgtaaaccggggtccccccgggttaaagggttaccccccccggg

SEQ ID NO: 23916 - DNA, 749 bp, Homo sapiens
  misc_feature: GYAE6OF02G97DT.9.22.B11.1.454.CMB.1.raw
tcagtgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacgagggtcctgggcccagtcgtgtggtgacgcagcccgccctcagtgtctcgccggaccccaggacaggacgggtccaaccactcctccgtgccttcgtacggtaaacctccaacctaacgtagttaggaacgtacgaacctaagtttacgttcggttttacccgtacggttaaccgacgtacctacggtccctacccggtaagggtaaccgacccgaacccccctaaaacgttcccctacgtaacttctaagtacgaacctaatacgaactaaaccggtccctacgtaacgggtaccttccgtacgttacccgtttcgtacgtccgtaccctacgtacgttcgtcggtaccgtccgtaccgaccgtacccgtacccgttcggaccctacgtcccgaaccgtacccgtacgtacggtacggtccggggaaccgacgtaccgtattacgtaccgtaggaccgtagacgttaggtacttacggtacggttcgtaaggtttcgggttacgggtacccgtttacggggacgggtaacgggtaccgacggtccgtacggtacgtccggttacggtaccggtaccggtacggtacccggacggttccccg

SEQ ID NO: 23917 - DNA, 850 bp, Homo sapiens
  misc_feature: GYAE6OF02FU5WW.9.22.B11.1.454.CMB.1.raw
  modified_base (193)..(193): a, c, t, g, unknown or other
  misc_feature (193)..(193): n is a, c, g, or t
tcagtgatacgtctcacgaccggtgctcgatttagacgacagctcaggggagctctgcttcagctgtgagcgcaagaaggcaggactcgggacaatcttcatcatgacctgcctcccctctcctcctcacccttctcattcactgccacgagggtcctcggcccagtctggtggtcgacgcacgcccgccctnagtgtctcggccggccccgaagggaccacgggacgggtacccaacctacttccgtcctggtaccttcccggtaaccggaaaaccccttccaaaccctaaaactcgtttacgaacggtaacgtacttaaacgttttagttaccgtttttaccgtacggttaacccacggtcctaacgtcccttaccccggaaaggaaccgtacccgaacccccctaaaccgttcccctactaacgtttacctaacgtcgaaacgttaagtaacgaaaacgttaaaccccggaacccgtacgtaacggggttaccctttaccgtaccggttaaccccgttttcctccgttacccgaccccgttaccgaacgtttcccgtccggcccgttaccggttacccaccggtccccctacccggtccggcctaaccgtacccgacccgacccgtcgtaaccggtacggtaaccggggtaccgaaccgggtaccttaacgtttaccgttaccgaggtaacccggagtacggtacggtttaaacgtagttacggttaggttacgggttgggtttaccggggtcgttaccggggtaccgggtaacggggtcccgaaggtccgtaacgggaccgttcgggtaccgttacggaccgtaccggtaccgtacggtcccccgg

SEQ ID NO: 23918 - DNA, 781 bp, Homo sapiens
  misc_feature: GYAE6OF02FUYAJ.9.22.B11.1.454.CMB.1.raw
  modified_base (200)..(200): a, c, t, g, unknown or other
  misc_feature (200)..(200): n is a, c, g, or t
  modified_base (387)..(387): a, c, t, g, unknown or other
  misc_feature (387)..(387): n is a, c, g, or t
tcagtgatacgtctcacgaccggtgctcgatttagacgacagctcaggggagctctgcttcagctgtgagcgcagaaggcaggactcggacatcttcatcatgacctgctcccctctcctcctcacccttctcattccactgcacgagggtccgtgggccctagtcttggtggtcgaccgtcgacgcccgccctgaggtntcgtggccggccccaggtacgacggtagggtccaccattcctctggccttacgtacggaaacctcaaccaacgtattcggaagtaacgacttaatttagttcgtttaccgttacggtacccaggtccgaccgactacccgaagggtaaaccgcccgaacccctaacgtccctactacgttccttaanacggtaaacaaggttacgaaaccgttaaaccgtcccgtacgttaacgggtcctttacccgttaccgggttaaccgttttccttccgtaccgtaccctaactacggttcgtaccggcgtccttacccgacccgtacctacccgtacggtaccctactacccgacccggacctacgaccggttacggtaccgggaccgtacgggtaaccttaaggtttaccgtacgtaccggaacgtaacgggttacgtacgggttacgttaacgggtcgttagggtaacggtttcgggtacggggtttacggtacgggtaccggggtaacggttccgggtacggtcggtaacgttacgggcgttaacccggtacggtaccgtaccggtcccggtacgttccccgg

SEQ ID NO: 23919 - DNA, 134 bp, Homo sapiens
  misc_feature: GYAE6OF01DV89U.53.22.B11.1.454.CMB.1.raw
  modified_base (133)..(134): a, c, t, g, unknown or other
  misc_feature (133)..(134): n is a, c, g, or t
tcagcgcgtatacacacgaccggtgctcgatttagacgacagctcagggccggtgctcgatttagcgagacgcgcagggcacgaccggtgctcgatttagcagacgtctgagcgggctggcaaggcgcatagnn

SEQ ID NO: 23920 - DNA, 257 bp, Homo sapiens
  misc_feature: GYAE6OF02H3GH4.53.22.B11.1.454.CMB.1.raw
  modified_base (253)..(257): a, c, t, g, unknown or other
  misc_feature (253)..(257): n is a, c, g, or t
tcagcgcgtatacacacgaccggtgctcgatttagacgacagctcagggacaacggtcacattggccatcagtggagtccaggcagaggacgaggctgactattactgtcagtccgcagacagcagtggcagttatgtcgtattcggcggagggactacgctgaccgtcctaggtcagcccaaggctgccccctcggtcactctgttcccacctcctctcgtactgcgctgagcggctggcaaggcgcatagnnnnn

SEQ ID NO: 23921 - DNA, 141 bp, Homo sapiens
  misc_feature: GYAE6OF02GC60P.53.22.B11.1.454.CMB.1.raw
  modified_base (138)..(141): a, c, t, g, unknown or other
  misc_feature (138)..(141): n is a, c, g, or t
tcagcgcgtatacacacgaccggtgctcgatttagacgacagctcagggcacgaccggtgctcgatttagacgacagctcagggcacgaccggtgctcgatttagcagacgtctgagcgggctggcaaggcgcatagnnnn

SEQ ID NO: 23922 - DNA, 305 bp, Homo sapiens
  misc_feature: GYAE6OF02GQ8MN.53.22.B11.1.454.CMB.1.raw
  modified_base (272)..(305): a, c, t, g, unknown or other
  misc_feature (272)..(305): n is a, c, g, or t
tcagcgcgtatacacacgaccggtgctcgatttagacgacagctcagggacaacggtcacattggccatcagtggagtccaggcagaggacgaggctgactattattgtcaatcaacagacaccattggtacttatgtcttcggaactgcgaccaaggtcaccgtcctgggtcagcccaaaggcccaaaccccgactgtccaacttctcgttccccaccctcctctcgtactgcgctgacgcgggctggacgaaggcgacatagctgcatgnnnnnnnnnnnnnnnnnnnnnnnnnnnnnnnnnn

SEQ ID NO: 23923 - DNA, 261 bp, Homo sapiens
  misc_feature: GYAE6OF02FOPJD.53.22.B11.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (254)..(261): a, c, t, g, unknown or other
  misc_feature (254)..(261): n is a, c, g, or t
tcagcgcgtatacacacgaccggtgctcgatttagacgacagctcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcacctctgttcccgccctcctctcgtactgcnctgagcgggctggcaaggcncatagnnnnnnnn

SEQ ID NO: 23924 - DNA, 302 bp, Homo sapiens
  misc_feature: GYAE6OF01DL77S.21.22.B11.1.454.CMB.1.raw
  modified_base (298)..(302): a, c, t, g, unknown or other
  misc_feature (298)..(302): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttccccgcctcctcctcgtctctactgagcggctggcaaggcgcatagnnnnn

SEQ ID NO: 23925 - DNA, 302 bp, Homo sapiens
  misc_feature: GYAE6OF01CT6NF.21.22.B11.1.454.CMB.1.raw
  modified_base (298)..(302): a, c, t, g, unknown or other
  misc_feature (298)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccacctcctcctcgtctctactgagcgggctggcaaggcgcatagnnnnn

SEQ ID NO: 23926 - DNA, 298 bp, Homo sapiens
  misc_feature: GYAE6OF01B1X9F.21.22.B11.1.454.CMB.1.raw
  modified_base (295)..(298): a, c, t, g, unknown or other
  misc_feature (295)..(298): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctggtcactctgttcccacctcctcctcgtctctactgagcggctggcaaggcgcatagnnnn

SEQ ID NO: 23927 - DNA, 353 bp, Homo sapiens
  misc_feature: GYAE6OF01B7AW6.21.22.B11.1.454.CMB.1.raw
  modified_base (197)..(197): a, c, t, g, unknown or other
  misc_feature (197)..(197): n is a, c, g, or t
  modified_base (312)..(312): a, c, t, g, unknown or other
  misc_feature (312)..(312): n is a, c, g, or t
  modified_base (314)..(353): a, c, t, g, unknown or other
  misc_feature (314)..(353): n is a, c, g, or t
tcagtcgtcgctcgcacgaccggtgctcgatttagacgacagctcgaggggtcccggtgaccgattctctggctccaagtctggcacctcacgcctccctgaccagtcagtgggctccggtccgaggatcgaggctgactagttactgtggccagtccacgggacgcaacatgggatgacaatctgagcggttgggngttcggcggagggaccaaactgaccgtcctaggtcagcccaaggctcgccccctaggtcactctgttcccgcctcctctagtctctactgacgcggcctggcaaggcgcatagcncnnnnnnnnnnnnnnnnnnnnnnnnnnnnnnnnnnnnnnnn

SEQ ID NO: 23928 - DNA, 301 bp, Homo sapiens
  misc_feature: GYAE6OF01D6POK.21.22.B11.1.454.CMB.1.raw
  modified_base (297)..(300): a, c, t, g, unknown or other
  misc_feature (297)..(300): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccacctcctcctcgtctctactgagcgggctggcaaggcgcatagnnnnc

SEQ ID NO: 23929 - DNA, 304 bp, Homo sapiens
  misc_feature: GYAE6OF01CMZ90.21.22.B11.1.454.CMB.1.raw
  modified_base (299)..(304): a, c, t, g, unknown or other
  misc_feature (299)..(304): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcagcccaaggctcgcccctcggtcactctcgttcccgccctcctcctcgtctctactgagcgggctggcaaggcgcatagnnnnnn

SEQ ID NO: 23930 - DNA, 303 bp, Homo sapiens
  misc_feature: GYAE6OF01BNFST.21.22.B11.1.454.CMB.1.raw
  modified_base (298)..(303): a, c, t, g, unknown or other
  misc_feature (298)..(303): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccaccctcctcctcgtctctactgagcgggctggcaaggcgcatagnnnnnn

SEQ ID NO: 23931 - DNA, 497 bp, Homo sapiens
  misc_feature: GYAE6OF01DNZV2.21.22.B11.1.454.CMB.1.raw
  modified_base (336)..(336): a, c, t, g, unknown or other
  misc_feature (336)..(336): n is a, c, g, or t
  modified_base (486)..(497): a, c, t, g, unknown or other
  misc_feature (486)..(497): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaatcctcatccagaggaataatcagcggccctcaggggtccctgaccgattctctggctccaagtctggcacctcagcctccctgaccatcagtgggctccggtcgaggatgaggctgactattactgtgcatcgacgggacncaacatgggatgaacaatctgagcggttgggtgttcggcggagggaccaaagtcgaccgtctagggtcagcccaaggctcgcccctggtcactctcgttcccgccctcctcctcgtctctactgacgcgggctggcaaggccgcagtagnnnnnnnnnnnn

SEQ ID NO: 23932 - DNA, 647 bp, Homo sapiens
  misc_feature: GYAE6OF01BCOU5.21.22.B11.1.454.CMB.1.raw
  modified_base (205)..(205): a, c, t, g, unknown or other
  misc_feature (205)..(205): n is a, c, g, or t
  modified_base (371)..(371): a, c, t, g, unknown or other
  misc_feature (371)..(371): n is a, c, g, or t
tcagtcgtcgctcgcacgaccggtgctcgatttagacgacagctcagggggaagctcagcttcagctttggtagagaagacaggactcaggacaatctccagcatggccggcttccctctcctcctcaccctcctcactcactgcgcagggtcctgggcccagtctgtgctgactcagtcaccctcagcgtctgggacccccggnagagggtcaccatctcttgttctggagcaactccaacatcggaataatatgtattctggtatcagcaactcccaggaatggcccccaaactcctcatccagaggaataatcagcggccctcgacggggtccctgaccgattctctggctccaagtctggcaccctnacgtccctccgtcgaccctatcgacgggtcgggtcccgttccgggtaccgagggtacgtcgggtacggtcgtacgtaacttagtttaccgtggtcgactacgtaccggaccggggacctaccaacgtaggtacgggaatcgaaactaacgttcgtaggtaacgggttcggggtttaggggttcgggttacccgggggacggggtaaacgggtaaacccctaaaacgggttcccggtaaccccgggttcccggttaaggggtccgtaaaccccgggg

SEQ ID NO: 23933 - DNA, 302 bp, Homo sapiens
  misc_feature: GYAE6OF01D9BU1.21.22.B11.1.454.CMB.1.raw
  modified_base (299)..(302): a, c, t, g, unknown or other
  misc_feature (299)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccaccctcctcctcgtctctactgagcgggctggcaaggcgcatagnnnn

SEQ ID NO: 23934 - DNA, 301 bp, Homo sapiens
  misc_feature: GYAE6OF01BF0CI.21.22.B11.1.454.CMB.1.raw
  modified_base (297)..(301): a, c, t, g, unknown or other
  misc_feature (297)..(301): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgccctcctcctcgtctctactgagcggctggcaaggcgcatagnnnnn

SEQ ID NO: 23935 - DNA, 491 bp, Homo sapiens
  misc_feature: GYAE6OF01AWR9R.21.22.B11.1.454.CMB.1.raw
  modified_base (356)..(356): a, c, t, g, unknown or other
  misc_feature (356)..(356): n is a, c, g, or t
  modified_base (479)..(491): a, c, t, g, unknown or other
  misc_feature (479)..(491): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctcaggggtccctgaccgattctctggctccaagtctggcacctcagcctccctgaccatcagtggctccggtccgaggatgaggctgactattactgtgcatcacgggacgcaacatgggatggacaatcngagcggttgggtgttcgggcggagggaccaactgaccgtcctaggtcagcccaaggctcgcccctcggtccactctcgttcccaccctcctcctctctctctgcgcggctggcagcgcagtgnnnnnnnnnnnnn

SEQ ID NO: 23936 - DNA, 329 bp, Homo sapiens
  misc_feature: GYAE6OF01A1DGK.21.22.B11.1.454.CMB.1.raw
  modified_base (297)..(297): a, c, t, g, unknown or other
  misc_feature (297)..(297): n is a, c, g, or t
  modified_base (303)..(329): a, c, t, g, unknown or other
  misc_feature (303)..(329): n is a, c, g, or t
tcagtcgtcgctcgcacgaccggtgctcgatttagacgacagctcaggggtacccgtggaccgattctctggctccaaggtctggcacctcagcctccctgacccatcagtcgggcctccggtccgaggatgaggctgactattactgtgcatcacgggacgcaacatgggatgacaatctggagccggttgggtgtcggcggaggaccaaactgaccgtctaggtcagcccaaggctgcccctggtcactctgtcccgcctctcctcgtctctactgagccggctcggcaaggtcncatagnnnnnnnnnnnnnnnnnnnnnnnnnnn

SEQ ID NO: 23937 - DNA, 304 bp, Homo sapiens
  misc_feature: GYAE6OF01BCY3M.21.22.B11.1.454.CMB.1.raw
  modified_base (300)..(304): a, c, t, g, unknown or other
  misc_feature (300)..(304): n is a, c, g, or t
tcagtcgtcgctcgcacgaccggtgctcgatttagacgacagctcaggggtccctgaccgattctctggactccaagtctggcacctcagcctccctgaccatcgagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccacctcctcctcgtctctactgagcgggctggcaaggcgcatagnnnnn

SEQ ID NO: 23938 - DNA, 323 bp, Homo sapiens
  misc_feature: GYAE6OF01AHGZ0.21.22.B11.1.454.CMB.1.raw
  modified_base (301)..(323): a, c, t, g, unknown or other
  misc_feature (301)..(323): n is a, c, g, or t
tcagtcgtcgctcgcacgaccggtgctcgatttagacgacagctcagggtccctgaccgagttctctggctccaagtctggcacctcagcctccctgaccatcagtgggctccggtccgaggatgaggctggactattactgtgcatcacgggacgcaacatgggatgacaatctgagtcggttgggtgttcgggcggagggaccaaactgaccgtcctaggtcagcccaaggctgccccctggtcactctgttcccaccctctccgagcgacgactgagcggctggctaaggcgcatagnnnnnnnnnnnnnnnnnnnnnnn

SEQ ID NO: 23939 - DNA, 488 bp, Homo sapiens
  misc_feature: GYAE6OF01BCTCG.21.22.B11.1.454.CMB.1.raw
  modified_base (336)..(336): a, c, t, g, unknown or other
  misc_feature (336)..(336): n is a, c, g, or t
  modified_base (479)..(488): a, c, t, g, unknown or other
  misc_feature (479)..(488): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtggctccggtccgaggatgaggctgactattactgtgcatcacgggacncaacatgggatgacaatctgagcggttggtgttcgggcggagggaccaactgaccgtctaggtcagcccaaggctcgccccctcggtcactctcgttcccgccctcctcctcgtctctactgagcggctggcaggcgcagtgnnnnnnnnnn

SEQ ID NO: 23940 - DNA, 493 bp, Homo sapiens
  misc_feature: GYAE6OF01CE6HD.21.22.B11.1.454.CMB.1.raw
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
  modified_base (480)..(480): a, c, t, g, unknown or other
  misc_feature (480)..(480): n is a, c, g, or t
  modified_base (484)..(493): a, c, t, g, unknown or other
  misc_feature (484)..(493): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcgacgggacgcaacatgggatgacaatctgagcgggttggtgttcgggcggagggaccaaacgtcgaccgtcgtaggtcagcccaaggctcgccccctcggtcactctcgtcccnccctcctcctcgtctctcngcgcggctggcaggcgnatgnnnnnnnnnn

SEQ ID NO: 23941 - DNA, 329 bp, Homo sapiens
  misc_feature: GYAE6OF01B1CKM.21.22.B11.1.454.CMB.1.raw
  modified_base (307)..(329): a, c, t, g, unknown or other
  misc_feature (307)..(329): n is a, c, g, or t
tcagtcgtcgctcgcacgaccggtgctcgatttagacgacagctcaggggtccctgaccgattctctggctccaagtctggcacctcagcctccctgaccatcagtgggctccgtcgaggatgagctggactattactgtgcatcacgggacgcaacatgggatgacaatctgagcggttgggtgttcggcggaggaccaaactgaccgtctaggtcagacccaaggcctcgcccccgtcggtcactctcgttccccgcctcctcctacgtctcgtactcgagcgggctcggcaacggcgcataggnnnnnnnnnnnnnnnnnnnnnnn

SEQ ID NO: 23942 - DNA, 509 bp, Homo sapiens
  misc_feature: GYAE6OF01BWGT1.21.22.B11.1.454.CMB.1.raw
  modified_base (206)..(206): a, c, t, g, unknown or other
  misc_feature (206)..(206): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagtcgtcgctcgcacgaccggtgctcgatttagacgacagctcagggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctcctgaccatcagtggctccggtcgaggatgaggctgactattacngtgcatcacggggacncaacngtgggatggaacatctgagcggttgggtgttcggcggagggacccaaagtggacccgtctaggtc

SEQ ID NO: 23943 - DNA, 609 bp, Homo sapiens
  misc_feature: GYAE6OF01CZI9S.21.22.B11.1.454.CMB.1.raw
  modified_base (357)..(357): a, c, t, g, unknown or other
  misc_feature (357)..(357): n is a, c, g, or t
  modified_base (597)..(609): a, c, t, g, unknown or other
  misc_feature (597)..(609): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggcccctcgacgggtccctgaccgtattcctcgtggcctaccgaagttctcggccaccctcacgccctccctgaccatcaggtcggcctcccgggtccgaggatggaggctgactattactgtgctatcgacggacncaacagtgggatgaactaatcagagtcgggttggtggttcgggcggtacggggaacctaaacgtcgtaacccgttccgtaacgggtcgacgaccccgaaaggtcctacccggcccccgttcgggtaccaccgttccgtttccggttccccccggtccccttcccttccccgttccggttcccttcccgttacgttcggacggccgggtcgtcgggacgtaacgggccgcgtaagtacggnnnnnnnnnnnnn

SEQ ID NO: 23944 - DNA, 307 bp, Homo sapiens
  misc_feature: GYAE6OF01EYTDE.21.22.B11.1.454.CMB.1.raw
  modified_base (303)..(307): a, c, t, g, unknown or other
  misc_feature (303)..(307): n is a, c, g, or t
tcagtcgtcgctcgcacgaccggtgctcgatttagacgacagctcagggtccctgaccgagttctctggctccaagtctggcacctcagcctcctgaccatcagtgggtctccggtccgaggatgaggctgactattactgtgcatcacgggacgtcaacgagtgggatgacaatctagagcggttgggtgttcggcggaggaccaactgaccgtcctaggtcacgcccaaggctgcccctggtcactctcgttcccaccctccgtcctcgtctctactgagcgggctggcaaggcgcatagnnnnn

SEQ ID NO: 23945 - DNA, 302 bp, Homo sapiens
  misc_feature: GYAE6OF01D7B4D.21.22.B11.1.454.CMB.1.raw
  modified_base (298)..(302): a, c, t, g, unknown or other
  misc_feature (298)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgcctcctcctcgtctctactgagcgggctggcaaggcgcatagnnnnn

SEQ ID NO: 23946 - DNA, 505 bp, Homo sapiens
  misc_feature: GYAE6OF01D4MHS.21.22.B11.1.454.CMB.1.raw
  modified_base (206)..(206): a, c, t, g, unknown or other
  misc_feature (206)..(206): n is a, c, g, or t
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
  modified_base (478)..(478): a, c, t, g, unknown or other
  misc_feature (478)..(478): n is a, c, g, or t
tcagtcgtcgctcgcacgaccggtgctcgatttagacgacagctcaggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtcgaggatgaggctgactattacngtgcatcgacgggacncaacatgggatgacatctgagtcggttggtgttcgggngagggaccaaacgtgacccgtctggtc

SEQ ID NO: 23947 - DNA, 331 bp, Homo sapiens
  misc_feature: GYAE6OF01ESMIC.21.22.B11.1.454.CMB.1.raw
  modified_base (308)..(311): a, c, t, g, unknown or other
  misc_feature (308)..(311): n is a, c, g, or t
  modified_base (313)..(331): a, c, t, g, unknown or other
  misc_feature (313)..(331): n is a, c, g, or t
tcagtcgtcgctcgcacgaccggtgctcgatttagacgacagctcgaggggtcccggtgaccgattctctggctccaagtctggcacctcagcctccctgaccatcagtgggctccggtccgaggatgaggctgactattactgtgcatcacgggacgcaacatgggatgacaatctgagtcggttggtgttcggcggagggaccaaacgtcgaccgtctaggtcagcccgaaggctcgcccctggtcactctcgttcccgtccttctacctcgtacgtctactgacgcggctggcaaggcgcatagnnnncnnnnnnnnnnnnnnnnnnn

SEQ ID NO: 23948 - DNA, 536 bp, Homo sapiens
  misc_feature: GYAE6OF01D7LY0.21.22.B11.1.454.CMB.1.raw
  modified_base (410)..(410): a, c, t, g, unknown or other
  misc_feature (410)..(410): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcatccagagaataatcagcggccctgacggggtccctgaccgattctctggcctccaagtctggcacctcacgcctccctgacccatcagtggctccggcgaggntgagctgactattactgtgcatccgacggggacncaacgngtgggatggaacatcgtggagtcgggtttgggtgttccgggcggaacggggtacccaaaacggtggaacccgttcgtagggtaccg

SEQ ID NO: 23949 - DNA, 303 bp, Homo sapiens
  misc_feature: GYAE6OF01ELHHM.21.22.B11.1.454.CMB.1.raw
  modified_base (299)..(303): a, c, t, g, unknown or other
  misc_feature (299)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgccctcctcctcgtctctactgagcgggctggcaaggcgcatagnnnnn

SEQ ID NO: 23950 - DNA, 336 bp, Homo sapiens
  misc_feature: GYAE6OF01CWCMW.21.22.B11.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (283)..(283): a, c, t, g, unknown or other
  misc_feature (283)..(283): n is a, c, g, or t
  modified_base (305)..(336): a, c, t, g, unknown or other
  misc_feature (305)..(336): n is a, c, g, or t
tcagtcgtcgctcgcacgaccggtgctcgatttagacgacagctcgacgggtccctcgaccggattcctctggcttccaagtctggcacctcagcctccctgaccatcagtgggctccggtccgaggatgaggctgactattacgttgtgcatctaacgggacgcaacatgggatgacaatctgagcggttgggngtcgnggaggaccaaactggacctcaggtcagccctaaggctgcccctcggtcacgtctgttcccgcctctcctcgtctcgtactgancgggctggcaaggcgcaagtgnnnnnnnnnnnnnnnnnnnnnnnnnnnnnnnn

SEQ ID NO: 23951 - DNA, 536 bp, Homo sapiens
  misc_feature: GYAE6OF01AC71K.21.22.B11.1.454.CMB.1.raw
  modified_base (208)..(208): a, c, t, g, unknown or other
  misc_feature (208)..(208): n is a, c, g, or t
  modified_base (399)..(399): a, c, t, g, unknown or other
  misc_feature (399)..(399): n is a, c, g, or t
  modified_base (427)..(427): a, c, t, g, unknown or other
  misc_feature (427)..(427): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgtctggagcaactcaacatcggaagtaattatgtattctggtatcagcaactcccaggaactcggacccccaaactcctcatccagaggaataactcagccggccctcgacggggtccctgaccgtattcctcgtggcctaccgaagtcctcggccacctcacgtccctcccngaccatcgaggtcggctccggtcgaggntgaggctagacttattactgtgcatcgacgggacncaacngtggatgactatcgtggagtcgggttggtcgtacgggcggaacggaccaacgtcgaccgtcgtaggtcg

SEQ ID NO: 23952 - DNA, 310 bp, Homo sapiens
  misc_feature: GYAE6OF01AENB7.21.22.B11.1.454.CMB.1.raw
  modified_base (292)..(292): a, c, t, g, unknown or other
  misc_feature (292)..(292): n is a, c, g, or t
  modified_base (298)..(310): a, c, t, g, unknown or other
  misc_feature (298)..(310): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctcgttcccgcctcctcctcgtctctactgagcggctggcaaggcncatagnnnnnnnnnnnnn

SEQ ID NO: 23953 - DNA, 512 bp, Homo sapiens
  misc_feature: GYAE6OF01BL6A1.21.22.B11.1.454.CMB.1.raw
  modified_base (343)..(343): a, c, t, g, unknown or other
  misc_feature (343)..(343): n is a, c, g, or t
  modified_base (480)..(480): a, c, t, g, unknown or other
  misc_feature (480)..(480): n is a, c, g, or t
  modified_base (500)..(512): a, c, t, g, unknown or other
  misc_feature (500)..(512): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcagggggtccctgacccgattctctggctccaagtctggcacctcagcctccctgaccatcagtgggctccggtccgaggatggaggctgacttattactgtgcatcgacgggacncaacagtggggatagaacaatcgtgaggtcgggtttgggtgttcgggcggagggacctagttcgaccgttcgttggtcacgcccgaaggctccgccccgtcggtccactctcgtcccaccctcctcctcgtctctcngcgcggctgcagcgcagtgnnnnnnnnnnnnn

SEQ ID NO: 23954 - DNA, 508 bp, Homo sapiens
  misc_feature: GYAE6OF01C5K8F.21.22.B11.1.454.CMB.1.raw
  modified_base (339)..(339): a, c, t, g, unknown or other
  misc_feature (339)..(339): n is a, c, g, or t
  modified_base (498)..(508): a, c, t, g, unknown or other
  misc_feature (498)..(508): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcacgcctccctgaccatcagtgggctccggtccgaggatgaggctgactattactgtgcatcacgggacncaacatgggatgaacaatctgagtcggttggtgttcgggcggagggaccaacgtcgaccgtccgtaggtcgacgccgaacggctcgcccccgtcggtccaccgtcctcgttccccaccctcctcctccgtctctctgcgcgggctggcacggcgcatgnnnnnnnnnnn

SEQ ID NO: 23955 - DNA, 546 bp, Homo sapiens
  misc_feature: GYAE6OF01ANY2L.21.22.B11.1.454.CMB.1.raw
  modified_base (418)..(418): a, c, t, g, unknown or other
  misc_feature (418)..(418): n is a, c, g, or t
  modified_base (452)..(452): a, c, t, g, unknown or other
  misc_feature (452)..(452): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgtctggaggcaactccaacatcggaagtaattatgtattctggtatcagcaactcccaggaatcggcccccaaactcctcatccagaggaataatcagccggccctcgacggggtccctgaccgtattactcgtggcctccaagtctggccacctcacgccctccctgaccatcagtcggctccggcgaggntggagctgactattactgtgcatcgaacgggtancaacgagtgggatgactaatcgaggacggtcgggtttgggtcggttcgggacgggacgggaaccctaaacgtggacccgttccgtagggtaccc

SEQ ID NO: 23956 - DNA, 304 bp, Homo sapiens
  misc_feature: GYAE6OF01CZWV1.21.22.B11.1.454.CMB.1.raw
  modified_base (298)..(304): a, c, t, g, unknown or other
  misc_feature (298)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctggtcactctcgttcccgcctcctcctcgtctctactgacgcgggctggcaggcgcatagnnnnnnn

SEQ ID NO: 23957 - DNA, 521 bp, Homo sapiens
  misc_feature: GYAE6OF01DUNWV.21.22.B11.1.454.CMB.1.raw
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
  modified_base (511)..(521): a, c, t, g, unknown or other
  misc_feature (511)..(521): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctcgaggggtccctgaccgattctctggctccaagtctggcacctcagcctccctgaccatcaggtgggcctccggtccgaggntggaggctgactattactgtgcatcgacgggacncaacagtgggatgacaatcgtggagtcgggttgggtcgttcgggcgggagggaccaacgtgaccgtcgtaggtcacgcccaaggcctcgccccgtcgtccactcctcgttcccgccctcctcctccgtctcctactcgacgccgggctcggcgacggccgacgagtcgnnnnnnnnnnn

SEQ ID NO: 23958 - DNA, 643 bp, Homo sapiens
  misc_feature: GYAE6OF01B40B0.21.22.B11.1.454.CMB.1.raw
  modified_base (626)..(626): a, c, t, g, unknown or other
  misc_feature (626)..(626): n is a, c, g, or t
  modified_base (630)..(630): a, c, t, g, unknown or other
  misc_feature (630)..(630): n is a, c, g, or t
  modified_base (634)..(635): a, c, t, g, unknown or other
  misc_feature (634)..(635): n is a, c, g, or t
  modified_base (637)..(643): a, c, t, g, unknown or other
  misc_feature (637)..(643): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagccgcctcgacggggtccctgaccgtattctcgtggcctaccaagtctggccacctcacgccctccctgaccatcgaggtcgggcctccggtccgaggatggagctgactatacgtgtcgcatcgaacgggacaacgaaaagtgggaatacggaactaagtcgtaggacggtcggggtttaggggtcggtttccgggacgggtaacgggaacccgtaacgtcggtaacccggttccgtaacgggtaccgacggacccgtaacgggtccctccggtccccccgtcgggttaccaccttcccgttccgttccccctaccccttccccttcccgttcccggttcccttaccgttaccgtcgggtaccggtccgggtccgtcgggaccgtaacgggccgacctaagtacggntagntcgnncnnnnnnn

SEQ ID NO: 23959 - DNA, 502 bp, Homo sapiens
  misc_feature: GYAE6OF01CS1K2.21.22.B11.1.454.CMB.1.raw
  modified_base (342)..(342): a, c, t, g, unknown or other
  misc_feature (342)..(342): n is a, c, g, or t
  modified_base (489)..(489): a, c, t, g, unknown or other
  misc_feature (489)..(489): n is a, c, g, or t
  modified_base (491)..(502): a, c, t, g, unknown or other
  misc_feature (491)..(502): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcggcaactcccaggaatggcccccaaactcctcatccagaggaataatcagcggccctcaggggtcccctgaccgattctctggctccaagtctggcacctcagcctccctgaccatcagtgggcctccggtccgaggatgaggctgactattactgtgcatcgacggggacncaacagtgggatgaacaatctgagcgggttgggtgttcggcggagggaccaaacgtgaccgtcctaggtcacgcccaaggcctcgcccctcggtcactctcgtccccgccctcctcctcgtctctactgagcgggctgcaggcgcangnnnnnnnnnnnn

SEQ ID NO: 23960 - DNA, 307 bp, Homo sapiens
  misc_feature: GYAE6OF01EJCTQ.21.22.B11.1.454.CMB.1.raw
  modified_base (299)..(307): a, c, t, g, unknown or other
  misc_feature (299)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggacccaaactgaccgtcctaggtcagcccaaggctcgcccctggtcactctcgtccaccctctctcgtctctactgagcggctggacaaggccgacatagnnnnnnnnn

SEQ ID NO: 23961 - DNA, 317 bp, Homo sapiens
  misc_feature: GYAE6OF01B2SUF.21.22.B11.1.454.CMB.1.raw
  modified_base (302)..(317): a, c, t, g, unknown or other
  misc_feature (302)..(317): n is a, c, g, or t
tcagtcgtcgctcgcacgaccggtgctcgatttagacgacagctcaggggtccctgaccgattctcctggctccaagtctggcacctcagcctccctgaccatcagtgggctccggtccgaggatgaggctgactattactgtgctatcacgggacgctaacatgggatgacaatctgagcggttgggtgttcggcggagggaccaaactgaccgtcctaggtcagcccaaggctcgccccctggtcactctcgttcccacctcctcctcgtctctactgagcggctggcaaggcgcatagnnnnnnnnnnnnnnnn

SEQ ID NO: 23962 - DNA, 304 bp, Homo sapiens
  misc_feature: GYAE6OF01DA974.21.22.B11.1.454.CMB.1.raw
  modified_base (299)..(304): a, c, t, g, unknown or other
  misc_feature (299)..(304): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgcccctcggtcactctcgttcccacctcctcctcgtctctactgagcgggctggcaaggcgcatagnnnnnn

SEQ ID NO: 23963 - DNA, 558 bp, Homo sapiens
  misc_feature: GYAE6OF01CI47Y.21.22.B11.1.454.CMB.1.raw
  modified_base (226)..(226): a, c, t, g, unknown or other
  misc_feature (226)..(226): n is a, c, g, or t
  modified_base (350)..(350): a, c, t, g, unknown or other
  misc_feature (350)..(350): n is a, c, g, or t
  modified_base (546)..(558): a, c, t, g, unknown or other
  misc_feature (546)..(558): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaatcctcatccagaggaataatcagcggccctnaggggtccctgaccgattctctggctaccaagtctggcacctcagccctccctgacccatcaggtgggcctccggtccgaggatggaggctgactattactgtgcatccgagggaccgacaaanagtggggaatgaacaatctaggagtcgggttgggtgttcgggacgggacgggacgaaacgtcgaccgtaccgtaggtcgacgcccgaaacggtcgtaccgcccccgtcggtaccacctccgttcgttccccgtcccctccctccctccgtcctcgtacctcgtacgccgggcgtcggcgaacggccgcgacgtagnnnnnnnnnnnnn

SEQ ID NO: 23964 - DNA, 307 bp, Homo sapiens
  misc_feature: GYAE6OF01EM939.21.22.B11.1.454.CMB.1.raw
  modified_base (299)..(307): a, c, t, g, unknown or other
  misc_feature (299)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctcgttcccgcctcctccgagcgacgactgagcgggctggcaaggcgcatagnnnnnnnnn

SEQ ID NO: 23965 - DNA, 302 bp, Homo sapiens
  misc_feature: GYAE6OF01DPBD5.21.22.B11.1.454.CMB.1.raw
  modified_base (298)..(302): a, c, t, g, unknown or other
  misc_feature (298)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccgcctcctcctcgtctctactgagcggctggcaaggcgcatagnnnnn

SEQ ID NO: 23966 - DNA, 687 bp, Homo sapiens
  misc_feature: GYAE6OF01DIVW8.21.22.B11.1.454.CMB.1.raw
  modified_base (208)..(208): a, c, t, g, unknown or other
  misc_feature (208)..(208): n is a, c, g, or t
  modified_base (378)..(378): a, c, t, g, unknown or other
  misc_feature (378)..(378): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagagggtcaccatctcttgttctggagcaactccaacatcggaagtaattatgttattctggtatcagcaaactcccgaaggaactcggaccccctaaactcctcactccaagaggaataatcagccgccctgacggggtccctgaccgtattctctggctaccaagtcnggccacctcacgccctccctagacctatcgaggtcgggccttcccggggtacgagggtactgggaacggccttaggtaacctttagttttacgcggttagaccgtaacgtccggaaaccggggaccgtaccaaaacgtcggttacgggggaacttacggaaaccgtaaagttccggtaacgggtaacggggttccggggggttttaggggttacgggtttacccgggggaccggggtaaacgggggtaaaaccccctaaaacgggtttcccggaaacccccgggtttccgttaaacgggggttaccccg

SEQ ID NO: 23967 - DNA, 561 bp, Homo sapiens
  misc_feature: GYAE6OF01B94U0.21.22.B11.1.454.CMB.1.raw
  modified_base (447)..(447): a, c, t, g, unknown or other
  misc_feature (447)..(447): n is a, c, g, or t
  modified_base (488)..(488): a, c, t, g, unknown or other
  misc_feature (488)..(488): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggcagagggtcaccatctcttgttctggaggcaactccaacatcggaagtaattatgtattctggtatcagcaactcccaggaatcggacccccaaactcctacatccagaggaataatcagccgccctgacggggtccctgaccgattctctcggcctacaagtctggccacctcacgcctccctgacccatcaggtcgggcctccgggtccgaggactggaggctgactattactgtnctatccgacgggacacgaacagtgggaatcgacaaattcgnggtacggtcgggtttggggtgttccgggacgggaacgggtaacctaaacgtcggtaaccgtccgtaggtaccg

SEQ ID NO: 23968 - DNA, 526 bp, Homo sapiens
  misc_feature: GYAE6OF01D2HGY.21.22.B11.1.454.CMB.1.raw
  modified_base (209)..(209): a, c, t, g, unknown or other
  misc_feature (209)..(209): n is a, c, g, or t
  modified_base (323)..(323): a, c, t, g, unknown or other
  misc_feature (323)..(323): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (488)..(488): a, c, t, g, unknown or other
  misc_feature (488)..(488): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactcccaggaactcggacccccaaatcctcatccagagaataancagcgccctgacggggtccctgaccgattctctggcctcaagtctggcacctcacgccctcctgaccatcaggtcggcctccggtcgaggatgaggctgacttagtactgtcgcagtccgacggggtacncaacngtgggatgactatcgtggagtgggttgggngttcgggcggacggaccaagcgtcgacccgtcgtacgg

SEQ ID NO: 23969 - DNA, 301 bp, Homo sapiens
  misc_feature: GYAE6OF01CPPQT.21.22.B11.1.454.CMB.1.raw
  modified_base (298)..(301): a, c, t, g, unknown or other
  misc_feature (298)..(301): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccgcctcctcctcgtctctactgagcgggctggcaaggcgcatagnnnn

SEQ ID NO: 23970 - DNA, 609 bp, Homo sapiens
  misc_feature: GYAE6OF01CX95M.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccgggnagagggtcaccatctcttgttctggaggcaactccaacatacggaagtaattatgtattctggtatcagcaactccaggaatcgaccccaactcctcactccagagaataatcacgccggccctcgacgggtccctgacccgtattcctcgtcggcctaccaagtctcggcctacctcacgtccctaccctcgacctatcgaggtcgggtcctccgggtaccgaggtactggagtcctaggtactttattacgtgtcgacctagtaccggaacggggtaccacaaacgtaggtagggaattcgaacagttcgtgggtacggtcggggtttgggggtcgttacggggaccgggtaacgggtaacccctaaagtcggtaaccccgtcgtacggtacccg

SEQ ID NO: 23971 - DNA, 593 bp, Homo sapiens
  misc_feature: GYAE6OF01BFNUB.21.22.B11.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (398)..(398): a, c, t, g, unknown or other
  misc_feature (398)..(398): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaanatcggaagtaattatgtattctggtatcagcaactcccaggaatcggacccccaaatcctacatccagagaatatcagccgcctcgacggggtccctgaccgtattctctcggcctaccgaagtctggcaccctcacgcctccctgacccntcgaggtcgggcctccgggtaccgaggactggaggcctaggtaccttatttaccgtgtgacctataccgacggggtaccactaaaccgtgtacgggattacgaacgtaattcgtaggacggtccgggtttgggtcggttcggggacgggaacgggtaacccaaacgtcggtaaaccccgttcgtaacgggtaccg

SEQ ID NO: 23972 - DNA, 788 bp, Homo sapiens
  misc_feature: GYAE6OF01BYA94.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagagggtcaccatctcttgttctggagcaactcaacatcggaagtaattatgtattctggtatcagcaactcccaggaatcggacccccaactcctcatccagagaatatcagcgccctgacggggtccctgaccgtattcctcgtcggccttacccgaaggttccgtcgggaccctaccccgttccgaacggtcccccttaccccgtacggaacccctacgttaccgaacggggttccggggacccgtttcccccgggggtacccggtaaggggtaacgttacggggaacgggtccttaacgggtaaacccttttaacgttttaacccggttggttacggacccttaacggttacccgggaaacccggggggtaccaacccgaaaaccgtaggttacgggggtaaacttacgggaaaccctaaagttacccgggttaggggtaacggggtttcccgggggttttaggggggttaccgggttttacccggggggaaccgggggttaaaccgggggtaaacccccttaaaacgggttcccgggtaaacccccggtttcgggttaaacccggggtacccgg

SEQ ID NO: 23973 - DNA, 839 bp, Homo sapiens
  misc_feature: GYAE6OF01CSTOJ.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcggggaccccggnaggagggtccaccattctcttgttcgtggaggccaactccaacatacggaagttaattatgttattcgttggtatcagcaactccaaggaactccggacccccaaactcctacactaccgaagaaggaaataactcgaacggccggtacccctcggtaaccgggggttccctacgaaccgttatttccgttcgtcgggtccttacccgtaaaggttccgtacgggaccctaacccgttaccgaccggtccccttaccccgttacggaaccctaacgttccggaacggggttcggggtaccccgttacccggggtaacccggaagggtaaccttcgggaaacgggttccgtaacgggttaaccttttaacgtttaccgttcgggtacggtaacctaacggttaccccgggaaaacgggggtacccgaaccgtaaaaaccgttagggttacgggggaaactttaacggaaaacccgtaaacgtttccggtaacggggtaaacgggtttaccgggggggttttcgggggttaccggggtttacccgggggaacggggtaaccgggggtaaaacccctaaaaccgggtttccgggtaaaccccggttaaccgggtttaacgggtaacccgg

SEQ ID NO: 23974 - DNA, 551 bp, Homo sapiens
  misc_feature: GYAE6OF01B8WOA.21.22.B11.1.454.CMB.1.raw
  modified_base (209)..(209): a, c, t, g, unknown or other
  misc_feature (209)..(209): n is a, c, g, or t
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
  modified_base (445)..(445): a, c, t, g, unknown or other
  misc_feature (445)..(445): n is a, c, g, or t
  modified_base (466)..(466): a, c, t, g, unknown or other
  misc_feature (466)..(466): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagagggtcaccatctcttgttctggagcaactccaacatcggaagtaattatgtattctggtatcagcaactcccaggaactcggacccccaaatcctcatccagagaataancagccgccctgacggggtccctagaacgtnttctcgtcggcctaccgaagtcctggccacctcacgccctccctgaccatcaggtcggcctccggcgaggactggacgctagacttatactgnccatccgacgggacacaacgngtgggaatcgaactaagttcgaggtaggtcgggttgggtcgttcgggaggaacggaacctaaacgtggacccgtcgtaggtaccg

SEQ ID NO: 23975 - DNA, 561 bp, Homo sapiens
  misc_feature: GYAE6OF01DTRMO.21.22.B11.1.454.CMB.1.raw
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (518)..(518): a, c, t, g, unknown or other
  misc_feature (518)..(518): n is a, c, g, or t
  modified_base (542)..(542): a, c, t, g, unknown or other
  misc_feature (542)..(542): n is a, c, g, or t
  modified_base (548)..(549): a, c, t, g, unknown or other
  misc_feature (548)..(549): n is a, c, g, or t
  modified_base (552)..(561): a, c, t, g, unknown or other
  misc_feature (552)..(561): n is a, c, g, or t
tcagtcgtcgctcgcacgaccggtgctcgatttagacgacagctcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatcggcccccaaatcctcatccagaggaataatcagccggccctgacggggtccctgaccgnttcnctcggctccgaagtctggccacctcacgccctccctgacccatcaggtcgggcctccgggtccgaggatggagctgacttattacgtgtgctagtccgaacgggcacaacgagtgggactgaacaagttcgtaggaggtcgggtttgggtcggttcgggacgggaacggaccaacgtcgaccgtcgtacggtcacgaccgacggccgtccgccccgtcgtctacgttcctccgttccccacccttccctcctccgtcctcgtaccgngcggtcggactcggacgacggccnacgtgnncgnnnnnnnnnn

SEQ ID NO: 23976 - DNA, 304 bp, Homo sapiens
  misc_feature: GYAE6OF01AMS59.21.22.B11.1.454.CMB.1.raw
  modified_base (300)..(304): a, c, t, g, unknown or other
  misc_feature (300)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttcccgccctcctcctcgtctctactgagcgggctggcaaggcgcatagnnnnn

SEQ ID NO: 23977 - DNA, 555 bp, Homo sapiens
  misc_feature: GYAE6OF01B1FPX.21.22.B11.1.454.CMB.1.raw
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggagcaactccaacatcggaagtaattatgtattctggtatcagcaactccaggaatcggacccccaaactcctcatccagagaataatcagcgccctgacggggtccctgaccgtattcctctcggctccaagtctggcacctcacgccctccctgaccatccaggtcgggcctcccgggtccgaggtatggaggtctgaccttattacgtgtgccatccgacgggacncaacngtgggatcgaactagtcgtaggcggtcgggttgggtcggttccgggagggacgggtaacctaacgtcggacccgtccgtagggtaccg

SEQ ID NO: 23978 - DNA, 306 bp, Homo sapiens
  misc_feature: GYAE6OF01B0U2B.21.22.B11.1.454.CMB.1.raw
  modified_base (300)..(306): a, c, t, g, unknown or other
  misc_feature (300)..(306): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctgttccccacctcctcctcgtctctactgagcgggctggcaaggcgcatagnnnnnnn

SEQ ID NO: 23979 - DNA, 646 bp, Homo sapiens
  misc_feature: GYAE6OF01BIP65.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcggggacccccggnagagggtcaccatctcttgttctggagcaactccaacatcggaataattatgtattctggtatcagcaactcccgaggaactcggacccccaaatccctacactccaagaagaaataactcacgccggtccctcgacggggttccctaggacccgtattccgtcgtcgggacctaccgaagttcctacggcctacccgttcgacgtccctccctagaccctatcgaggtcgggaccttccgggtaccgaggactggacggtctaggacttagttactggtcgactacgtccggaaccgggtacacaacgtggtacgggactaggaactacgttaccggtagggacggttcggggtttacgggttcgggttaccggggacgggtaaccgggtaacccaaacggttcccggtaacccggttccgtaacgggtacccg

SEQ ID NO: 23980 - DNA, 507 bp, Homo sapiens
  misc_feature: GYAE6OF01BELOH.21.22.B11.1.454.CMB.1.raw
  modified_base (209)..(209): a, c, t, g, unknown or other
  misc_feature (209)..(209): n is a, c, g, or t
  modified_base (412)..(412): a, c, t, g, unknown or other
  misc_feature (412)..(412): n is a, c, g, or t
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (464)..(464): a, c, t, g, unknown or other
  misc_feature (464)..(464): n is a, c, g, or t
  modified_base (481)..(481): a, c, t, g, unknown or other
  misc_feature (481)..(481): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctgggagcaactccaacatcggaagtaattatgtattctggtatcagcaactcccaggaatcggaccccaaactcctcatccagagaataatcagcgcctcagggtccctgaccgattctctggctccaagtctcggcacctcacgcctcctgaccatcagtcggctcggtcgagatgaggntgactattacngtcgcatcgacgggacncaacgntaggatgacaatcgtagngtacggttggtgtcggnggaggacaactgaccgtcgtagtccg

SEQ ID NO: 23981 - DNA, 570 bp, Homo sapiens
  misc_feature: GYAE6OF01CTJJN.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccgggcagagggtcaccatctcttgtctggaggcaactccaacatcggaagtaattatgtattctggtatcagcaactcccaggaatcggaccccaaactcctcatccagagaatatcagcgccctgacggggtccctgaccgtattctctggctccaagtctggcacctcagccctccctgaccatcgaggtcgggcctccgggtaccgaggactggacggtctcgaacttagttactgtcgctagtccgacgggacacaacgagtgggaatggactaagtctagggacggtcggggtttgggtcggttaccgggcggggaacgggtaacccgtaaacgttggaaccccgttccgtaagggtaccg

SEQ ID NO: 23982 - DNA, 300 bp, Homo sapiens
  misc_feature: GYAE6OF01BJ18C.21.22.B11.1.454.CMB.1.raw
  modified_base (294)..(300): a, c, t, g, unknown or other
  misc_feature (294)..(300): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctggtcactctgttcccacctcctcctcgtctcactgagcggctggcaaggcgcatagnnnnnnn

SEQ ID NO: 23983 - DNA, 546 bp, Homo sapiens
  misc_feature: GYAE6OF01C3BUQ.21.22.B11.1.454.CMB.1.raw
  modified_base (463)..(463): a, c, t, g, unknown or other
  misc_feature (463)..(463): n is a, c, g, or t
tcagtcgtcgctcgcacgaccggtgctcgatttagacgacagctcagggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactccccaggaatcggacccccaaactcctcatccagaggaatatcagcggccctcgacggggtccctgaccgtattctctggctccaagtctggcacctcacgccctccctgacccatcacggtggcctaccgggtccgaggactggaggtcctagaccttaattactgtgcagtccgacgggcncaactgtgggatgactaagtcgtgaggtcgggtttggtcggttcggcggacgggaccaaacgtggaacccttcgtaaggtccg

SEQ ID NO: 23984 - DNA, 299 bp, Homo sapiens
  misc_feature: GYAE6OF01D595C.21.22.B11.1.454.CMB.1.raw
  modified_base (296)..(299): a, c, t, g, unknown or other
  misc_feature (296)..(299): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgcctcctcctcgtctctactgagcggctggcaaggcgcatagnnnn

SEQ ID NO: 23985 - DNA, 561 bp, Homo sapiens
  misc_feature: GYAE6OF01EAA90.21.22.B11.1.454.CMB.1.raw
  modified_base (209)..(209): a, c, t, g, unknown or other
  misc_feature (209)..(209): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatacggaagtaattatgtattctggtatcagcaactcccaggaatcggacccccaaatcctcatccagagaataatcagccggccctgacggggtccctgaccgtattcctctggcctcaagtctggcacctcacgcctcctgaccatcagtcggcctccggtcgaggatgagctgacttattactgtgctagtcgacggggacacgaacngtagggatacgactaagttcgtagggacggtcggggtttagggtcggttaccggggacgggaacggggtacctaaaacggtcggaacccgtcgtaaggtcccg

SEQ ID NO: 23986 - DNA, 205 bp, Homo sapiens
  misc_feature: GYAE6OF01DWV22.21.22.B11.1.454.CMB.1.raw
  modified_base (198)..(205): a, c, t, g, unknown or other
  misc_feature (198)..(205): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcgggctggcaaggcgcatagnnnnnnnn

SEQ ID NO: 23987 - DNA, 577 bp, Homo sapiens
  misc_feature: GYAE6OF01BZAK7.21.22.B11.1.454.CMB.1.raw
  modified_base (358)..(358): a, c, t, g, unknown or other
  misc_feature (358)..(358): n is a, c, g, or t
  modified_base (463)..(463): a, c, t, g, unknown or other
  misc_feature (463)..(463): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggagcaactccaacatcggaagtaattatgtattctggtatcagcaactcccaggaatcggacccccaaatcctcatccagaggaataatcagccggccctcgacggggtccctgaccgtattccnctggcctccaagtctggcacctcacgccctccctgacccatcgaggtcgggcctcccgggtcgaggatggacgctgacttattactgtgcagtcgaccggggacncaacgagtgggatcgaactaatcgtaggacgtcgggggtttcgggtcggtttaccggggacgggtaacgggaaaccctaacggttccggaccccggtttccgtaagggtacccg

SEQ ID NO: 23988 - DNA, 604 bp, Homo sapiens
  misc_feature: GYAE6OF01CSDSL.21.22.B11.1.454.CMB.1.raw
  modified_base (208)..(208): a, c, t, g, unknown or other
  misc_feature (208)..(208): n is a, c, g, or t
  modified_base (486)..(486): a, c, t, g, unknown or other
  misc_feature (486)..(486): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagaggtcacatctcttgtctggagcaactcaacatcggaagtaattatgtattctggtatcagcaactccaggaatcggaccccaactcctcatccagaagaataatcagccggccctgacggggtccctagaccgtattcctcgtggcctaccaagtcctggccacctcacgtccctccctgaccactcgaggtcggccttcccggtcgaggtactggacggtctgtaaccttattactggttcgactacgttccggaaccggggacaccgaaacgngttagggacttacggaacctaagtcgtagggtacggtcggggtttgggtgggttacccgggagggtaacgggtaacccctaaacggttccggaaccggttcccggttaagggtacccg

SEQ ID NO: 23989 - DNA, 301 bp, Homo sapiens
  misc_feature: GYAE6OF01CN6MM.21.22.B11.1.454.CMB.1.raw
  modified_base (298)..(301): a, c, t, g, unknown or other
  misc_feature (298)..(301): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggaccaaactgaccgtcctaggtcagcccaaggctcgccccctggtcactctcgttcccacctcctcctcgtctctactgagcggctggcaaggcgcatagnnnn

SEQ ID NO: 23990 - DNA, 611 bp, Homo sapiens
  misc_feature: GYAE6OF01BQ8RY.21.22.B11.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
  modified_base (442)..(442): a, c, t, g, unknown or other
  misc_feature (442)..(442): n is a, c, g, or t
  modified_base (488)..(488): a, c, t, g, unknown or other
  misc_feature (488)..(488): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagaggtcaccatctcttgtctggagcaactccaantcggaagtaattatgtattctggtatcagcaactccgaggatcggacccccaaactcctanactccagaaggaataactcagccgccctcgacgggtctctgaccgtattcgtctggtcctaccgaagttcgtcggaccacctcgacgtccctccctagaccctagtcgaggttcgggcctacccgggtccgaaggtntggacgtctaggaactttattacgtgtcgctacgtcgacgggaccncgtaaacgaggtggaagtgaaaccgtaagttcgacggtaagggtcgggttttggggtcggttacccggggacgggtaacgggtaacccctaaaggttccggtaacccggttcccgtaacgggg

SEQ ID NO: 23991 - DNA, 527 bp, Homo sapiens
  misc_feature: GYAE6OF01DEPH6.21.22.B11.1.454.CMB.1.raw
  modified_base (452)..(452): a, c, t, g, unknown or other
  misc_feature (452)..(452): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactcaacatcggaagtaattatgtattctggtatcagcaactcccaggaatcggcccccaaactcctcatccagaggaaataatcagccggccctcgacggggtccctgaccgattctctggctcaagtctggcacctcagcctcctgaccatcagtcgggctccgggtacgaggactggacggctgacttattactgtcgcatcgacgggacncaacgagtgggatagacaatctgagtcgggttgggtcgtcggcgggaggacccaaagtgaccgtcgtaggtaccg

SEQ ID NO: 23992 - DNA, 525 bp, Homo sapiens
  misc_feature: GYAE6OF01EKIIR.21.22.B11.1.454.CMB.1.raw
  modified_base (207)..(207): a, c, t, g, unknown or other
  misc_feature (207)..(207): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctgtatcagcaactccaggaatcggaccccaactcctcatccagaggaataatcagcggccctcgaggggtccctgaccgattctctcgctccaagtctggcacctcacgccctcctgaccatcaggtcggctcccggtcgaggatggaggctgactattacngtncatccgacgggacacaacagtggatgaactatcgtgacggtgggttgggtggttcgggacggacgggaccaaacgtggaacccgtcgtaggtccg

SEQ ID NO: 23993 - DNA, 512 bp, Homo sapiens
  misc_feature: GYAE6OF01DS9OY.21.22.B11.1.454.CMB.1.raw
  modified_base (339)..(339): a, c, t, g, unknown or other
  misc_feature (339)..(339): n is a, c, g, or t
  modified_base (382)..(382): a, c, t, g, unknown or other
  misc_feature (382)..(382): n is a, c, g, or t
  modified_base (499)..(501): a, c, t, g, unknown or other
  misc_feature (499)..(501): n is a, c, g, or t
  modified_base (504)..(512): a, c, t, g, unknown or other
  misc_feature (504)..(512): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctcaggggtccctgaccgattctctggctccaagtctggcacctcagccctccctgaccatcagtgggctccggtccgaggatgaggctgactattactgtgcatcgacgggacncaacagtgggatgaacaatctggagtcgggttgggtgttcggnggagggaccaaacgtgaccgtcgtaggtcagccgaagctcgcccctgtccactctcgttcccaccctcctccgacgccgacgactcgacgcgggctcggcaaggccgacgagtacgnnncgnnnnnnnnn

SEQ ID NO: 23994 - DNA, 631 bp, Homo sapiens
  misc_feature: GYAE6OF01C7PFD.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagaggtcaccatctcttgtctggagcaactccaacatacggaagtaattatgttattctggtatcagacaactcccgaggaactccggacccccaacctcctcactccaagaggaaataatcacgccggccctcgacgggtccctgaccgtattctctggcctccaagtctcgctacctcacgccctccctcgaccactcaggtcggcgtccggtcgaggatggacggctgtacttagttacgtgtcgactacgtacgaccgggacgaccgaaaccgtaggttacgggaattacggtaaacctaacgttcgtagggtacgggttgggttttcgggggttcgggtttaccggggaccggggtaaaccggggtaaccccgtaaaaccggttcggtaaacccccggttccggtaacgggtacccg

SEQ ID NO: 23995 - DNA, 301 bp, Homo sapiens
  misc_feature: GYAE6OF01CV967.21.22.B11.1.454.CMB.1.raw
  modified_base (294)..(301): a, c, t, g, unknown or other
  misc_feature (294)..(301): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcagcccaaggctgcccctggtcactctgttcccacctcctcctcgtctctactgagcggctggcaggcgcatagnnnnnnnn

SEQ ID NO: 23996 - DNA, 305 bp, Homo sapiens
  misc_feature: GYAE6OF01BIYT1.21.22.B11.1.454.CMB.1.raw
  modified_base (299)..(305): a, c, t, g, unknown or other
  misc_feature (299)..(305): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccaccctcctcctcgtctctactgagcgggctggcaaggcgcatagnnnnnnn

SEQ ID NO: 23997 - DNA, 603 bp, Homo sapiens
  misc_feature: GYAE6OF01CI05E.21.22.B11.1.454.CMB.1.raw
  modified_base (207)..(207): a, c, t, g, unknown or other
  misc_feature (207)..(207): n is a, c, g, or t
  modified_base (493)..(493): a, c, t, g, unknown or other
  misc_feature (493)..(493): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacatcggaagtaattatgtattctggtatcagcaactcccaggaatcggacccccaaactcctcactccaagaggaaataatcagccggccctcgacggggtccctgaccgtattcctcgtcggcctaccgaagttctaggccaccctcacgtccctccctgacccatcaggtcgggcctcccgggtaccgaggactcggaggtcctagaaccttattaaccgtgtcgctatccggaacgggacacgaaacngtgggatggaactaagtcgtaggtacggtgggtttaggggttcggttaccgggacgggtaacgggtaacccctaaacggttccggaaccccggttccgtaagggtacccg

SEQ ID NO: 23998 - DNA, 537 bp, Homo sapiens
  misc_feature: GYAE6OF01A126T.21.22.B11.1.454.CMB.1.raw
  modified_base (209)..(209): a, c, t, g, unknown or other
  misc_feature (209)..(209): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
tcagtcgtcgctcgcacgaccggtgctcgatttagacgacagctcagggggggaaggctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaacatcggaagtattatgtattctggtatcagcaactcccaggaatcggcccccaactcctcatccagaggaataatcaggccgcctcgaggggtccctgaccgtattctctggctaccaagtctggccacctcacgccctccctgacccatcagtcggcctccggtcgaggatggagctgacttatactgtgcatccgacgggacncaacgngtgggatggacaagtcgtggaggtcgggttgggtgttccgggcggaacgggacccaaagtcggacccgttcgtaaggtccg

SEQ ID NO: 23999 - DNA, 517 bp, Homo sapiens
  misc_feature: GYAE6OF01D8AX7.21.22.B11.1.454.CMB.1.raw
  modified_base (505)..(517): a, c, t, g, unknown or other
  misc_feature (505)..(517): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgaccatcagtggctccggtccgaggatgaggctgactattactgtgcatcgacgggacgcaacagtgggatgacaatctgagtcggttgggtgttcgggacggagggaccaaacgtcgaccgtcgtaggtcacgcccaaggcctcgcccccgtcggtccacctctcgttccccaccctcctccgacgccgacgactgacgcgggctcggcgacggccgacagtgnnnnnnnnnnnnn

SEQ ID NO: 24000 - DNA, 548 bp, Homo sapiens
  misc_feature: GYAE6OF01BRI8D.21.22.B11.1.454.CMB.1.raw
  modified_base (209)..(209): a, c, t, g, unknown or other
  misc_feature (209)..(209): n is a, c, g, or t
  modified_base (432)..(432): a, c, t, g, unknown or other
  misc_feature (432)..(432): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccgggnagagggtcaccatctcttgtctggagcaactccaacatcggaagtaattatgtattctggtatcagcaactcccaggaatcggacccccaaactcctcatccagaagaataatcagcgccctcgacggggtccctgaccattctctggctccaagtctggcacctcacgcctccctgaccatcaggtcggcctccgggtcaggatggaggctgacttattacngtcgcagtcgacgggtacncaaacgngtcgggatggaactaagtccgtaggacggtcgggttgggtcgttccgggcgggtaacgggaccaaacgtgaccccgttcgtaggtacccg

SEQ ID NO: 24001 - DNA, 497 bp, Homo sapiens
  misc_feature: GYAE6OF01ESB4X.21.22.B11.1.454.CMB.1.raw
  modified_base (227)..(227): a, c, t, g, unknown or other
  misc_feature (227)..(227): n is a, c, g, or t
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (486)..(497): a, c, t, g, unknown or other
  misc_feature (486)..(497): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctnaggggtccctgaccgattctctggctccaagtctggcacctcagcctccctgaccatccagtgggctccggtccgaggatggaggctgactattacngtgcatcacgggcncaacntgggatgacaatctgagcggttggngttcggnggaagggaccaaacgtgaccgtctaggtcagcccaggctcgccccctggtccactctcgttccccaccctcctcctcgtcctctactgacgcggctggcaaggcgcatcgnnnnnnnnnnnn

SEQ ID NO: 24002 - DNA, 680 bp, Homo sapiens
  misc_feature: GYAE6OF01AS4QJ.21.22.B11.1.454.CMB.1.raw
  modified_base (344)..(344): a, c, t, g, unknown or other
  misc_feature (344)..(344): n is a, c, g, or t
  modified_base (660)..(660): a, c, t, g, unknown or other
  misc_feature (660)..(660): n is a, c, g, or t
  modified_base (672)..(672): a, c, t, g, unknown or other
  misc_feature (672)..(672): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (679)..(680): a, c, t, g, unknown or other
  misc_feature (679)..(680): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatcggcccccaaatcctcatccagaggaataatcagccggccctcgaggggtccctgaccgattctctggcctccaagtctggcacctcacgcctcctgaccatcaggtcggctccggtcgaggatgagctgactattactgtcgactatccgacgggacncaaacgagtgggatggaacaatcgtggaggtcgggtttggggtacgttccggggacgggtaacggggaaccctaacgtacggtacccggttaccgtacgggttaccgacggtaccccgaacgggtaccgtcccggtacccccccggttcgggttacccgtacccgttaccgtttcccggtttcccccctaacccccgttccccgttccccgtttcccggttcccgttacccgtttacccggtaccgggtaaccgggtcccgggggtccgttacggggaccgtaaaccggggtcccgtaccgtacggttaacgggcncgcgcgcgcgcncancngnn

SEQ ID NO: 24003 - DNA, 666 bp, Homo sapiens
  misc_feature: GYAE6OF01DH0YQ.21.22.B11.1.454.CMB.1.raw
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggcagagggtcaccatctcttgtctggagcaactcaacatcggaataattatgtattctggtatcagcaactcccaggaactcggaccccaaactcctcactccagaacgaataatcacgccggccctacgacggggtccctagaccgtattcctcgtcggccttaccgaagttctcggccaccctcacgtccctcccgtacgacctacgtcgaggttccgggccgttcccgggtaccgaggtacgtggacgggtcctaggtaacctttattacgtgtacgcctaagtccggaaccggggacgaccgtaaactaggtacggggaatacggaacctaacgttaccggtagggtaacgggttcccggggttttagggggttcggtttaccgggggaccgggaaaccggggtaaaccctaaaaccgggttccggtaaaccccggttcccgtaaaggggtaccccg

SEQ ID NO: 24004 - DNA, 554 bp, Homo sapiens
  misc_feature: GYAE6OF01B338W.21.22.B11.1.454.CMB.1.raw
  modified_base (211)..(211): a, c, t, g, unknown or other
  misc_feature (211)..(211): n is a, c, g, or t
  modified_base (322)..(322): a, c, t, g, unknown or other
  misc_feature (322)..(322): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnagagggtcaccatctcttgttctggaggcaactccaacatcggaagtaattatgtattctggtatcagcaactcccaggaatcggaccccaactcctcatccagagaatancagcgcctcgacggggtcctgaccgattctctcggctccaagtctggccacctcacgtccctccctgacccatccgaggtcgggcctccgggtccgaggatgacggtctacgtactattactgtcgcatcgacgggacncaacngtgggatgaacatcgtaggacggtcgggtttgggtcggttcgggcgggaacgggtaaccgtaacgtcggacccggttcgtagggtccg

SEQ ID NO: 24005 - DNA, 571 bp, Homo sapiens
  misc_feature: GYAE6OF01EIKL2.21.22.B11.1.454.CMB.1.raw
  modified_base (209)..(209): a, c, t, g, unknown or other
  misc_feature (209)..(209): n is a, c, g, or t
  modified_base (461)..(461): a, c, t, g, unknown or other
  misc_feature (461)..(461): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactccccaggaactcggacccccaaactcctcactccagagaataatcagccggccctcgaggggtccctgaccgattctctggctccaagtctggcacctcacgccctccctgaccatcaggtggctccgggtcgagatgaggctgacttattactgtcgcagtcgacggggacacaacgngtagggatggaaccaagttcgtagggtacggtcggggtttggggttcggttaccggggacggggaacgggtaaccctaaacgtcgggaacccggttccgtagggtacccg

SEQ ID NO: 24006 - DNA, 593 bp, Homo sapiens
  misc_feature: GYAE6OF01CIK90.21.22.B11.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggcagagggtcaccatctcttgttctggaggcaactccaaacatcggaagtaattatgttattctggtatcagcaactcccaggaactcggaccccaaactccncactccagaggaataatcagccggccctcgacggggtccctgacccgattctcgtggctaccaagtcctgggccacctcacgtccctccctgaccctatccgaggtcgggccttcccgggtccgagggactcgggaggtcctaggaactttattacgtgtcgaccagttccggaacggggtaccacaaacgagtggggaatcggaacaagtcgtaggacggtcgggttgggtgttcgggacgggtacgggaacccaacgtggaacccggttctagggtaccc

SEQ ID NO: 24007 - DNA, 527 bp, Homo sapiens
  misc_feature: GYAE6OF01EZEB9.21.22.B11.1.454.CMB.1.raw
  modified_base (428)..(428): a, c, t, g, unknown or other
  misc_feature (428)..(428): n is a, c, g, or t
  modified_base (508)..(510): a, c, t, g, unknown or other
  misc_feature (508)..(510): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (523)..(524): a, c, t, g, unknown or other
  misc_feature (523)..(524): n is a, c, g, or t
  modified_base (526)..(526): a, c, t, g, unknown or other
  misc_feature (526)..(526): n is a, c, g, or t
tcagtcgtcgctcgcacgaccggtgctcgatttagacgacagctcaggggtcctgggcccagtctgtgctgactcagccaccctcagcgtctgggacccccgggcagagggtcaccatctcttgttctggaggcaactccaacatcggaagtaattatgtattctggtatcagcaactcccaggaatggccccaaactcctcatccagaggaataatcagcggccctcgacggggtccctgaccgattctctggctccaagtctggcacctcagcctcctgaccatcagtcggctccggtccgaggactggaggcctgactattactggtgcaatcgaacgggacgcaaacgagtgggatgacaatcgtgagtcggttggtgttcgggcgggagggaccaacgtgaccgtcaggtcacgccaaggccncgcccctcggtcactctcgttccccacctcctcctcgtcctcacgtcgacgccgggctcggcgtaacggccgacagtagnnngacgnacnangcnncng

SEQ ID NO: 24008 - DNA, 582 bp, Homo sapiens
  misc_feature: GYAE6OF01DE6QJ.21.22.B11.1.454.CMB.1.raw
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggaccccggagaggtcacatctcttgtctggagcaactccaacntcggaataattatgtattctggtatcagcaactcccaggaatcgacccccaatcctnatccaagagaataancagccggccctgacggggtccctgacctattctcgtcgctacgaagtctggacctacctcacgtccctcccgtagaaccctgtcgaggtccgggccttccgggtaccgaaggatcgggaaggtcctagaaccttattacgtgtacgctaatccgaacggggacacaacgtaggtagggaatcggtaacaagttcgtagggacggttcgggttgggttcggttcggggacggtaacggaccaaacgttcgaccggtttccaagggtcc

SEQ ID NO: 24009 - DNA, 572 bp, Homo sapiens
  misc_feature: GYAE6OF01CHYFB.21.22.B11.1.454.CMB.1.raw
  modified_base (208)..(208): a, c, t, g, unknown or other
  misc_feature (208)..(208): n is a, c, g, or t
  modified_base (327)..(327): a, c, t, g, unknown or other
  misc_feature (327)..(327): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactcaacatcggaagtaattatgtattctggtatcagcaactccaggaatggcccccaaatcctcatccagagaataatcagcggccctnaggggtccctgaccgattctctggctccaagtctggcacctcacgcctccctagaccagtcaggtcgggccttcccgggtacgaggtataggacggtcctaggtaacttattacgtgtcgacacgtcgaacgggtcacaacgagtagggatacggaacaagttcgtaggacgggttcggggtttagggtcgttcggggacggaacgggtaacccaaacgttcggaacccgtcgtaagggtacccg

SEQ ID NO: 24010 - DNA, 508 bp, Homo sapiens
  misc_feature: GYAE6OF01BWBWE.21.22.B11.1.454.CMB.1.raw
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (445)..(445): a, c, t, g, unknown or other
  misc_feature (445)..(445): n is a, c, g, or t
  modified_base (490)..(490): a, c, t, g, unknown or other
  misc_feature (490)..(490): n is a, c, g, or t
  modified_base (496)..(498): a, c, t, g, unknown or other
  misc_feature (496)..(498): n is a, c, g, or t
  modified_base (500)..(508): a, c, t, g, unknown or other
  misc_feature (500)..(508): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctcgaggggtccctgaccgattctctggctcaagtctggcacctcagcctcctgaccatcagtgggctccggtcgagatgaggctgactattacngtgcatcacgggacncaacngtgggatgaacaatcgtgagtcgggttgggtcgttcgggcgggagggaccaacgtcgaccgtcgtaggtcacgcccaaggctcgcccctgccactcctcgttcccnccctcctcctcgtcctctacgtgacgccgggctcggcaggccganacgtgnnncnnnnnnnnn

SEQ ID NO: 24011 - DNA, 491 bp, Homo sapiens
  misc_feature: GYAE6OF01ADR9T.21.22.B11.1.454.CMB.1.raw
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (467)..(468): a, c, t, g, unknown or other
  misc_feature (467)..(468): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
tcagtcgtcgctcgcacgaccggtgctcgatttagacgacagctcgagggtccggtgaccgattctctggcgtccaagtctggcacctcagccgtccctggaccatcacgtgggcctccggtccgaggatgacggcgtgactagttacctggtcgcatcacgggacgcaacatcgggatcgacctaatcctggacgtcggttggggtacgttcgggcggacgggaccaaactcgaccgtcctaggtcacgccgaaggctcgccctgggtcacgtcgtcgttccacctcctcctcgtacgtctaactggacgcggctggacaacggcncatgntngnctnancncgcagtgctncgtcgctcncncncncncncncncncncncncncncncncncnctcgtcgtcgcgcgcgctntctntctcncnctcncncncacacgcncacncncncncnctncncgcgcgcnncncncncncncncacncncnctc

SEQ ID NO: 24012 - DNA, 849 bp, Homo sapiens
  misc_feature: GYAE6OF01BWXM4.21.22.B11.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctctcaccctcctcactcactgcgcgacgggtccgtcgggcccagtctgtgctgactcacgccacctcagccgtcgtccggggaccccggnaggacggtccaccattcttctttgttcgtggacggaccaacctaccaaacgtacgtacggtaaagttaaatttagttagttaactttcgtaggttactcgacgtacctaaacctcccgaaggaactccggaccccctaaactcctacactaccgaagaacggtaaacttaacgccgaacggtcccggtacccgttacgggtaaccgggggttcccctacggaacccgtttacttccgtcgtcggtacccttaccgtaacgttccgtacggaccctacccgttacgacccggtccccttacccgtacgtaaccctacgttaccggtacgggttccgggtacccgtttaccccggggaccggtaagggtacgttaccgggtaacgggtccgttaacggtaccgttttaacgtttacggtcggttacgtaccgtaaccggttacccggaaccggggtaacccgtaacgtaaacggttagggtacggggtaaactacggtaaaccttaaacggttccggtacgggtacgggttaccgggggtttcggggtttcggggtacccgggtaaccggggtaaacgggtaaaccccgtaacggtacccgggttaacccggttaccgggttaaccgggtaccccgg

SEQ ID NO: 24013 - DNA, 758 bp, Homo sapiens
  misc_feature: GYAE6OF01CNMYY.21.22.B11.1.454.CMB.1.raw
  modified_base (56)..(56): a, c, t, g, unknown or other
  misc_feature (56)..(56): n is a, c, g, or t
  modified_base (120)..(120): a, c, t, g, unknown or other
  misc_feature (120)..(120): n is a, c, g, or t
  modified_base (185)..(185): a, c, t, g, unknown or other
  misc_feature (185)..(185): n is a, c, g, or t
  modified_base (206)..(206): a, c, t, g, unknown or other
  misc_feature (206)..(206): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
tcagtcgtcgctcgcacgaccggtgctcgatttagacgacagctcagggggggaanctcagcttcagctgtggtagagaagacaggactcaggacaatctccagcatggccggcttcccnctcctctcacctcctcactcactgcgcagggtcctgggcccagtctgtgctgactcagccacctnacgcgtcgtcggggaccccgnagacggtcacattctcttgttcnggacgcaacgtcaaacngtacggaagttaacttntgttattcgtaggtactcgagtccaactccgaaggtaactccggacccctaactcctacacgttaccgaagtaacggtaactaacgtccgaacggtcccggtacctacgggtaccggggttacccctaggaacccggttactttcccggtacggttacggtacccgttaccgtaacggtttcccgtacgggtaccctaaccgttccgtaacccggttccctttacccgtacgggaacccttacggttccggtaacgggttccgggttacccgttacccggggttaccgaaagggtaccgttacgggtaacgggtccctttaaggtaaccgtttaacgtttaccgtcggtacgtaccgttaaccggttacggaaccggggttactaccgtaacgttacggtacgggacttacggactaacgttcgtagggtacgttcgggtttaggtcggtaccgacgggtacaacccgttagtccggtaccgtcgtaggtacccg

SEQ ID NO: 24014 - DNA, 306 bp, Homo sapiens
  misc_feature: GYAE6OF01B8DTS.21.22.B11.1.454.CMB.1.raw
  modified_base (299)..(306): a, c, t, g, unknown or other
  misc_feature (299)..(306): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtgaccgtcctaggtcagcccaaggctgccccctggtcactctgttcccacctcctcctcgtctctactgagcgggctggcaaggcgcatagnnnnnnnn

SEQ ID NO: 24015 - DNA, 561 bp, Homo sapiens
  misc_feature: GYAE6OF01BGXKY.21.22.B11.1.454.CMB.1.raw
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatcggcccccaaactcctcatccagaggaataatcagccggccctcgacggggtccctgaccgtattctcgtggcctccaagtctggcacctcacgtccctccctgacccatcgaggtcgggcctccgggtcgaggntggaggctgacttattactgtncatcgacgggacncaacgtgtgggatgaactatcgtaggacggtcgggttgggttggttccggggcgggaacgggtaacccaacggttcggaaccccgttcgtacgggtacc

SEQ ID NO: 24016 - DNA, 337 bp, Homo sapiens
  misc_feature: GYAE6OF01B2RO8.21.22.B11.1.454.CMB.1.raw
  modified_base (309)..(337): a, c, t, g, unknown or other
  misc_feature (309)..(337): n is a, c, g, or t
tcagtcgtcgctcgcacgaccggtgctcgatttagacgacagctcaggggttcccgtgaaccgattacctctggctccaacgtctaggcaccctcacgcctccctgaccatcagtgggctccggtccgaggatggaggctgactattactgtgcatcacgggacgcaacatgggatgacaatctgagcggttgggtgttcggcggagggaccaaacgtgaccgtcctaggtcagcccaaggctcgccccctggtcactctgttcccacctctcctcgtctctactgagcggctggcaagggcgcatagnnnnnnnnnnnnnnnnnnnnnnnnnnnnn

SEQ ID NO: 24017 - DNA, 306 bp, Homo sapiens
  misc_feature: GYAE6OF01BC7WI.21.22.B11.1.454.CMB.1.raw
  modified_base (301)..(306): a, c, t, g, unknown or other
  misc_feature (301)..(306): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctcggtcactctcgttcccgccctcctcctcgtctctactgagcgggctggcaaggcgcatagnnnnnn

SEQ ID NO: 24018 - DNA, 539 bp, Homo sapiens
  misc_feature: GYAE6OF01DOVH5.21.22.B11.1.454.CMB.1.raw
  modified_base (434)..(434): a, c, t, g, unknown or other
  misc_feature (434)..(434): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagccgtctcggggacccccgggcaggacgggtcaccatctcttgttctggagcaactcaacatcggaagtaattatgtattctggtatcagcaactcccaggaatcggaccccaactcctcatccagagaataatcagcgccctgacggggtccctgaccgtatcgtctggctacaagtctggccacctcagccctccctgaccatcagtcggtctccggtcgagatggagctgactatactgtncatcgaacgggacacaacagtagggatgactaagtctaggagtcgggtttagggtcggttacgggcgggaacggtaaccaaacgtggtacccgtcgtaggtaccg

SEQ ID NO: 24019 - DNA, 299 bp, Homo sapiens
  misc_feature: GYAE6OF01DJJUU.21.22.B11.1.454.CMB.1.raw
  modified_base (296)..(299): a, c, t, g, unknown or other
  misc_feature (296)..(299): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgcccctggtcactctgttcccgcctcctcctcgtctctactgagcggctggcaaggcgcatagnnnn

SEQ ID NO: 24020 - DNA, 513 bp, Homo sapiens
  misc_feature: GYAE6OF01C6YBL.21.22.B11.1.454.CMB.1.raw
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (498)..(499): a, c, t, g, unknown or other
  misc_feature (498)..(499): n is a, c, g, or t
  modified_base (501)..(501): a, c, t, g, unknown or other
  misc_feature (501)..(501): n is a, c, g, or t
  modified_base (504)..(513): a, c, t, g, unknown or other
  misc_feature (504)..(513): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggccccaaatcctcatccagaggaataatcagcggccctcgaggggtccctgaccgattctctggctaccaagtctggcacctcagcctccctgaccatcagtggcctcggtccgaggatgaggctgactattactgtncatcagggcacaaaagtgggatgactatcngngcgttgggngtcgacggaggaccaacgtcgaccgtccgtaggtcacgaccgaaggccgtcgcccccgtgtctaccgtctccgttacccctccgtcctccgttcgtctctacgtgacggcggtctggacaggcgctagtcgnngntcnnnnnnnnnn

SEQ ID NO: 24021 - DNA, 739 bp, Homo sapiens
  misc_feature: GYAE6OF01C2DE7.21.22.B11.1.454.CMB.1.raw
  modified_base (248)..(248): a, c, t, g, unknown or other
  misc_feature (248)..(248): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggaccccggcagagggtcaccatctcttgttctggaggcaactccaacntacggaagtaattatgtattcgtggtatcagcaacgtccgggaatccggacccccaaactcctacactccgagaggaataatcagccggccctcgacggggttccctaggaccgtattcgtcgtacggccctaccgaaggttccgtcgggccctaaccccgttccgtaaccggtcccccttaccccgtacggaaacccctaagttcccgaacggggtttccggggccccgtttaccccggggtacccgggaacggggtacgttacgggaaccggggtcttaacggtacctttaacgtttaaccgttggtacgtaaccgtacgttacccggaaccggggtaaccgaccgtaaaccgtggttacggggaactacggtaacaacggttccggtagggacgggttccggggttaggggttcggttccggggacggggttaaaccgggaaccctaaacggtcgggtaacccgttccggtaacggcccgtaacccgg

SEQ ID NO: 24022 - DNA, 307 bp, Homo sapiens
  misc_feature: GYAE6OF01BCIOF.21.22.B11.1.454.CMB.1.raw
  modified_base (295)..(307): a, c, t, g, unknown or other
  misc_feature (295)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggaggaccaaactgaccgtcctaggtcagcccaaggctgccccctggtcactctcgttcccgcctcctcctcgtctctactgagcggctggcaggcgcatgnnnnnnnnnnnnn

SEQ ID NO: 24023 - DNA, 533 bp, Homo sapiens
  misc_feature: GYAE6OF01BCNLG.21.22.B11.1.454.CMB.1.raw
  modified_base (210)..(210): a, c, t, g, unknown or other
  misc_feature (210)..(210): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (485)..(485): a, c, t, g, unknown or other
  misc_feature (485)..(485): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagagggtcaccatctcttgtctggagcaactcaacatcggaataattatgtattctggtatcagcaactccaaggaatcggaccccaaactcctcactcagagaatatcagcgcctgacgggtccctgaccgattctctggcctaccgaagtctggacacctcacgtccctcctgacctatcgaggtcggcctccgggcgaggatggacggtctgtaaccttattacgtgtacgcaagtccgacgggacncaagntgggatgactagttcgaggngtgggttggtcgttcggcggacgaacccaagtcgaccgcgtagtaccg

SEQ ID NO: 24024 - DNA, 498 bp, Homo sapiens
  misc_feature: GYAE6OF01E0NTN.21.22.B11.1.454.CMB.1.raw
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
  modified_base (468)..(468): a, c, t, g, unknown or other
  misc_feature (468)..(468): n is a, c, g, or t
  modified_base (482)..(482): a, c, t, g, unknown or other
  misc_feature (482)..(482): n is a, c, g, or t
  modified_base (487)..(498): a, c, t, g, unknown or other
  misc_feature (487)..(498): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcacgcctccctgaccatcagtgggctccggtccgaggatggaggctgactattactgtgcatcgacgggacncaacngtgggatgaacaatcngagcggttgggtgttcgggcggagggaccaacgtgaccgtctaggtcacgcccaaggccncgcccctcgtcactctcgttccccnccctcctcctctctcctctgngcggctggcaggcnagtgnnnnnnnnnnnn

SEQ ID NO: 24025 - DNA, 585 bp, Homo sapiens
  misc_feature: GYAE6OF01BD156.21.22.B11.1.454.CMB.1.raw
  modified_base (210)..(210): a, c, t, g, unknown or other
  misc_feature (210)..(210): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnagagggtcaccatctcttgttctggaggcaactccaacatcggaagtaattatgtattctggtatcagcaactccaggaatcggacccccaaactcctcatccaagagaataatcagccgcctcgacgggtcccngaccgatctcngctccaagtctcggcacctcacgcctccctagaccctatcgaggttcgggccttcccgggaccgagtacgtggacggtctagaacgttnttacgngtacgcagtcggaacgggtacncaaacgtcgngggactagaacgtaatccggtaggcggttcggggtttgggtcgggtacccgggacgggaacggtaacccgtaacgttgggaaccccgttcggtgggtacccg

SEQ ID NO: 24026 - DNA, 662 bp, Homo sapiens
  misc_feature: GYAE6OF01C1EUZ.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctccaccctcctcactcactgcgcagggtcctcgggcccagtctgtgctgactcagcccaccctcagcgtcgtcggggaccccggnagagggtcaccatctcttgtcgtggagcaactcaacagtacggaagttaattatgttattcgtggtatcagccaacctcccgaaggaactccggaacccccaaactccctacactccgaaggaaggtaaataacgtcacggtccggccctcggacggggtccctagacccgtattccgtcgtcggacctaccgtaagttctacggcctacccgttcgaccgtccccttccgtacgacctacgtccgaggtcgggtccgtcccgggtacgaggactcggacggtcctagtaacttagttacgtggtacacgtacgtaccggaaccgggtacaccgaaacgtacggttggaacttagaacctagttcgagggtacgggttcggggtttgggcgggttaccgggacggtaaccggggaaccctaacggttccgacccggttcgtaggtacccg

SEQ ID NO: 24027 - DNA, 262 bp, Homo sapiens
  misc_feature: GYAE6OF01CGM1H.21.22.B11.1.454.CMB.1.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (212)..(213): a, c, t, g, unknown or other
  misc_feature (212)..(213): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (223)..(224): a, c, t, g, unknown or other
  misc_feature (223)..(224): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (258)..(262): a, c, t, g, unknown or other
  misc_feature (258)..(262): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcgggtgtgtcgaggnggcaatgcncngnanccagnncccngtnacnngtccactctcngntcacnancggctgcaggcnannnnn

SEQ ID NO: 24028 - DNA, 668 bp, Homo sapiens
  misc_feature: GYAE6OF01DG09D.21.22.B11.1.454.CMB.1.raw
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
  modified_base (666)..(666): a, c, t, g, unknown or other
  misc_feature (666)..(666): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatcggaccccaaactcctcatccagagaataatcagcggccctcgacgggtcctgaccgtattctctggctccaagtctggcacctcagcctcctgaccatcgagtcgggcctccggtccgaggactgacggctgtaactagttacctgtcgacagtccgaacgggtcacaacgtagtcgggattacgactaagtcgtaggagtcgggtttagggtcggttacgggacgggtaacgggaaccgtaaacgtcggtaacccggttaccgtacgggttaccgaaccgtacccgaagggtccctccccggaccccgttacggtaccctaacgtcccgtttacccgttacccccgaacccccgtttcccgttcccgttaccgttccccgtttacccgttaaccgttcgggtaccggtaccggggtccgtaccgggaaccgacggtccggacttaacggtacgcgtgcgcgacgacgcgacgancncgngc

SEQ ID NO: 24029 - DNA, 307 bp, Homo sapiens
  misc_feature: GYAE6OF01EFIR5.21.22.B11.1.454.CMB.1.raw
  modified_base (301)..(307): a, c, t, g, unknown or other
  misc_feature (301)..(307): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggaggaccaaactgaccgtcctaggtcagcccaaggctcgccccctggtcactctcgttcccgccctcctcctcgtcctctactgagcgggctggcaaggcgcatagnnnnnnn

SEQ ID NO: 24030 - DNA, 568 bp, Homo sapiens
  misc_feature: GYAE6OF01CHSFU.21.22.B11.1.454.CMB.1.raw
  modified_base (210)..(210): a, c, t, g, unknown or other
  misc_feature (210)..(210): n is a, c, g, or t
  modified_base (325)..(325): a, c, t, g, unknown or other
  misc_feature (325)..(325): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcaactccaacatcggaagtaattatgtattctggtatcagcaactccccaaggaactcggacccccaaatcctcatccagagaataancagcggccctgacggggtcctgaccgattctcgtggcctcaagtctggccacctcacgccctccctgacccatcaggtcgggccctccgggtaccgaggtatggacggtctagacttattactgtagctatccgacgggacacaacgtgtcgggatcggaacaagtcgtaggacggtgggtttgggtcggttccggggacggacgggtaacccaaacgtcggaacccgttcggtaggtacccg

SEQ ID NO: 24031 - DNA, 598 bp, Homo sapiens
  misc_feature: GYAE6OF01A525D.21.22.B11.1.454.CMB.1.raw
  modified_base (494)..(494): a, c, t, g, unknown or other
  misc_feature (494)..(494): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcaggagggtcaccatctcttgttctggagcaactccaacatcggaagtaattatgtattctggtatcagcaactcccaggaatcggaccccaaactcctcatccagagaataatcagccgcctcgacggggtccctgaccgtattctctggcctcgaacgtctggccacctcgactcctccctgacccatccgaggtcggcctccgggtacgaggtatggacggccttaggacccttatttacgtggtcgaccgtaacgtccggaaccggggtacaccgtaaacnggtagggaatcggaaactagtcgtgggagggttcggggtttaggggtcgttcggggacgggtaacgggaacctaaacgtcggaaccccggttcgtagggtaccg

SEQ ID NO: 24032 - DNA, 301 bp, Homo sapiens
  misc_feature: GYAE6OF01BTSG4.21.22.B11.1.454.CMB.1.raw
  modified_base (291)..(291): a, c, t, g, unknown or other
  misc_feature (291)..(291): n is a, c, g, or t
  modified_base (297)..(301): a, c, t, g, unknown or other
  misc_feature (297)..(301): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcagcccaaggctcgcccctcggtcactctcgtcccgcctcctcctcgtctctactgagcggctggcaaggcncatagnnnnn

SEQ ID NO: 24033 - DNA, 598 bp, Homo sapiens
  misc_feature: GYAE6OF01CZLF6.21.22.B11.1.454.CMB.1.raw
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggcaggagggtccaccatctcttgttctggagcaactccaacatcggaataattatgttattctggtatcagcaactccaggaactcgaccccaactcctcactccagagaataatcacgcgccctgacggggtccctgaccgtattcctctcggctaccgaagtctggccacctcacgtccctccctgacctatccaggtcggcctccgggtaccgaggctggacggctgtaacttattctgtcgctagtccgaacgggtacacaactaggtgggaattacggaactaagttcgtagggacgggttcggggttttggggtcggtttaccgggggacggtacggggaaaccccttaaagttccgggaaccccggttcgtaacgggtacccg

SEQ ID NO: 24034 - DNA, 576 bp, Homo sapiens
  misc_feature: GYAE6OF01E4QE9.21.22.B11.1.454.CMB.1.raw
  modified_base (207)..(207): a, c, t, g, unknown or other
  misc_feature (207)..(207): n is a, c, g, or t
  modified_base (432)..(432): a, c, t, g, unknown or other
  misc_feature (432)..(432): n is a, c, g, or t
  modified_base (473)..(473): a, c, t, g, unknown or other
  misc_feature (473)..(473): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggcccccaaatcctcatccagagaataatcagccggccctcgacggggtccctggaccgtattctcgtggccttaccgaagttctgggccacctccacgtccctccctcgaccatccgaggtcgggcctccgggtcgaaggntggacggctgacttattactgtcgctacgtcgacggggacnccaacgtagtggggacttggaactaagtcgtaggacggtgggtttggggtcgttcggggacgggacgggaaccctaaacgtcggacccgttcgtagggtaccg

SEQ ID NO: 24035 - DNA, 597 bp, Homo sapiens
  misc_feature: GYAE6OF01ETGHG.21.22.B11.1.454.CMB.1.raw
  modified_base (208)..(208): a, c, t, g, unknown or other
  misc_feature (208)..(208): n is a, c, g, or t
  modified_base (493)..(493): a, c, t, g, unknown or other
  misc_feature (493)..(493): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagagggtcaccatctcttgttctggagcaactccaacatcggaagtaattatgtattctggtatcagcaactcccaggaatcggacccccaaactcctcatccagagaataatcagccggccctcgacggggtcccctagaccgattcctcgtcggcctaccgaagtcctggccacctcgacgcccttcccgtgaacccagtccaggtcgggcctccgggtaccgaggtatggaggtctaggaccttagttactgtagcctagtccgaaccggggtacaccaaangtaggggaatggaaactaagtcgtggtaagggtcgggtttgggtcggttacgggacgggtaacgggtaacccgaaacgtcggaaccccggttctaagggtaccg

SEQ ID NO: 24036 - DNA, 620 bp, Homo sapiens
  misc_feature: GYAE6OF01D9JOC.21.22.B11.1.454.CMB.1.raw
  modified_base (209)..(209): a, c, t, g, unknown or other
  misc_feature (209)..(209): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
  modified_base (452)..(452): a, c, t, g, unknown or other
  misc_feature (452)..(452): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactcccaggaatcggaccccaactccncatccagagaatancagcggcctcgacgggtcccngaccgtattctcgtcggtcctaccaagtcctggcctacctcgacgcccttcccagaccatcgaggtcgggcctcccgggtacgaggtatggacggtctagacttagttacgngtacgctacgtaccgaaccggggtacaccgtaacgaggtaggggacttaggaacctaagttccgtagggaacggttccgggggtttagggggttcggttaccgggggacccgggaaacggggtaacccctaaaggttcccggaacccggttaccgtagggtaaccccg

SEQ ID NO: 24037 - DNA, 538 bp, Homo sapiens
  misc_feature: GYAE6OF01BDN31.21.22.B11.1.454.CMB.1.raw
  modified_base (207)..(207): a, c, t, g, unknown or other
  misc_feature (207)..(207): n is a, c, g, or t
  modified_base (430)..(430): a, c, t, g, unknown or other
  misc_feature (430)..(430): n is a, c, g, or t
  modified_base (450)..(450): a, c, t, g, unknown or other
  misc_feature (450)..(450): n is a, c, g, or t
  modified_base (475)..(475): a, c, t, g, unknown or other
  misc_feature (475)..(475): n is a, c, g, or t
  modified_base (512)..(512): a, c, t, g, unknown or other
  misc_feature (512)..(512): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctggtatcagcaactcccaggaactcggacccccaaatcctcatccagaaggaataatcagccggccctcgaggggtcccctgacccgtattcctcgtcggcctccaagtcctgggccaccctcacgccctccctgacccatccaggtcgggcctccggtcgaggntggaggctagacttattacngtgcagtccgacggggacacaacgngtgggatgacatcgtgacggtcgggttggtgtcgggnggacggaccaagtgaccgttgaggcc

SEQ ID NO: 24038 - DNA, 588 bp, Homo sapiens
  misc_feature: GYAE6OF01EMN3P.21.22.B11.1.454.CMB.1.raw
  modified_base (390)..(390): a, c, t, g, unknown or other
  misc_feature (390)..(390): n is a, c, g, or t
  modified_base (452)..(452): a, c, t, g, unknown or other
  misc_feature (452)..(452): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggcagagggtcaccatctcttgttctggaggcaactccaacatcggaagtaattatgtattctggtatcagcaactcccagaatcggacccccaaactcctcataccagaggaataatcagccggccctcgacggggtccctgaccgtattctctggcctaccaagtctggcctacctcacnccctccctgacccatcaggtcggcctcccgggtacgaggatggcgctgacttattactgtcncatccggaggacgacaacgagtacgggatagaacacgttcgtagggacggtgggggtttgggtcggttcgggggaccggaaacgggggtaaacccctaaacggttccgggaacccggttcccgtaagggtacccgg

SEQ ID NO: 24039 - DNA, 493 bp, Homo sapiens
  misc_feature: GYAE6OF01EF0S5.21.22.B11.1.454.CMB.1.raw
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (482)..(493): a, c, t, g, unknown or other
  misc_feature (482)..(493): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgaccatcagtggctccggtccgaggatgaggctgactattactgtgcatcacgggacncaacntgggatgacaatctgagcggttggtgttcgggcggagggaccaacgtgaccgtctaggtcagccaagctcgcccctcgtcactctcgttcccaccctcctcctcgtcctctactcgacgcggctggcgacggcgcatagnnnnnnnnnnnn

SEQ ID NO: 24040 - DNA, 302 bp, Homo sapiens
  misc_feature: GYAE6OF01C7DYS.21.22.B11.1.454.CMB.1.raw
  modified_base (299)..(302): a, c, t, g, unknown or other
  misc_feature (299)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggacaaactgaccgtctaggtcagcccaaggctcgccccctcggtccactctgttccccgcctcctcctcgtctctactgagcggctggcaaggcgcatagnnnn

SEQ ID NO: 24041 - DNA, 636 bp, Homo sapiens
  misc_feature: GYAE6OF01A7OKX.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcggggacccccgggnaggagggtcaccatctcttgtctggagcaactccaacatacggaagtaattatgtattctggtatcagcaactccaggaactccggaccccaaactcctacactccagaagaataactcagccgcctcggacggggtccctaggaccgtattcctcgtcggacctccgaacgttctcggcctacctcgacgtccctcccgtacgaccctagtaccgtaggggtcgggtacccttccgggtaccggaggtacttcggacggtcctaggtacctttacgtttacgtggtcgacctaagttcccggaaccggggtaccaaccgtaaactgggtacgggtaatacggaacttaacgtcggtaggtacgggttcggtggggttacgtcggggacgaacgggacctaacggtgaccccgttgtcggaccg

SEQ ID NO: 24042 - DNA, 311 bp, Homo sapiens
  misc_feature: GYAE6OF01A2CSN.21.22.B11.1.454.CMB.1.raw
  modified_base (296)..(296): a, c, t, g, unknown or other
  misc_feature (296)..(296): n is a, c, g, or t
  modified_base (302)..(311): a, c, t, g, unknown or other
  misc_feature (302)..(311): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgacctattactgtgcatcacgggacgcaacatgggatgacaatctgagcggttgggtgttcggcggagggaccaaactgaccgtcctaggtcagcccaaggctgccccctggtcactcgtgttcccaccctcctcctcgtctctactgagcgggctggccaaggcncatagnnnnnnnnnn

SEQ ID NO: 24043 - DNA, 414 bp, Homo sapiens
  misc_feature: GYAE6OF01CSCDN.21.22.B11.1.454.CMB.1.raw
  modified_base (227)..(227): a, c, t, g, unknown or other
  misc_feature (227)..(227): n is a, c, g, or t
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (395)..(414): a, c, t, g, unknown or other
  misc_feature (395)..(414): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctnaggggtcccctgaccgattctctggctccaagtctggcacctcagccctccctgacccatcagtgggctccgggtccaggntggaggcctgactattactgtgcatcgaacgggacncaaaagtgggatgaacaatctagacgcgggctggacaagggcgacataggnnnnnnnnnnnnnnnnnnnn

SEQ ID NO: 24044 - DNA, 306 bp, Homo sapiens
  misc_feature: GYAE6OF01DEVUK.21.22.B11.1.454.CMB.1.raw
  modified_base (301)..(306): a, c, t, g, unknown or other
  misc_feature (301)..(306): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgcccctcggtcactctcgttcccacctcctcctcgtcctctactgagcgggctggcaaggcgcatagnnnnnn

SEQ ID NO: 24045 - DNA, 511 bp, Homo sapiens
  misc_feature: GYAE6OF01A2Z7C.21.22.B11.1.454.CMB.1.raw
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (364)..(364): a, c, t, g, unknown or other
  misc_feature (364)..(364): n is a, c, g, or t
  modified_base (455)..(455): a, c, t, g, unknown or other
  misc_feature (455)..(455): n is a, c, g, or t
  modified_base (498)..(499): a, c, t, g, unknown or other
  misc_feature (498)..(499): n is a, c, g, or t
  modified_base (501)..(511): a, c, t, g, unknown or other
  misc_feature (501)..(511): n is a, c, g, or t
tcagtcgtcgctcgcacgaccggtgctcgatttagacgacagctcagggtcctgggcccagtctgtgctgactcagccaccctccagcgtctgggacccccgggcacggagggtcaccatctcttgttctggaggcaactccaacatcggaagtaattatgtattctggtatcagcaactcccaggaatggcccccaaatcctcatccagaggaataatcagcggccctcaggggtccctgacccgattctctggctccaagtctggcacctcagccctccctgaccatcagtgggctccggtcgaggatgaggctgactattacngtncatcgacgggacgcaacagtggggatgacaatcgngagcgggttgggtgttcggcggtaggggaccaaacgtgaccgtacctaggtcacgcccgaagctccgccccttcggccactctcgttcccnccctctccctcgtctctactgcgcggctggcgacgcgcaagtnncnnnnnnnnnnn

SEQ ID NO: 24046 - DNA, 304 bp, Homo sapiens
  misc_feature: GYAE6OF01DI0X3.21.22.B11.1.454.CMB.1.raw
  modified_base (300)..(304): a, c, t, g, unknown or other
  misc_feature (300)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctgttcccaccctcctcctcgtctctactgagcgggctggcaaggcgcatagnnnnn

SEQ ID NO: 24047 - DNA, 710 bp, Homo sapiens
  misc_feature: GYAE6OF01BQH49.21.22.B11.1.454.CMB.1.raw
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
tcagtcgtcgctcgcacgaccggtgctcgatttagacgacagctcaggggggggaagctcagcttcagctgtggtagagaagacagggactcaggacaatctccagcatggccggcttccctctcctcctccaccctcctcactcactgcgcagggtcctgggcccagtctgtgctgactcagccaccctcagcgtcgtcgggacccccgggnagnggtccaccagtctcttgtctggagcaactccaacatcggaagtaattatgtaattctggtatcagcaactccccaggtaatcggacccccaaatcctcataccagaagaataactcacgccgaccctcggacggggtccctagaacccgtattcctcgtcgggccctaccgaaaggttcctaggacctaccctcaacgtcccttcccgtagacccagtccagggtcgggcccttcccgggtccgaaggtacgttacggaggtcccgttagtacctttacggtttaccgttggtacgaccgtacggtaccgggaacccggggtaccgtaccgtaaaccgaggttacggggaacttaccggaaccgtaaaccgtccgggttacggaaccgggggttcgggttttcgggggtccggtttaccccggggaccggggttaaaccgggaaaccctaaacccgggttacggacccccggttaaccggtacgggtaaccccg

SEQ ID NO: 24048 - DNA, 559 bp, Homo sapiens
  misc_feature: GYAE6OF01BC5NK.21.22.B11.1.454.CMB.1.raw
  modified_base (427)..(427): a, c, t, g, unknown or other
  misc_feature (427)..(427): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaactcctcatccagaggaataatcagccggccctcgacggggtccctgaccgtattcctctggcctccgaagtctggccacctcacgtccctccctgaccatcgaggtcggctcccgggtcgaggntggacggctgactattactgtgcatcgacgggacaccaacgngtgggatggaactagtctaggacggttgggttggggtcggttccgggacgggacgggtaacccaagtcggaccccgttcgtcgggtaccg

SEQ ID NO: 24049 - DNA, 553 bp, Homo sapiens
  misc_feature: GYAE6OF01C1YWH.21.22.B11.1.454.CMB.1.raw
  modified_base (209)..(209): a, c, t, g, unknown or other
  misc_feature (209)..(209): n is a, c, g, or t
  modified_base (461)..(461): a, c, t, g, unknown or other
  misc_feature (461)..(461): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggaccccggnagagggtcaccatctcttgttctggagcaactccaacatacggaagtaattatgtattctggtatcagcaactccaggaactcgaccccaactctcatccagagaatatcagccggcctgacggggtcctgaccgtattctcgtcggctaccaagtctcggcctacctcacgccctccctcgaccatcaggtcgggcctcccgggtaccgaggactggacgctagacttatctgtgactatcgacgggtacncaacgagtgggatgaacaagtcgtaggacggtgggttgggtggttccgggacgggaacggtaccaaacggtcgaacccgtccgtaggtaccg

SEQ ID NO: 24050 - DNA, 646 bp, Homo sapiens
  misc_feature: GYAE6OF01ALKI1.21.22.B11.1.454.CMB.1.raw
  modified_base (253)..(253): a, c, t, g, unknown or other
  misc_feature (253)..(253): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggacccccgggcaggagggtcaccatctcttgttctggagcaactccaacntacggaataattatgtattcgtgtatcagcactcccaggaactccggacccccaaactcctacactccagaagtaataatcagccggccctcgacggggtccctagacccgtattcctcgtcggcctaccgtaagtcctcggcctaaccctcgaccgtcccctcccgtagacccatcggacggttcgggacccttccggggtaccgaggtcgtcggacgggtcctagtaccttagttacgtggtcgacgtactccgggaaccggggacctacaacgtaggtcgggaatcggaactaagtccgtagggtcgggttcggggtttgggtcgggttacggggacgggtaacgggtaaacccgtaaagtcccggtaacccggttcgtacggtaaccgg

SEQ ID NO: 24051 - DNA, 773 bp, Homo sapiens
  misc_feature: GYAE6OF01BPUKL.21.22.B11.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagnggtcaccatctcttgtctggagcaactccaacatcggaagtaattatgtattcgtggtatcagacaacctcccgaaggtaactccggacccccaaactccctacactccaaggagaataatcgacggccgccctcggaccggggttccctaggacccgtagttcctcgtcggtacctaccgtaagtccgtacgggaccctaacccttccgaccgtccccgttaccccgttagaaccccctagttaccgacggggtttcccgggcccgtttaccccggggaccggtaaagggtacgttcggaacggggtcccttacgggttaaacctttaacgttttacggtacggttccgaaccttaacggttaccccggaaccgggggtaaccacccggtaaaaacgttgggtacggggtaacttaccggaaacgtaacgttccgggtagggtaaccggggtttcccggggttttagggggttaccgggtttacccggggaacgggggtaaaccgggtaacccctaaaccgggttacggacccccgggttaccgttaacggggtaacccg

SEQ ID NO: 24052 - DNA, 845 bp, Homo sapiens
  misc_feature: GYAE6OF01D7MUI.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccggcaggaggtcaccatctcttgtctggagcaactccaacagtacggaagtaattatgtattctggtatcagcaactccgaggaactccggacccccaaactcctacactaccgaaggaacgtaaataacgtcaacggcccggtaccccttacggaacgggggttcccctaggtaacccgtagtttcctacggtacggtacccttaccgtaagttcccgtacgggaccctaacccgttccgaaccggtcccccttaccccgtacggtaacccctagttacccggaacggggtttcccggggaccccgtttacccccggggttaccgggaaacgggtacgtttccggggaaaccgggttccggttaacgttaaacccgttttaaacggttttaccggtacgggttacggtaaccctaaacggtttaccccgggaaaccggggggaaccctaaccgtaaaccggtagggttacgggggaaactttacgggaaacccttaaacggttccggttacggggaacgggtttccgggggggttttcgggttacggggtttaccgggggaccggggtaaaccgggggtaaaccccctaaacgggttcccggggttaaccccggttaacccggtaggggtaaaccccgg

SEQ ID NO: 24053 - DNA, 505 bp, Homo sapiens
  misc_feature: GYAE6OF01B0X67.21.22.B11.1.454.CMB.1.raw
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
  modified_base (493)..(505): a, c, t, g, unknown or other
  misc_feature (493)..(505): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtggctccggtccgaggatgaggctgactattactgtgcatcgacgggacgcaacgatggggatgacaatctgagtcggttgggtgttcgggcggagggaccaaacgtgaccgtcctaggtcagcccaaggctcgcccctcggtcactctcgtccccacctctcctcgtctctacngacgcggcncggcgaaggtccacgagtcgnnnnnnnnnnnnn

SEQ ID NO: 24054 - DNA, 543 bp, Homo sapiens
  misc_feature: GYAE6OF01BBBRF.21.22.B11.1.454.CMB.1.raw
  modified_base (422)..(422): a, c, t, g, unknown or other
  misc_feature (422)..(422): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactccaggaatcggcccccaaatcctcatccagaggaataatcagccggccctgacggggtccctgacccgtattcctctggcctccaagtcctggcacctcacgccctccctgacccatcagtcgggcctccgggtccgaggntggacggtctgacttattactgtgcatcgacgggacncaacgagtgggatgacaatcgtgaggtcgggttgggtgttcgggacgggtagggtaacccaagtcggacccgttcgtagggtcc

SEQ ID NO: 24055 - DNA, 643 bp, Homo sapiens
  misc_feature: GYAE6OF01EGFTD.21.22.B11.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagagggtcaccatctcttgttctggaggcaactccaacatacggaagtaattatgtattctggtatcagcaactcccaaggaactccggaccccaaactcctcactccaagagaataatcacgccggccctcgacggggtccctagaccgtattcctcgtcggcctaccgaagtccgtcggcctacctcacgtcccctccctacgaccatcgtacggtcgggtccgtaccgggtcgaggagtggacggtctaggtaacctttagtttacgtggttcgactaacgtaccggaccgggtacgactaacgaggttagggaatcggaaactacgtcggtagggtacgggttcggggtttggggtcgggttaccggggacgggtaaacccgggtaaccgtaaacggttccgggtaacccggttccggtagggtaaccccg

SEQ ID NO: 24056 - DNA, 592 bp, Homo sapiens
  misc_feature: GYAE6OF01ED3J3.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatacggaagtaattatgtattctggtatcagcaactcccaggaactcggacccccaaactcctcactccagagaataatcagccggccctcgacggggtccctgaccgtattctcgtggcctaccaagtctggccaccctcacgccctccctagacccatcgaggtcgggcctccgggtccgaggatggacggtctgacttattacgtgtcgctagtccgaacgggacacaacagtgggatcgaactaagtcgtaggtacgggtcggggtttggggtcggttaccggggaccgggtaacgggtaaccctaaacggtcggtaacccggtccgttaagggtacccg

SEQ ID NO: 24057 - DNA, 623 bp, Homo sapiens
  misc_feature: GYAE6OF01BR3A9.21.22.B11.1.454.CMB.1.raw
  modified_base (217)..(217): a, c, t, g, unknown or other
  misc_feature (217)..(217): n is a, c, g, or t
  modified_base (274)..(274): a, c, t, g, unknown or other
  misc_feature (274)..(274): n is a, c, g, or t
tcagtcgtcgctcgcacgaccggtgctcgatttagacgacagctcagggggggtaaggctcagccttcagctgtggtagagaagacaggactcagggaccaatctccagcagtggccggcttccctctcctcctcaccctcctcactcactgcgcagggtcctgggcccagtctgtgctgacctcagccaccctcagcgtcgtcgggacccccgggnagacgggtcaccatctcttgtctggagcactccaacatcggaagtattatgtattcngtatcagcactccaggactcggaccccaatcctcatccgagagaatatcagccgccctcggacggggtccctgaccgtattccgtcgtggcctaccgaagttctcggcctaccgtcacgtccccttaccctacgaccctactccgaggttcgggcctccgggtaccgaggtactggacggctacggacttagttactgtcactactaccgacggggacacgtaaacgtgtacgggactacggaacgtaacgttcggtacggacgggttcggggtttacggggtcggttaccggggacgggtaacgggtaacccaaacggttcgggtacccggttccgtacgggtacccg

SEQ ID NO: 24058 - DNA, 626 bp, Homo sapiens
  misc_feature: GYAE6OF01AUS5A.21.22.B11.1.454.CMB.1.raw
  modified_base (465)..(465): a, c, t, g, unknown or other
  misc_feature (465)..(465): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcggggacccccgggcagagggtcaccatctcttgtctggaggcaactccaacatcggaagtaattatgtattctggtatcagcaactcccaaggaatcggacccccaaactcctacatccagagaataatcagccggccctcgacggggtccctgaccgtattcctctcggctccaagtcctggcacctcacgccctccctgaacccatccgaggtcgggccttcccgggtaccggaggactggacggtcctagtaacttagtttacnggtcgacctaacttcggaaccgggggaactaccgaaacgtagggtgggaacttggaaacctaaagtccggtaggacggttcgggggtttgggttcggttccgggacgggtaacggggtaaccctaaacggtccgggtaacccgttcccggtaagggtcccg

SEQ ID NO: 24059 - DNA, 567 bp, Homo sapiens
  misc_feature: GYAE6OF01CVL38.21.22.B11.1.454.CMB.1.raw
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (561)..(567): a, c, t, g, unknown or other
  misc_feature (561)..(567): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaatcctcatccagaggaataatcagcggccctcgaggggtccctgaccgattctctggctccaagtctggcacctcagcctcctgaccatcgaggttcgggcctccgggtccgaggactggacggctaggaaccttattactggtcgactagtccgaacggggacacaaacgagtggggatggaactaatcgtggaggtcgggttggggtcgttcggggacgggaagggaccaaacgtcgaccgtaccgtaggtcacgccaaggctccgccccgtcgtcactcgtcgttcccgccctcctcctccgtcctcgtacgtcgacggccggtcgtcgggacaacgggccgactacgtaggcatngcncnnnnnnn

SEQ ID NO: 24060 - DNA, 552 bp, Homo sapiens
  misc_feature: GYAE6OF01C6QR7.21.22.B11.1.454.CMB.1.raw
  modified_base (540)..(552): a, c, t, g, unknown or other
  misc_feature (540)..(552): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctctggctccaagtctggcacctcacgcctccctcgaccactcagtgggcgtccggccgttttttaggatgaggctgactattactgtgcatcacggacgcaacatgggatgacaatctgaggtcggttggggtggttcgggcgggacggggaaccgaaaccgtacggaccgtccgtacggtcgacgacccgaacggccgtcgcccccgtccggtccacctcctcgttccccgtcccctccctcccttccgtcctcctactcgacgccgggcgtcggcgaggccgcacgtagnnnnnnnnnnnnn

SEQ ID NO: 24061 - DNA, 304 bp, Homo sapiens
  misc_feature: GYAE6OF01BXRQH.21.22.B11.1.454.CMB.1.raw
  modified_base (297)..(304): a, c, t, g, unknown or other
  misc_feature (297)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccacctcctcctcgtctctactgagcggctggcaaggcgcatagnnnnnnnn

SEQ ID NO: 24062 - DNA, 512 bp, Homo sapiens
  misc_feature: GYAE6OF01EG0F1.21.22.B11.1.454.CMB.1.raw
  modified_base (350)..(350): a, c, t, g, unknown or other
  misc_feature (350)..(350): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (480)..(480): a, c, t, g, unknown or other
  misc_feature (480)..(480): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggagcaactccaacatcggaagtaattatgtattctggtatcagcaactcccaggaatcggcccccaaatcctcatccagagaataatcagcggccctcaggggtccctgaccgattcnctggctccaagtctggcacctcagccctcctgacccatcgagtggctccggtcgaggatgagctgactattcngtncatccgacgggacncaangtgggatgacatctggagtcgggttggtgttcgggnggtaagggacccaaagtgacccgtcgtaggtc

SEQ ID NO: 24063 - DNA, 622 bp, Homo sapiens
  misc_feature: GYAE6OF01DM4QQ.21.22.B11.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggnagagggtccaccatctcttgtctggagcaactccaacatacggaagttaattatgttattctggtatcagcaactccaggaatccggaccccaactcctcactccagaagaataatcacgccgccctcgacggggtccctgaccgtattcctcgtgcctcaagtctcggccacctcacgtccctccctgacctatcgaggtcgggcctcccgggtacgaggtactggacgtcgtagtacctttattacgtgtcgactacgtaccggaccgggtacaccgaacgtacggtagggtaactacgaacttaacgtcgtaggtacggttccggggtttagggttccgggttaccgggacggggtaaccggtaaccgtaaaccgttgggtaaacccggttccgtacggggtacccg

SEQ ID NO: 24064 - DNA, 562 bp, Homo sapiens
  misc_feature: GYAE6OF01DP4VJ.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgtctggagcaactccaacatcggaagtaattatgtattctggtatcagcaactcccaggaatcggaccccaaactcctcatccagaggaataatcagccggccctcgacggggtccctgaccgtattctctggcctccaagtctggccaccctcacgccctccctacgaccctatcgaggtcgggcctcccgggtcgaggatggaggctgacttattactgtcgctagtccgaacggggacacaacagtgggatacgacatcgtggacggtcgggtttgggtcggttacgggcgggaacgggtaccaaacggtcggaacccgtcgtaggtaccg

SEQ ID NO: 24065 - DNA, 610 bp, Homo sapiens
  misc_feature: GYAE6OF01B2L79.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggcagagggtcaccatctcttgttctggaggcaactccaacatcggaagtaattatgtattctggtatcagcaactcccaggaatcggaccccaaactcctcatccagagaataatcagccgcctcgacggggtccctgaccgtattcctcgtcggcctaccaagtcgtcggccaccctcacgtccctccctgacccatccgaggtcgggccttcccgggtaccgaggtactcggaggtctagacttatttacgtgttcgctagtccgaacggggtacgaccaacgtagtagggaatcggaactaagttcgtaggtacgggttcgggtttggggtcggttaccggggaccgggaaacggggtaaccctaaacggttccggaaccccggttccgtaagggtacccg

SEQ ID NO: 24066 - DNA, 680 bp, Homo sapiens
  misc_feature: GYAE6OF01DWEF8.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagcccaccctcagccgtcgtcggggacccccgggnaggagggtccaccatcttcttgttctggacggcaactccaacagtacggaagttaattatgttattctggtatcagacaactccaaggaactccggacccccaaactcctacactaccgaagaaggaataatcaaggcccgccctcggtacggggtacccctaggaaccgtactttctcgtcggtacctaccgaagttcctcggacctaccctcacgtccccttcccgtacgaaccctacttaccggagggttccgggtcccgttacccggggtccggaagggtacgtgggaacgtcgtaacggtactttaacgttacgtgtacgctaacgtccggaacgggtaccacgtaacgtaggtcgggtaactaggaactaaagtccgtagggcgggttacggggttgggtcggttaccggggaggaaccgggtaaccttaacgacccgggttaccgtcggtacggacccgg

SEQ ID NO: 24067 - DNA, 694 bp, Homo sapiens
  misc_feature: GYAE6OF01C15G6.21.22.B11.1.454.CMB.1.raw
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggcagagggtcaccatctcttgtctggaggcaactccaacatacggaagtaattatgtattctggtatcagcaactccaggaactcgaccccaactccncactcagagaatancagccgcctgacgggtcctagaccgtattcctcgtcgcctaccgaagtctcggcctacctcacgtccctccctgaccctatcgagtcgggtccttccgggtaccgaggtactgggacggtcctcggtaacctttacgttaccgttggtacgtaccgtaacgttacccgggaaaccgggggtaccgaaccgtaaaaccgttagggttacgggggtaacttaccgggtaaaacctaaacgtttccgtaggggtaaaccgggttccgggggtttttagggggttacggggtttacccggggggaccggggtaaacggggtaaacccccgtaaaacgggttccgggtaaacccggttcccggttaacggggtaaccccgg

SEQ ID NO: 24068 - DNA, 511 bp, Homo sapiens
  misc_feature: GYAE6OF01BTT68.21.22.B11.1.454.CMB.1.raw
  modified_base (314)..(314): a, c, t, g, unknown or other
  misc_feature (314)..(314): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (457)..(457): a, c, t, g, unknown or other
  misc_feature (457)..(457): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (502)..(511): a, c, t, g, unknown or other
  misc_feature (502)..(511): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctcgtggctccaagtctggccacctcacgccctccctgaccatcaggtcggcctccgggtccgaggntggaggctgactattacngtgcatcgacgggacncaacgngtgggatgaactatctggagtcgggttgggtcgttcgggcggacgggaccaacgtcgaccgtctaggtcacgccaggcctcgcccctcggcactctcgtcccnccctcctcctcgtctctctgcgcggcncggcaggcncagtcgngnnnnnnnnnn

SEQ ID NO: 24069 - DNA, 304 bp, Homo sapiens
  misc_feature: GYAE6OF01B89LL.21.22.B11.1.454.CMB.1.raw
  modified_base (300)..(304): a, c, t, g, unknown or other
  misc_feature (300)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctcggtcactctcgttcccgcctcctcctcgtctctactgagcggctggcaaggcgcatagnnnnn

SEQ ID NO: 24070 - DNA, 704 bp, Homo sapiens
  misc_feature: GYAE6OF01D9EC5.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaagtaattatgtattctggtatcagcaactcccaggaatcggaccccaaactcctcactccagaggaataatcagccggccctcgacggggtccctgaccgtattcctcgtcggcctaccgaaagttcctcgggaccctaacccgtccgaaccggtccccttaccccgttacggaacccctaagttcccgaacgggttccggggtcccgttccccggggtacccggaagggtaacttcgggaacggttccttacggtaacctttaacgtttaaccgttggtacgacctaacggttacccggaaccgggggtaacctaccgaaacgtaggttacggggaattacgaaccttaaacgtcgttagggacgggttcggggtttaggggttcggttaccggggacgggtaacgggtaaccctaaacggtccggtaacccggttccgtagggtacccg

SEQ ID NO: 24071 - DNA, 556 bp, Homo sapiens
  misc_feature: GYAE6OF01BMPI9.21.22.B11.1.454.CMB.1.raw
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (405)..(405): a, c, t, g, unknown or other
  misc_feature (405)..(405): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaatcctcatccagagaatancagcgcctnaggggtccngacgattcnctggctccaagtctggcacctcacgccctcctgaccatcgagtcggctccggacgagntggaggctgactattcgtgtcgctatcgaacggggtacacaacgtagtggggaactaggactaagtccgtaggacggttcggggtttaggggtcgttaccgggacgggaacgggtaaccaaacggttggaccccgttcggtaaggtacccg

SEQ ID NO: 24072 - DNA, 647 bp, Homo sapiens
  misc_feature: GYAE6OF01ERHX4.21.22.B11.1.454.CMB.1.raw
  modified_base (211)..(211): a, c, t, g, unknown or other
  misc_feature (211)..(211): n is a, c, g, or t
  modified_base (309)..(309): a, c, t, g, unknown or other
  misc_feature (309)..(309): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (385)..(385): a, c, t, g, unknown or other
  misc_feature (385)..(385): n is a, c, g, or t
  modified_base (456)..(456): a, c, t, g, unknown or other
  misc_feature (456)..(456): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnagagggtcaccatctcttgttctggagcaactccaacatcggaagtaattatgtattctaggtatcagcaactccaggactcggacccccaaactccncatccagagaataatcagccgcctcgacggggtcccngaccattcncgtgctcagtctggccactcacgccctccncgacctagtcgtaggtcgggcctcccgggtacgaggtactggaacggtctagtactttattacgtggtacncgtaacgtccggaacggggtaccacgtaaaccgtaggttaggggactagaaacccgttaaagtcccgggtagggtacgggttaccgggggtttggggtttacgggttaccccggggggagggaaacccggggttaaacccctaaacggtttacccgggtacccccgggtttaacgacggggttaaccccgg

SEQ ID NO: 24073 - DNA, 759 bp, Homo sapiens
  misc_feature: GYAE6OF01ACI2F.21.22.B11.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccggnagagggtcaccatctcttgttctggagcaactccaacatcggaagtaattatgtattctggtatcagcaactccaggatcggacccccaatcctcatccagaggaataatcagccggccctcgacggggtccctaggacccgtattcctcgtcggcctaccgaagttccgtggacctacccgtccacggccccttccctaggacccctaattccgagggttccggggtcccttacccggggtacccggaagggtacgttcgggaaaccgggtcctttacggaacccttttaacgtttaaccgttcgggttacggacccgtaacgttacccgggaaacccgggggtacccgaaccgaaaacccgtaggttacggggggaacctttagggaaacccgtaaaacgttcccggttaaggggtaccggggttacccgggggttttgggggttaccgggttttaccccggggggaaaccggggtaaccgggggttaaaaccccctaaaacggtttcccgggggaaacccccgtttcccgggttaacggggtaacccccg

SEQ ID NO: 24074 - DNA, 578 bp, Homo sapiens
  misc_feature: GYAE6OF01C9YWI.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgtctggaggcaactccaacatacggaagtaattatgtattctggtatcagcaactccaggaatcgtacccaaactcctcactccagagaataatcagccggcctcgacgggtccctagaccgattctctggcctcaagtctggccacctcacgtcctccctgacctatcgaggtcgggctcccgggtccgaggatggacggctgacttattacgtgtcgctagtccgacgggtacgacaacgtagtgggatagaactaatcgtaggacggttcgggtttaggggtcggttaccgggacggggaacgggtaaccgtaaacggtcggtaaccccgttccggtaggtacccg

SEQ ID NO: 24075 - DNA, 303 bp, Homo sapiens
  misc_feature: GYAE6OF01EQHIZ.21.22.B11.1.454.CMB.1.raw
  modified_base (297)..(303): a, c, t, g, unknown or other
  misc_feature (297)..(303): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcagcccaaggctgccccctggtcactctcgttcccaccctctcctcgtctctactgagcggctggcaaggcgcatagnnnnnnn

SEQ ID NO: 24076 - DNA, 526 bp, Homo sapiens
  misc_feature: GYAE6OF01EZ36Y.21.22.B11.1.454.CMB.1.raw
  modified_base (347)..(347): a, c, t, g, unknown or other
  misc_feature (347)..(347): n is a, c, g, or t
  modified_base (513)..(518): a, c, t, g, unknown or other
  misc_feature (513)..(518): n is a, c, g, or t
  modified_base (520)..(524): a, c, t, g, unknown or other
  misc_feature (520)..(524): n is a, c, g, or t
  modified_base (526)..(526): a, c, t, g, unknown or other
  misc_feature (526)..(526): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgaggggtccctgaccgattctctggctccaagtctggcacctcagcctccctgaccatcagtgggcctccggtccgaggatgaggctgactattactgtgcatcgacgggacacaacgngtgggatgaacaatcgtgagtcgggttggtgttcgggcgggaggaccaacgtcgaccgtcgtaggtcacgcccgaaggcctcgcccccgtcgtccactcctcgttccccaccctccgtccgacgccgacgtactcggacgcggcgtcggcgacggcgacgagtcgnnnnnncnnnnngn

SEQ ID NO: 24077 - DNA, 314 bp, Homo sapiens
  misc_feature: GYAE6OF01EJYTR.21.22.B11.1.454.CMB.1.raw
  modified_base (302)..(304): a, c, t, g, unknown or other
  misc_feature (302)..(304): n is a, c, g, or t
  modified_base (306)..(314): a, c, t, g, unknown or other
  misc_feature (306)..(314): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggcctcgccccctggtcactctcgttccccgcctcctccgagcgacgactgagcgggctggcaaggcgcatagnnngnnnnnnnnn

SEQ ID NO: 24078 - DNA, 577 bp, Homo sapiens
  misc_feature: GYAE6OF01A6MNY.21.22.B11.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagaggtcaccatctcttgtctggagcaactccaanatcgaagtaattatgtattctgtatcagcaactcccaggaactcggacccccaaactcctcactccagaaggaataatcgagccggtccctcgacggggtccctagacccgtattcctctcggtcctaccgaagtcgtacggccacctcacgccctcccacgaccatcgaggtcggcctccggtcgagatggagtctagacttattacgtgtgcagtcgaccggacacaagtgtagggataggaactatcgtaggtaggtcgggtttagggtcggttcgggacgggtacgggtaacctaaacggtccggaacccgttccggtaaggtacccg

SEQ ID NO: 24079 - DNA, 549 bp, Homo sapiens
  misc_feature: GYAE6OF01ELATY.21.22.B11.1.454.CMB.1.raw
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactccaggatcggaccccaactcctcatccagagaataatcagcggccctcgaggggtccctgaccgtattcctctcggctccaagtctggcacctcagcccttccctgacccatcgaggtcggcctccgggccgaggatggagctgactattacngtcncatcgacggganccaacngtagggatgactaagtcgtggtacggtggggttgggtcggttcgggacgggaagggaaccctaaacgtcggaacccggttcgtagggaccg

SEQ ID NO: 24080 - DNA, 517 bp, Homo sapiens
  misc_feature: GYAE6OF01BS3IX.21.22.B11.1.454.CMB.1.raw
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (505)..(517): a, c, t, g, unknown or other
  misc_feature (505)..(517): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctcagggtccctgaccgattctctggctccaagtctggcacctcagccctccctgaccatcagtgggcctccggtccgaggatggaggctgacttattactgtgcatcgacgggacncaacngtgggatgacaatctgagcggttggtgtcggcggagggaccaacgtcgaccgtctacggtcacgcccgaaggcctcgcccctcggtcctactcctcgttcccgccctcctcccgggtctccgtctacgtcgacgcggctggccgaacggcgacagtcgnnnnnnnnnnnnn

SEQ ID NO: 24081 - DNA, 610 bp, Homo sapiens
  misc_feature: GYAE6OF01A2Z45.21.22.B11.1.454.CMB.1.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (322)..(322): a, c, t, g, unknown or other
  misc_feature (322)..(322): n is a, c, g, or t
  modified_base (356)..(356): a, c, t, g, unknown or other
  misc_feature (356)..(356): n is a, c, g, or t
  modified_base (488)..(488): a, c, t, g, unknown or other
  misc_feature (488)..(488): n is a, c, g, or t
  modified_base (510)..(510): a, c, t, g, unknown or other
  misc_feature (510)..(510): n is a, c, g, or t
tcagtcgtcgctcgcacgaccggtgctcgatttagacgacagctcagggggggaaggcgtcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnaggacgggtcaccatctcttgttctggagcaactcaacntacggaagtaattatgtattcnggtatcagcaactccaggaactcggacccccaatcctcatcagagaatancagcgcctacgacggggtccctgaccgtattccncgtcggctccaagtcgtggcacctcacgccctccctagaccatccagggttcggccctccgggtaccggagagttacggagggtccctagtaacttagttacctagtcgactaacggtcccaacgggggacnccgaaaatcggttggaacgttnaaacctaaggttaccctgggaacgttgggggtttacggtcggttaccggggaacgaacggggtaaccctaaacgggcgttaccccgtccttaaggggacc

SEQ ID NO: 24082 - DNA, 783 bp, Homo sapiens
  misc_feature: GYAE6OF01AG1ZE.21.22.B11.1.454.CMB.1.raw
  modified_base (242)..(242): a, c, t, g, unknown or other
  misc_feature (242)..(242): n is a, c, g, or t
  modified_base (481)..(481): a, c, t, g, unknown or other
  misc_feature (481)..(481): n is a, c, g, or t
  modified_base (612)..(612): a, c, t, g, unknown or other
  misc_feature (612)..(612): n is a, c, g, or t
tcagtcgtcgctcgcacgaccggtgctcgatttagacgacagctcagggggggaaggcgtcagcttcagctgtggtagagaagacaggactcaggacaatctccagcatggccggcttcctctcctctcaccctcctcactcactcgcgcagggtcctcgggccacgtctgtgctgactcacgccacctcagcgtcgcgggaccccggcgacgagggtccaccactctcgttgttcctgggngaccgaactccaactagtaccggaagtaattagtcgttacttcgttaggtacttacgacgactaacctaccccgaagggtaacttaccgggacccccctaaacgtaccctaccacgttacccaaggtaacggaaacttaaacgtcaacggtcccggacccgttccgaacgggggttccccgttacggaacccgtaactttcgtaccggttcgaccggtttacctaaacgggtttcccgngggtaacccctaccttaccgaacccgttcccctcccgttaccgaaacccgttgttaccgtaacgggtcggttacccggtcccggggtttacgaccggtacgtcggtagggaccttagaccctttaacgttntcggttacgaactcggtaccgaccggggtactaccgaacgtaggtacggaactagtaacaccgtaccggtaaggttcgggcggggtttcggggttaccggttacgggggtacccgggaaccgggtaacgttaacccgggaccttaacccggggtttcgcggttaaaccggg

SEQ ID NO: 24083 - DNA, 506 bp, Homo sapiens
  misc_feature: GYAE6OF01DM5FH.21.22.B11.1.454.CMB.1.raw
  modified_base (226)..(226): a, c, t, g, unknown or other
  misc_feature (226)..(226): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (469)..(469): a, c, t, g, unknown or other
  misc_feature (469)..(469): n is a, c, g, or t
  modified_base (485)..(485): a, c, t, g, unknown or other
  misc_feature (485)..(485): n is a, c, g, or t
  modified_base (493)..(498): a, c, t, g, unknown or other
  misc_feature (493)..(498): n is a, c, g, or t
  modified_base (501)..(506): a, c, t, g, unknown or other
  misc_feature (501)..(506): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagagaataatcagcggccctnagggtccctgaccgattctctggctccaagtctggcacctcagcctccctgaccatcagtcgggctccggtccgaggatggaggctgactattactgtncatccgacggacncaacagtggggatgaactaatctggagtcgggtttgggtgttcgggacgggagggaccaaacgtcgaccgtcgtaggcacgcccaaggctcgccctcggtcactctcgtcccncctccncctcgtctctcngcgcggctggcaggcncagtacgnnnnnntcnnnnnn

SEQ ID NO: 24084 - DNA, 650 bp, Homo sapiens
  misc_feature: GYAE6OF01DAU9Y.21.22.B11.1.454.CMB.1.raw
  modified_base (211)..(211): a, c, t, g, unknown or other
  misc_feature (211)..(211): n is a, c, g, or t
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnaggagggtcaccatctcttgttctggaggcaactccaacatacggaagtaattatgttattctggtatcagcaactcccaggaactccggaccccaaactcctnaactccaagaggaaataancgacgccggccctgacggggtccctgaccgtattcncgtcggactaccgaagtcgtcggcctacctcacgtccctcccgtcgacctaatcgacggtcgggccttcccgggtccggacggtagtcggacggtctagtaacctttaagttacgtgtcgactataccggaacgggacgacaaacgtaggtacgggattacggaactaagtccgtagggacgggttcggggtttgggggttcgggttaccggggaccggggaacggggtaaccccgttaaaacggtcccgggtaaacccggttcccgtaaggggtacccg

SEQ ID NO: 24085 - DNA, 574 bp, Homo sapiens
  misc_feature: GYAE6OF01BZY0E.21.22.B11.1.454.CMB.1.raw
  modified_base (207)..(207): a, c, t, g, unknown or other
  misc_feature (207)..(207): n is a, c, g, or t
  modified_base (243)..(243): a, c, t, g, unknown or other
  misc_feature (243)..(243): n is a, c, g, or t
  modified_base (415)..(415): a, c, t, g, unknown or other
  misc_feature (415)..(415): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccgggnagaggtcaccatctcttgttctggagcaactcaacntcggaagtaattatgtattctggtatcagcaactcccaggaatcggacccccaaactcctcatccagaggaataatcagcgccctcgacggggtccctgaccgtattctctcggctccaagtcctggccacctcacgcctcctgaccagtcaggtcggctccggtcgaggtntgaggtctagtacttattactgtgctagtcgaccggggtacaccaacgtagtgggatacggaactaagttccgtgggacggttccgggttggggttcggttacggggacgggaacgggtaaccctaaacggtcggaccccggttccgtaagggtacccg

SEQ ID NO: 24086 - DNA, 631 bp, Homo sapiens
  misc_feature: GYAE6OF01DJQL0.21.22.B11.1.454.CMB.1.raw
  modified_base (610)..(610): a, c, t, g, unknown or other
  misc_feature (610)..(610): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (622)..(622): a, c, t, g, unknown or other
  misc_feature (622)..(622): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggccccaaatcctcatccagaggaataatcagcggccctcgacggggtccctgaccgattctctggctccaagtctggcacctcagcctccctgacctatcaggtcggctccggtccgaggatgaggctgactattactgtgcatcgacgggacgactaaaagtggggaatgaacaaagttcgtaggtaggtcgggtttgggtggtttaccgggcgggaacgggtaccctaaacgttcgggtaacccggttaccgttaacgggtaccaacggccccgaaagggtccctcccggccccccttcgggtaccctaccgttccgttccgtttacccccaccccgttccctcccgttccgtcccttccgtaaccgtggaccggtccgggtcgttcggaccgtaaaccgggcgaccgtacgtacggcgtancgtcgngnctcncancngngn

SEQ ID NO: 24087 - DNA, 555 bp, Homo sapiens
  misc_feature: GYAE6OF01C3TMW.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactccaacatacggaagtaattatgtattctggtatcagcaactccaggaatcggaccccaactcctcactccagagaatatcagcgcctgacggggtccctgaccgtattctctggctccaagtctggcacctcacgccctccctgacccatcaggtcggcctccgggtaccgaggatcggaggtcctgtaacttatttacttgctaagtccgaacgggtacgcaacgagttcgggatgaactaatcgtagaggtcggttgggtcgttcgggacgggtaacggacctaaacgtcggacccgtactagggtcaaccgg

SEQ ID NO: 24088 - DNA, 796 bp, Homo sapiens
  misc_feature: GYAE6OF01AGNMG.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggagcaactccaacatacggaagtaattatgtattctggtatcagcaacctccaaggaactcggacccccaaactcctcactccaagaggaatatcgagccggccctcgacggggtcccctagaccgtattccgtcgtcggcctacgtaacgtctcgggcctacccgtccaccgtccccttcccgtacgaaccctacgtccgtacgggttccgggtccgttacccggggtaccgaagggtacgttcgggtaacgggcccgtttacggtaaccgtttaacgttttaacccggtggtttaccggaccctttaacggtaccccggggtaaaccgggggtaaccccggtaaccgtaaaacggttaccgggttagggggtaaaccttacggaaaccgttaaaccggttccgggttaacggggttaaccggggtttccgggggggttttaggggggttcccggggtttaacccgggggggacggggaaaacccgggggttaaaccccgttaaaccgggttaacccggggttaaccccccgggtttaccggttaaacggggtaccccggg

SEQ ID NO: 24089 - DNA, 548 bp, Homo sapiens
  misc_feature: GYAE6OF01B3Y53.21.22.B11.1.454.CMB.1.raw
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagaggtcaccatctcttgtctggagcaactccaacatcggaagtaattatgtattctggtatcagcaactccagatcggccccaactcctcatccagagaataatcagccggccctcgacggggtccctagaccgattctcgtcggctccgaagtctggccacctcacgccctccctgaccctatccaggtcggccgtcccgggtcgaggatgaggcctgtacttattactgtgcatcgaccgggacncaangtggatcgaacatcgtaggacggtcgggttgggtcggttcgggacgggacgggaaccctaaacgtcgacccgttacgtggtacccg

SEQ ID NO: 24090 - DNA, 532 bp, Homo sapiens
  misc_feature: GYAE6OF01AV013.21.22.B11.1.454.CMB.1.raw
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (519)..(520): a, c, t, g, unknown or other
  misc_feature (519)..(520): n is a, c, g, or t
  modified_base (523)..(532): a, c, t, g, unknown or other
  misc_feature (523)..(532): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaatcctcatccagaggaataatcagcggccctcaggggtccctgaccgattctctggctccaagtctggcacctcagccctccctgaccatccagtcggctccggtccgaggatgaggctgactattactgtgcatcgacgggcncaacngtgggatgacaatcgtgaggtcggttgggtgttcgggacggagggaccaacgtcggaccgtcgtaggtcacgcccgaaggcctccgccccctcggtcctactcctcgttccccaccctcccgtcccgacgccgaccgtactcggacggcggcgtcggcgaaggccgacgagtagnngcnnnnnnnnnn

SEQ ID NO: 24091 - DNA, 670 bp, Homo sapiens
  misc_feature: GYAE6OF01DN0IM.21.22.B11.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtcaccatctcttgttctggaggcaactccaacatacggaagtaattatgtattctggtatcagcaactcccaggactcgaccccaactcctcatccagagaatancagcgcctcgagggtccctgaccgtattctcgtggcctacaagtctcggcaccctcacgtccctccgtacgaccacgtcgacggtcggggtccttacccgggtaccgagggtattcggaacggtccgttacggaacgtttaactttaccgtaggttcgacctaagttacccggaaccggggtaaccgacccgtaaacgtaggttcggggaaatttaccggaaaccgttaaacgttccggtagggtaacggggttccgggggttttaggggggttccgtttacccggggggacgggtaaaccggggaacccttaaaaccggtggtaacccccggttcgtaacgggtacccg

SEQ ID NO: 24092 - DNA, 527 bp, Homo sapiens
  misc_feature: GYAE6OF01CMYU1.21.22.B11.1.454.CMB.1.raw
  modified_base (249)..(249): a, c, t, g, unknown or other
  misc_feature (249)..(249): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (514)..(515): a, c, t, g, unknown or other
  misc_feature (514)..(515): n is a, c, g, or t
  modified_base (517)..(517): a, c, t, g, unknown or other
  misc_feature (517)..(517): n is a, c, g, or t
  modified_base (519)..(527): a, c, t, g, unknown or other
  misc_feature (519)..(527): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagccggccctcaggggtccctgaccgattcnctggctccaagtctggcacctcagcctccctgacccatcaggtggcctccgggtccgaggntgaggctgactattacngtgcatcgacgggacgcaacagtgggatgaacaatctgagcggttggtgttcggcgggagggaccaacgtcgaccgtccgtaggtcacgcccgaaaggcctcgcccccgtcggtccactcctcgttcccacccctcctcccacgccgaccgactgacggcgggctgggccgaaggccgacacgtagnncngnnnnnnnnn

SEQ ID NO: 24093 - DNA, 717 bp, Homo sapiens
  misc_feature: GYAE6OF01EUQHE.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaattatgtattctggtatcagcaactcccaggaactcggacccccaaactcctcactccagaggaataatcagccggccctcgacggggtccctgaccgtattcctcgtcggcctaccgaaggttcctacgggcctaacccttcgacgtccccttaccccgtcgaacccctagtccgaacgggttcggggtcccttacccggggtacccggaagggtagttacgggaacgggtccttacggtaacctttacgtttaaccgtggtacgaccgtaacgttccggaacccgggggaccgtaccaaacgtacggttaggggaacttacgggaaacctaaacgttcgttacggggtaacgggttccgggggttttagggggttcggtttaccgggggtaggggtaaacccggggtaaccctaaaacggttccgggtaaccccggtttacccggtacgggtaacccg

SEQ ID NO: 24094 - DNA, 306 bp, Homo sapiens
  misc_feature: GYAE6OF01EET2I.21.22.B11.1.454.CMB.1.raw
  modified_base (302)..(306): a, c, t, g, unknown or other
  misc_feature (302)..(306): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtgaccgtcctaggtcagcccaaggctcgccccctcggtcactctcgttcccaccctcctcctcgtctctactgagcggctggcaaggcgcatagnnnnn

SEQ ID NO: 24095 - DNA, 304 bp, Homo sapiens
  misc_feature: GYAE6OF01BZ88Q.21.22.B11.1.454.CMB.1.raw
  modified_base (294)..(294): a, c, t, g, unknown or other
  misc_feature (294)..(294): n is a, c, g, or t
  modified_base (300)..(304): a, c, t, g, unknown or other
  misc_feature (300)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctgttcccgccctcctcctcgtctctactgagcgggctggcaaggcncatagnnnnn

SEQ ID NO: 24096 - DNA, 554 bp, Homo sapiens
  misc_feature: GYAE6OF01B0K2D.21.22.B11.1.454.CMB.1.raw
  modified_base (209)..(209): a, c, t, g, unknown or other
  misc_feature (209)..(209): n is a, c, g, or t
  modified_base (435)..(435): a, c, t, g, unknown or other
  misc_feature (435)..(435): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggacccccaaactcctcatccagagaataatcagcgccctgacggggtccctgaccgattctctggctcaagtctggcacctcacgtccctccctgacccatcaggtcggcctccggtcgaggatggagctgactattctgtncagtcgacgggtacnctaacgngtagggatcggaacaagtcgtaggacggtggggtttgggtcggttacgggacgggtaacgggtaaccctaacgtcggacccgttccgtaggtacccg

SEQ ID NO: 24097 - DNA, 685 bp, Homo sapiens
  misc_feature: GYAE6OF01CCKWH.21.22.B11.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcaggtcctgggcccagtctgtgctgactcagccaccctcagcgtctcgggacccccggnagagggtcaccatctcttgttctggagcaactccaacatcggaagtaattatgtattctggtatcagcaactccaggaatcggaccccaaatcctcatccagagaataatcagccgccctgacggggtccctgaccgtattcctcgtgcctaccgaagttcctggccaccgtcacgtcccctcccgtagaccctagtcgagggttcgggccttcccggggtaccgaaggtacgtacggaacgggtccttaggtaacctttaagtttaccgtggttcgaccgtaagttcccgggaaaccgggggtaccgacctaaaaccggtaggttacgggggaaacttacgggtaaaccctaaagtttcccgtagggtaccgggttacgggggtttcgggggttcggtttacccgggggaccgggtaaacggggtaacccctaaaacggttccgggtaaaccccggtttccggttaagggtaccccg

SEQ ID NO: 24098 - DNA, 551 bp, Homo sapiens
  misc_feature: GYAE6OF01AIUWM.21.22.B11.1.454.CMB.1.raw
  modified_base (346)..(346): a, c, t, g, unknown or other
  misc_feature (346)..(346): n is a, c, g, or t
  modified_base (389)..(389): a, c, t, g, unknown or other
  misc_feature (389)..(389): n is a, c, g, or t
  modified_base (465)..(465): a, c, t, g, unknown or other
  misc_feature (465)..(465): n is a, c, g, or t
  modified_base (506)..(506): a, c, t, g, unknown or other
  misc_feature (506)..(506): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtaattatgtattctggtatcagcaactcccaggaactcggacccccaactcctcatccagaggaatatcagccggccctcgacggggtcccngaccgtattctctggcctcaagtctggcacctcacgccctccngaccatcaggtcgggcctcccgggtccgaggactggacggtctgacttattacgtgtcgcaagtccgacgggaccnaacgagtcggatcgactatcgtaggacggtgggttggggtnttccgggaggtacgggacctaaacgtcggacccgtcgtagggtcc

SEQ ID NO: 24099 - DNA, 302 bp, Homo sapiens
  misc_feature: GYAE6OF01ELQWM.21.22.B11.1.454.CMB.1.raw
  modified_base (299)..(302): a, c, t, g, unknown or other
  misc_feature (299)..(302): n is a, c, g, or t
tcagtcgtcgctcgcacgaccggtgctcgatttagacgacagctcagggtccctgaccgattctctggctccaagtctggcacctcagcctccctgaccatcagtgggctccggtccgaggatgaggctgactattactgtgcatcacgggacgcgaacatgggatgacaatctgagcggttgggtgttcggcggagggaccaaactgaccgtcctaggtcagcccaaggctgccccctggtcactctgttcccgccctcctcctcgtctctactgagcgggctggcaaggcgcatagnnnn

SEQ ID NO: 24100 - DNA, 724 bp, Homo sapiens
  misc_feature: GYAE6OF01BVMHX.21.22.B11.1.454.CMB.1.raw
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggaccccggcagagggtcacatctcttgtctggagcaactcaacagtacggaagttaattatgtattcgtggtatcagcaactccgaaggtaactcggaccccctaaaactcctacaactccgaagaacggtaaattaactcgaacggcccggtaccctacggaaccgggggttcccctacggaacccggtactttccgtaccgttcgggacccttacccgtaaacgttccgttacgggaccctaaacccgtccgtaacggtcccccttacccgtacggaaacccttaacgtccgtaacgggttcgggtacccgtacccgggttacccggaagggtacttcgggaacggtccttacggtaacctttacgtttacgtgtacgacctacgttaccggaccggggtacaccgtaacgtaggttagggactacggaacctacgttcgtagggacggttcgggttgggtacggttaccgggacggaaacgggtaaccctaacggtcggtaccccggttgtacggtaccgg

SEQ ID NO: 24101 - DNA, 630 bp, Homo sapiens
  misc_feature: GYAE6OF01D4RAR.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagaggtcaccatctcttgtctggagcaactcaacatcgaagtaattatgtattctgtatcagcaactccaggaactcggaccccaaactcctcactccagagaataatcagccggccctcgacggggtccctaggaccgtattctcgtcggcctaccgaagttccgtcggccacccgtcacgtcccttacccgtgaacccagtccgaagggttcgggccgttacccgggtaccggaagggtacttcggacgggtccttagtaacctttaagtttacgtggtacgacctaagtccgaacggggacacaacgtagtgggaatacggaactaagttccgtaggacgggttccgggtttaggggtcgttaccggggacgggaacgggtaaccctaaacggtcgaaccccggttgtacggtaccg

SEQ ID NO: 24102 - DNA, 299 bp, Homo sapiens
  misc_feature: GYAE6OF01EODM9.21.22.B11.1.454.CMB.1.raw
  modified_base (155)..(155): a, c, t, g, unknown or other
  misc_feature (155)..(155): n is a, c, g, or t
  modified_base (292)..(299): a, c, t, g, unknown or other
  misc_feature (292)..(299): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacncaacatgggatgacaatctgagcggttggtgttcggcggaggaccaactgaccgtctaggtcagcccaaggctcgcccctgtcactctcgttcccgcctcctcctcgtctctactgagcggctgcaagcgtcatagnnnnnnnn

SEQ ID NO: 24103 - DNA, 698 bp, Homo sapiens
  misc_feature: GYAE6OF01CL1L6.21.22.B11.1.454.CMB.1.raw
  modified_base (334)..(334): a, c, t, g, unknown or other
  misc_feature (334)..(334): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccgggcaggagggtcaccattctcttgttctggaggcaactccaacatcggaagtaattatgtattctggtatcagcaactcccaggaactcggacccccaaactcctacactccaagaaggaataancagccggccctgacggggtctcgtgacccgtatttcctcgtcggtcctaccgaaagttccgtcggaccctaccctcgtaccgccccttccctacgaccctatccgaaggtcgggccttccccgggtacggagggacgttggacggtccttaggtaaccttaagtttaccgtgggtcgaccgtacgttaccgggaaccgggggtaccacgaaaccgtaggttacggggaacttacggaaacctaaagttccggttacgggtaaggggttccgggggttttaggggtccgggtttacccgggggaccggggtaaacggggtaacccctaaaaccggtcggtaacccccgggttccgtaaaccgggg

SEQ ID NO: 24104 - DNA, 568 bp, Homo sapiens
  misc_feature: GYAE6OF01CD9L8.21.22.B11.1.454.CMB.1.raw
  modified_base (209)..(209): a, c, t, g, unknown or other
  misc_feature (209)..(209): n is a, c, g, or t
  modified_base (304)..(304): a, c, t, g, unknown or other
  misc_feature (304)..(304): n is a, c, g, or t
  modified_base (501)..(501): a, c, t, g, unknown or other
  misc_feature (501)..(501): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactccaggaatcggacccccaatccncatccagagaataatcagccggccctgacggggtccctagaccgtattctcgtcggcctaccgaagtctggcctacctcacgtccctcctacgaccctatcgaggtcgggctcccgggtccgaggatggacggtctagacttattacgtgtgctagtcgacggggcacaacgagtgggatggaactaatcgtacggnggttcgggttgggtcggttcgggacgggaacgggtaacccaaacgtcggacccgttcgtaagggtcc

SEQ ID NO: 24105 - DNA, 579 bp, Homo sapiens
  misc_feature: GYAE6OF01E1S4Z.21.22.B11.1.454.CMB.1.raw
  modified_base (209)..(209): a, c, t, g, unknown or other
  misc_feature (209)..(209): n is a, c, g, or t
  modified_base (396)..(396): a, c, t, g, unknown or other
  misc_feature (396)..(396): n is a, c, g, or t
  modified_base (453)..(453): a, c, t, g, unknown or other
  misc_feature (453)..(453): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccggnagagggtcaccatctcttgttctggaggcaactccaacatcggaagtaattatgtattctggtatcagcaactccccaggaatcggacccccaaatcctcatccagagaataatcagccggccctcgacgggggtccctggaccgattctctggcctccaagtcctggccaccctcacgccctcccngacccatcaggtcgggcctcccgggtcgaggatggacggcttagacttagtttaccngtgcatccgaacggggacncaacngtacggggatacgaactaaatcgtaggacggttcggggttggggtcggttccggggacgggaacgggtacccaaacggtcggtacccgttcgtagggtaccg

SEQ ID NO: 24106 - DNA, 715 bp, Homo sapiens
  misc_feature: GYAE6OF01BIOH9.21.22.B11.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacntcggaagtaattatgtattctggtatcagcaactcccaggaactcggacccccaaactcctacactccgagacggaataactcagccggccctacgacggggttccctaggaccgtattccgtactcgggcctaccgtaacgtccgtcgggacctaacccgttcgacggtccccttaccccgtaggaacccctaagttccggtaacgggttccggggtacccttccccggggtaccggaagggtacttcgggaacgggtcccttaacggtaacctttaacgtttaaccgtggttacgaccgtaacggttaccggaacccgggggtaccaccgtaaacgtaggtacggggaacttacggaactagtccggttagggacggttccggggtttaggggtcggttaccggggacgggtaaaccgggtaaccctaaaacggttccggaacccggttccggtaacgggtacccg

SEQ ID NO: 24107 - DNA, 596 bp, Homo sapiens
  misc_feature: GYAE6OF01DL9DL.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaacctccaacatacggaagtaattatgtattctggtatcagcaactcccaggaatcggaccccaaactcctcactccagaggaaataatcacgccggccctcgacggggtccctggaccgtattcctctggctccaagtctggccacctcacgcctccctacgaccatcgagtcgggtcctccgggtcgaggatcgagctagaccttattacgtgtcgactactcgacgggacgccaagtagtagggacttgaaacctaagttcgtaggtacggtacggggtttcggggttcggttacggggacgggtaaacggggaacccctaaacgtcggtaacccggttccgtaacgggtaccg

SEQ ID NO: 24108 - DNA, 349 bp, Homo sapiens
  misc_feature: GYAE6OF01D3RTG.21.22.B11.1.454.CMB.1.raw
  modified_base (306)..(307): a, c, t, g, unknown or other
  misc_feature (306)..(307): n is a, c, g, or t
  modified_base (309)..(310): a, c, t, g, unknown or other
  misc_feature (309)..(310): n is a, c, g, or t
  modified_base (312)..(349): a, c, t, g, unknown or other
  misc_feature (312)..(349): n is a, c, g, or t
tcagtcgtcgctcgcacgaccggtgctcgatttagacgacagctcagggggtccctgaccgattctctggctccaagtctggcacctcagcctccctgaccatcagtgggctccggtccgaggatgaggctgactattactgttgcatcacgggtacgcaacatgggatgacaatctgagcggtggtgtcggcggaggaccaaactgaccgtccgtaggtcagcccgaaggctcgccccctggtccactctcgttcccacctcctccgagcgtacgactgacgcggctggcaagggcaccatacgnnanngnnnnnnnnnnnnnnnnnnnnnnnnnnnnnnnnnnnnnn

SEQ ID NO: 24109 - DNA, 304 bp, Homo sapiens
  misc_feature: GYAE6OF01BAMA8.21.22.B11.1.454.CMB.1.raw
  modified_base (299)..(304): a, c, t, g, unknown or other
  misc_feature (299)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctcgttcccaccctcctcctcgtctctactgagcggctggcaaggcgcatagnnnnnn

SEQ ID NO: 24110 - DNA, 816 bp, Homo sapiens
  misc_feature: GYAE6OF01DU6LQ.21.22.B11.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctcgggcccagtctgtgctgactcacgcccaccctcacgcgtccgtccggggacccccgggnaggacgggtccaccatcttctttgttcgtggacggaccaactccaaacagtacggtaaagttaattatgttattcgtggtatcgacgacaacctaccgaaggaactccggacccccaaacttcctacactaccaaggaagtaaattaactcaacggcccggtaccctcggaaccgggggtccctacggaacccgttacttccgtccgttacggacccttaccgtaacggttccgtcggaccctacccgttaccaccggtccccttacccgtacgaaccctagtaccgtacggggtccgggtcccgttacccggggtaccggaggtacgtacgggtacggtccgttacggtaaccttttaacgttacgtacggtacgtaccgtaacggttaccgggaaaccgggggtaacctaaccgtaaacggttacgggtacggggtaactaaccggtaaacgtaaacgttcggtacgggtacggggtttaccgggggtttacgggggttacggggttacccgggggtaaccgggggaaacccgggtaaaacccgttaaaccggtaccgggtaaacccccgggtttccggtaaacgggtaaccccgg

SEQ ID NO: 24111 - DNA, 580 bp, Homo sapiens
  misc_feature: GYAE6OF01AO6GO.21.22.B11.1.454.CMB.1.raw
  modified_base (209)..(209): a, c, t, g, unknown or other
  misc_feature (209)..(209): n is a, c, g, or t
  modified_base (478)..(478): a, c, t, g, unknown or other
  misc_feature (478)..(478): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgtctggagcaactccaacatcggaagtaattatgtattctggtatcagcaactccaggaatcggacccccaatcctcatccagagaataatcagccggccctcgacggggtccctagaccgtattctcgtcggctccgaagtccgtaggcctacctcacgtccctccctagaccatccgaggtcgggcctccgggtccgaggatggacggctagaccttagttactggtacgcctagtccgaccgggtacnctaacgagtagggatcgactacgtcgtaggtaggtcgggtttgggtcggttacgggcgggtaacgggtaaccctaaacggtggacccgttcgtaggtacccg

SEQ ID NO: 24112 - DNA, 654 bp, Homo sapiens
  misc_feature: GYAE6OF01E29CV.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtcaccatctcttgttctggaggcaactccaacatcggaagtaattatgtattctggtatcagcaactcccaggaatcggacccccaaactcctcatccaggagaataatcagccggccctcgacggggtccctggacccgtattcctcgtggccttaccaagttcctcggacctacccgttcacgtccccttccctagaccctagtcgaggtcgggccttcccgggtcgtaagggacttcgggaacgggtcctaggaacctttacgttactgggtcgacctaacgtcccggaaccggggacctacgaaaccgtaggtacgggtactacggaaacctaaagtccgtagggtacgggttcggggtttgggtcgggtttaccggggaccgggtaacggggtaacccctaaacggttccggaccccgttcgtagggtacccg

SEQ ID NO: 24113 - DNA, 813 bp, Homo sapiens
  misc_feature: GYAE6OF01DEKOB.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccggcagagggtcaccatctcttgttctggagcaactccaacatacggaagtaattatgtattctggtatcagcaactcccgaaggaactccggacccccaaactcctacactaccgaagaaggaaataactccgaacggcccgggaccccttacggaaccgggggttcccctacggaacccgtacgtttccgtcgtcgggaccttacccgtaaggttccgttaccgggaccctaacccgttcccgaaccggtcccccgtttaccccgtacgggtaaccccaacgtttacccgggaacggggtttcccgggggtcccctttaccccggggggtacccgggtaaagggtacgttacgggaaccgggtccgtttacgtaaaccgttaacttttaccggtggttaccggacctaaccggtcccggaaacccgggggtaccctaaccgtaaaaccgtgggttaacggggaacttacggaaaccttaagttcccggttaggggtaacgggttcggggggttttagggtccggggtttacgggggaacccgggtaacggggaaacccccttaaacgggtccggtaaccccgggttcccggtaagggtacccccgg

SEQ ID NO: 24114 - DNA, 695 bp, Homo sapiens
  misc_feature: GYAE6OF01DMUJH.21.22.B11.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagaggtcaccatctcttgtctggagcaactcaacatcggaagtaattatgtattctggtatcagcaactcccaggaactcggacccccaactcctcactccaagaggaataactcagccggccctagaccggggtccctgaccgtattcctcgtacggcctaccgaagtcctggcctaccctcaccgtcccttcccgtagaccctagtccgagggttcgggtacccgttcccgggtaccggaggtacgttcgggaacgggtccttaggtaacctttaacgttcgttggttcggacctaacgttacccggaaacccgggggtaaccacgtaaaccggtaggttacgggggaattacgggaaacccaaagtttcccggtaaggggtacggttcccggggggttttggggttaccggttcccgggggaacgggtaaccgggtaaccctaaaacgggttccggaaccccgggtttcggtaacggtacccggg

SEQ ID NO: 24115 - DNA, 589 bp, Homo sapiens
  misc_feature: GYAE6OF01BKIV4.21.22.B11.1.454.CMB.1.raw
  modified_base (212)..(212): a, c, t, g, unknown or other
  misc_feature (212)..(212): n is a, c, g, or t
  modified_base (378)..(378): a, c, t, g, unknown or other
  misc_feature (378)..(378): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
  modified_base (483)..(483): a, c, t, g, unknown or other
  misc_feature (483)..(483): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccgggnaggagggtcaccatctcttgttctggaggcaactccaacatcggaagtaattatgtattctggtatcagcaactccccaggaatcggaccccaactcctcatccagagaataatcagccgccctcgacggggtccctgaccgtattcctcgtggcctccaagttcncggccacctcacgccctccctgacccntcgaggttcgggcctccgggtccgaggntggacggcttgacttattacgtgtcgactagtccgacgggtacacaacgnggtgggaatcggaactagtcgtggaggtcggggtttggggtcggttccggggacgggtaacgggtaacccgtaaacgttccgggaacccgttccggtaaggtaccg

SEQ ID NO: 24116 - DNA, 536 bp, Homo sapiens
  misc_feature: GYAE6OF01BT5GH.21.22.B11.1.454.CMB.1.raw
  modified_base (209)..(209): a, c, t, g, unknown or other
  misc_feature (209)..(209): n is a, c, g, or t
  modified_base (417)..(417): a, c, t, g, unknown or other
  misc_feature (417)..(417): n is a, c, g, or t
  modified_base (453)..(453): a, c, t, g, unknown or other
  misc_feature (453)..(453): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaagtaattatgtattctggtatcagcaactcccaggaatcggacccccaaactcctcatccagagaataatcagcgccctcgacggggtccctgaccattctcgtggctccaagtctgcacctcacgcctccctgacccatcgagtcgggcctccggtccgaggntggagctagacttatactgtgcagtccgacgggacncaacagtgggatgactagtcgtgaggtcgggttgggtcgttcgggacggacgggtaaccaacgtgacccgttcgtaggtaccg

SEQ ID NO: 24117 - DNA, 308 bp, Homo sapiens
  misc_feature: GYAE6OF01D22ZW.21.22.B11.1.454.CMB.1.raw
  modified_base (301)..(308): a, c, t, g, unknown or other
  misc_feature (301)..(308): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagtcggttgggtgttcggcggagggaccaaacgtgaccgtcctaggtcagcccaaggctcgcccctggtcactctcgtcccaccctcctcctcgtctctactgagcgggctggcaaggcgcatagnnnnnnnn

SEQ ID NO: 24118 - DNA, 572 bp, Homo sapiens
  misc_feature: GYAE6OF01AS37I.21.22.B11.1.454.CMB.1.raw
  modified_base (210)..(210): a, c, t, g, unknown or other
  misc_feature (210)..(210): n is a, c, g, or t
  modified_base (481)..(481): a, c, t, g, unknown or other
  misc_feature (481)..(481): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactccaggaatcggaccccaactcctcatccagagaatatcagcggccctcgacggggtccctgaccgtattctcgtcggcctaccgaagttcgtggcctacctcacgtccctccctgacccagtccgaggtcggccttccgggaccgaggactggacgtctagtacttattactgtcgcagtccgacgggtacacaacgngtaggatcgaactagtcgtaggcggtcggggttggtcggttccgggacggaacggtaaccctaacgtcggaccggttcgtacgggtacccg

SEQ ID NO: 24119 - DNA, 541 bp, Homo sapiens
  misc_feature: GYAE6OF01AQ3O3.21.22.B11.1.454.CMB.1.raw
  modified_base (208)..(208): a, c, t, g, unknown or other
  misc_feature (208)..(208): n is a, c, g, or t
  modified_base (381)..(381): a, c, t, g, unknown or other
  misc_feature (381)..(381): n is a, c, g, or t
  modified_base (451)..(451): a, c, t, g, unknown or other
  misc_feature (451)..(451): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggcccccaaatcctcatccagaggaataatcagcggccctcgacggggtccctgaccgtattcctctggctccgaagtctggccaccctnacgcctccctgaccatcagtcggctccggtcgaggatggagctgactattctgtcgcatccgacgggacncaactagtgggatggaaccaagtcgtaggaggtcgggttgggtcggttacgggcgggaacggaacctaacgtcgacccgtcgtagggccg

SEQ ID NO: 24120 - DNA, 304 bp, Homo sapiens
  misc_feature: GYAE6OF01EVQWX.21.22.B11.1.454.CMB.1.raw
  modified_base (299)..(304): a, c, t, g, unknown or other
  misc_feature (299)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcccccctggtcactctcgttcccgcctcctcctcgtctctactgagcgggctggcaaggcgcatagnnnnnn

SEQ ID NO: 24121 - DNA, 666 bp, Homo sapiens
  misc_feature: GYAE6OF01COYAR.21.22.B11.1.454.CMB.1.raw
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcacgccaccctcagccgtctcgggaccccggagagggtcaccatctcttgttctggaggcaactcaacatacggaattaattatgtattctggtatcagcaactccaagaatcgaccccaactccacatcagagaataactcagccgtcctgacgggtcctagaccgtattctcgtggtcctccgaacggtctcgggacctaccctcaacggtcccctcccgtagaacctacgtccgaagggtcgggtccgttacccgggtaccggaggtacgttcggaacggttcctacggtaacctttacgtttacgtcggtcgaacctaacggttaccgaaccggggtacctaccaacgtaggtaggggtaactacgaacgtaagttcggtaacggtagggttccggggtttaggggttcgggtttaccgggaccggggtaacgggtaaaccccgtaaagtaccgggttaccccgttaccggttaacggtacccgg

SEQ ID NO: 24122 - DNA, 638 bp, Homo sapiens
  misc_feature: GYAE6OF01D95L8.21.22.B11.1.454.CMB.1.raw
  modified_base (617)..(617): a, c, t, g, unknown or other
  misc_feature (617)..(617): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (630)..(630): a, c, t, g, unknown or other
  misc_feature (630)..(630): n is a, c, g, or t
  modified_base (633)..(635): a, c, t, g, unknown or other
  misc_feature (633)..(635): n is a, c, g, or t
  modified_base (637)..(638): a, c, t, g, unknown or other
  misc_feature (637)..(638): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaaaatcggaagtaattatgtattctggtatcagcaactcccaggaatggcccccaaactcctcatccagaggaataatcagcggccctcaggggtccctgaccgattctctggctccaagtctggcacctcagccctccctgaccatcagtggcctccggtccgaggacgtggcggtcgtacgtacttagttacgtgtcgactacgtaccgggacggaccgaacgaacgtagggtacggtagtacgaacgtactcggtaggtacgggttcgggggtttggttcggggtccgggacgggtaaccggaacctaacgtccggtacccgtacggtagtaccgaccgaccggacgtcgtaccccgtccccggtcgtcctaccgttccggttcccgtcccccgtcccctttcccgtcccgttccgttccttaccgttacgtggtcccgggtccgtgtaccgggacgtacggccgtacgtaacgngactgatngnacngcnnngnn

SEQ ID NO: 24123 - DNA, 645 bp, Homo sapiens
  misc_feature: GYAE6OF01A5WL4.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactcccaggaatcggaccccaaactcctcatccagagaataatcagccggcctacgacggggtccctgaccgtattctactggcctccaagttctggcctaccgtcacgtccctcctgacccatcgtacggttcgggcctcccgggtccgagggtatcggacggctacgtacttagtttacgtggttaggcctacgtccggaaccgggggtacgaacctaaacgaggttacgggaatacgaacgtaaacgttggtacggaaggggttccggggttttagggggttcggttaccgggggaccgggtaaacggggtaaacccctaaacggttaccgggtaaccccggttccgtaacggggtaacccg

SEQ ID NO: 24124 - DNA, 302 bp, Homo sapiens
  misc_feature: GYAE6OF01CKSAZ.21.22.B11.1.454.CMB.1.raw
  modified_base (296)..(302): a, c, t, g, unknown or other
  misc_feature (296)..(302): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccgcctcctcctcgtctctactgagcggctggcaggcgcatagnnnnnnn

SEQ ID NO: 24125 - DNA, 306 bp, Homo sapiens
  misc_feature: GYAE6OF01D3ZUJ.21.22.B11.1.454.CMB.1.raw
  modified_base (299)..(306): a, c, t, g, unknown or other
  misc_feature (299)..(306): n is a, c, g, or t
tcagtcgtcgctcgcacgaccggtgctcgatttagacgacagctcaggggtccctgaccgattatctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctgccccctggtcactctgttcccaccctcctcctcgtctctactgagcgggctggcaaggcgcatagnnnnnnnn

SEQ ID NO: 24126 - DNA, 590 bp, Homo sapiens
  misc_feature: GYAE6OF01BPGEP.21.22.B11.1.454.CMB.1.raw
  modified_base (210)..(210): a, c, t, g, unknown or other
  misc_feature (210)..(210): n is a, c, g, or t
  modified_base (400)..(400): a, c, t, g, unknown or other
  misc_feature (400)..(400): n is a, c, g, or t
  modified_base (428)..(428): a, c, t, g, unknown or other
  misc_feature (428)..(428): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctggggacccccgggnagagggtcaccatctcttgttctggaggcaactccaacatcggaagtaattatgtattctggtatcagcaactcccaggaactcggacccccaaactcctcatccagagaatatcagccggccctcgacggggtcccagaccgattctctggcctccaagtcctggccaccctcacgtcctccctgaccntcgaggttcgggcctccgggtcgaggtntcggaggctagaccttattacngtnctagtccgaggggaccncaaacnggtgggaatgaactaaagttcgtaaggtacggtccgggtttggggtcgttaccggggacgggtaacgggaaaccctaaaacggttcgggaaccccgttcggttaaggtacccgg

SEQ ID NO: 24127 - DNA, 555 bp, Homo sapiens
  misc_feature: GYAE6OF01D565Y.21.22.B11.1.454.CMB.1.raw
  modified_base (209)..(209): a, c, t, g, unknown or other
  misc_feature (209)..(209): n is a, c, g, or t
  modified_base (474)..(474): a, c, t, g, unknown or other
  misc_feature (474)..(474): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactcccaggaactcggaccccaaactcctcatccagaggaataatcacgccggccctcgacggggtccctagaccgtattctctggctccaagtctggcacctcacgtccctccctcgacccactacaggtcggccgtacccgggtcgaggctggacgctagacttagttactgtgctatcgacgggtacacaacngtgggactagaactagtcgtggacggtggttgggtgttacgggcggaacgggtaccaaacgtcgaaccgtcgtaggtaccg

SEQ ID NO: 24128 - DNA, 732 bp, Homo sapiens
  misc_feature: GYAE6OF01CPD49.21.22.B11.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcacctcctcactcactgcgcagggtcctgggcccagtctgtgctgactcagccaccctcagcgtctcggggacccccggnagagggtcaccatctcttgttctggaggcaactcaacatcggaagtaattatgtattctgtatcagcaactccaaggaatccgacccccaaactccctacacgtaccgaagaaggtaaataaactcgaacgccggtaccctgaaccggggttcccctagaacccgtatttcctacgtcggcctaccgtaagttccgtacgggtacccaaccttccgaaccggtccccttaccccgtaggaacccctagttccggaacgggttcggggacccgtttacccggggtaacccggagggtaacgttcgggaaacgggttcctacggtaacctttaaggttttaaccgtggtcggacctaagttcccggaaaccgggggtaccactaaacggtgtaggggtaaacttggaaacctaagttccgtaagggtaaccgggttcggggttttagggggtcggtttaccggggacgggtaaaccggggtaaaccctaaacgtccgggtaaccccgttacggttacggtaacccg

SEQ ID NO: 24129 - DNA, 592 bp, Homo sapiens
  misc_feature: GYAE6OF01CL6ET.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccgggcagagggtcaccatctcttgttctggagcaactccaacatcggaagtaattatgtattctgtatcagcaactcccaggaactcggaccccaaactcctcactccagagtaataactcagcgccctcgacggggtccctagaccgtattcctcgtcggctacctaagtctcggccacctcacgcctccctgaccatcacggtcggctacccggtcgaggtatcggaggctgtactatttactgtcgacagtccgaacggggtacacaacagtgggaatagaactaaagttccgtaggtacgggtgggttacgggttggggttaccgggacggggaacgggtaaccctaaaacggtccggaaacccggtttccgtaacgggtaccg

SEQ ID NO: 24130 - DNA, 364 bp, Homo sapiens
  misc_feature: GYAE6OF01COGUM.21.22.B11.1.454.CMB.1.raw
  modified_base (327)..(327): a, c, t, g, unknown or other
  misc_feature (327)..(327): n is a, c, g, or t
  modified_base (334)..(335): a, c, t, g, unknown or other
  misc_feature (334)..(335): n is a, c, g, or t
  modified_base (338)..(341): a, c, t, g, unknown or other
  misc_feature (338)..(341): n is a, c, g, or t
  modified_base (344)..(364): a, c, t, g, unknown or other
  misc_feature (344)..(364): n is a, c, g, or t
tcagtcgtcgctcgcacgaccggtgctcgatttagacgacagctcaggggtccctgaccgattctctggctccaagtctggcacctcagcctccctgaccatcaagtgggctccggtccgaggatgaggctgactattactgtgcatcacgggacgcaacatgggatgacaatctgagcggttgggtgttcgggcggagggaccaaaacgtcggaccgtccgtagggtccacgcccaaaggcctaccccccgtcggtaccaccgttcctccggttccccgccccttcctccggagtccgacgactggaaggccggctggcaaggccncatacgnntgnnnngcnnnnnnnnnnnnnnnnnnnnn

SEQ ID NO: 24131 - DNA, 618 bp, Homo sapiens
  misc_feature: GYAE6OF01C3ZQP.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagaggtcaccatctcttgttctggaggcaactccaacatcggaagtaattatgtattctggtatcagcaactccaggaatcggacccccaaatcctcatccagagaataatcacgcgccctgacggggtccctagacctattcctcgtcggcctccgaacgtctggccacctcacgtccctaccctcgaccatccgaggtcgggtcctccgggtaccgaggactggaacggtctacgactttagttacctggttcgacctacgtaccgtaacggggaccgactaaaccgagttacggggaatacggaaaccaagttccgaggtacgggtcgggttttggggtccgggttcggggacggggaacgggtacccaaaacggttcggaacccggttccgttaagggtaccccg

SEQ ID NO: 24132 - DNA, 543 bp, Homo sapiens
  misc_feature: GYAE6OF01DBGLL.21.22.B11.1.454.CMB.1.raw
  modified_base (318)..(318): a, c, t, g, unknown or other
  misc_feature (318)..(318): n is a, c, g, or t
  modified_base (332)..(333): a, c, t, g, unknown or other
  misc_feature (332)..(333): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
tcagtcgtcgctcgcacgaccggtgctcgatttagacgacagctcgaggggtcccggtgaccgattctctggcgtccaagtctggcacctcagcctccctgaccatcagtgggctccggtccgaggatcgaggctgactattactgtgcagtcctacgggacgcaacagtgggatgacatctgagtcggttggtgtcggcggaggaccaacgtcgaccgtctaggtcagcccgaagctcgccccgtggtcactctcgttccgccttcctcctacgtcgtctactcgacggcggctcggacaacggcgactaagtaggnagtgcgtcgcgtgnngtcacgtnacgngtcgngcgcgacacgcnctactatactacncgtcgtcgcgtcgacgtcgtctcgtactactntctatatntatacntatatgtcgtcgtaacgtacgtacgtacgtacgtacgtacgtacgtacgagtacgtacgtacgtcgtcgtacgtcgtactacgtcgtactactctcgtctactcgtcgtactctcgtcgtac

SEQ ID NO: 24133 - DNA, 665 bp, Homo sapiens
  misc_feature: GYAE6OF01AE9U5.21.22.B11.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggactcggacccccaaactccncactccagagaataatcagccgccctcgacggggtccctggaccgtattcctcgtggcctccaagtcctcggcctaccctcacgcccctacccgtgaaccctagttcgacggtcgggcctcccgggtaccgagggactggacggccttaggaaccttaagtttaccgtggtcgacctacgtccggaaccgggggaccacaaaccgtagtacggggaattacggaacctaaacggttcggtagggggttccgggtttggggttcgggttaccggggaccgggggtaaacgggtaaacccctaaaacccgggttcggtaaacccccggtttcccggttaaggggtccccgaaacccggg

SEQ ID NO: 24134 - DNA, 496 bp, Homo sapiens
  misc_feature: GYAE6OF01D4R20.21.22.B11.1.454.CMB.1.raw
  modified_base (337)..(337): a, c, t, g, unknown or other
  misc_feature (337)..(337): n is a, c, g, or t
  modified_base (479)..(479): a, c, t, g, unknown or other
  misc_feature (479)..(479): n is a, c, g, or t
  modified_base (485)..(496): a, c, t, g, unknown or other
  misc_feature (485)..(496): n is a, c, g, or t
tcagtcgtcgctcgcacgaccggtgctcgatttagacgacagctcagggtcctgggcccagtctgtgctgactcagccaccctcagcgtctgggaccccgggcagagggtcaccatctcttgttctggaggcaactccaacatcggaagtaattatgtattctggtatcagcaactcccaggaatggcccccaaatcctcatccagaggaataatcagcggccctcaggggtccctgaccgattctctggctccaagtctggcacctcagcctccctgaccatcagtgggctccggtccgaggatggaggctgactattactgtgcatcacgggacncaacatgggatgacaatctgagtcggttgggtgttcgggcggagggaccaaacgtgaccgtcgtaggtcagcccaaggctcgcccctggtccactcgtcgttcccgccctcctcctcgtctctctgagcggctggcaggccncatagnnnnnnnnnnnn

SEQ ID NO: 24135 - DNA, 308 bp, Homo sapiens
  misc_feature: GYAE6OF01EUYEB.21.22.B11.1.454.CMB.1.raw
  modified_base (301)..(308): a, c, t, g, unknown or other
  misc_feature (301)..(308): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctggtcactctcgttcccgccctcctcctcgtctctactgagcgggctggcaaggcgcatagnnnnnnnn

SEQ ID NO: 24136 - DNA, 577 bp, Homo sapiens
  misc_feature: GYAE6OF01BLMFJ.21.22.B11.1.454.CMB.1.raw
  modified_base (210)..(210): a, c, t, g, unknown or other
  misc_feature (210)..(210): n is a, c, g, or t
  modified_base (473)..(473): a, c, t, g, unknown or other
  misc_feature (473)..(473): n is a, c, g, or t
  modified_base (499)..(499): a, c, t, g, unknown or other
  misc_feature (499)..(499): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnaggagggtcaccatctcttgttctggaggcaactccaacatacggaagtaattatgtattctggtatcagcaactccaggactcggaccccaatcctcatccaaggagaataatcagccgcctcgacggggtccctagaccgtattcctcgtggccttaccgaagttcctcggcctaccctcacgtccctccgtgacccagttccgaggttcgggcccttccgggaccgaggactcggacggtctaggtaaccttagttacgngtacgctaagtccggaaccgggtacncaagtgtagggatacggaactgtcgtggaggtcggttagggtcgtacgggcggaaggtaccagtcgacgtcgtggccg

SEQ ID NO: 24137 - DNA, 678 bp, Homo sapiens
  misc_feature: GYAE6OF01D8Y35.21.22.B11.1.454.CMB.1.raw
  modified_base (660)..(660): a, c, t, g, unknown or other
  misc_feature (660)..(660): n is a, c, g, or t
  modified_base (670)..(672): a, c, t, g, unknown or other
  misc_feature (670)..(672): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggccccaaactcctcatccagaggaataatcagcggccctcgacggggtccctgaccgattctcgtggctcaagtctggccacctcacgcctccctgaccatcaggtgggcctccggtccggaggatggagctgacttattacgtgtgctagtcgacgggacacgaacagtgggactggaactaagtcgtaggacgggtcggggtttacggtgggtttccgggacggggtaacgggtaacccgtaaacggtaccggtacccgggttacccgttaacgggtcccgaaccggtaccccggaaacgggtcccgtcccgggtacccccccgttcggtacccgtaacccgttccgttcccggtttaccccctacccccttcccgtttccccgttcccgttacccgttccgttaacccgtcggtaccgggtaccgggtccgtcgggtaccggaacggcccgtacgtacgtagctacggncgtcgcgacnnncngngn

SEQ ID NO: 24138 - DNA, 619 bp, Homo sapiens
  misc_feature: GYAE6OF01C9VDT.21.22.B11.1.454.CMB.1.raw
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccgggcagagggtcaccatctcttgttctggaggcaactccaacatacggaagtaattatgtattctgtatcagcaactcccaggaatccgaccccaaactcctcactccaagagaaataactcacgccggccctcgacggggtccctgaccgtattcctctcggcctaccgaagttctcggccacctcgacgtccctccctagaccatcgaggtcgggtcctaccgggtacgaggtactggacggctagtacttaattaccgtggtcgaccgtagtaccggaacgggaccacaacgtagtagggaatacggaaacacgttacgtaggtaacggttgggtttggggttcggttaccggggacggaaacgggtaaccctaaacgttccgggaacccgttcggtaacggtaccg

SEQ ID NO: 24139 - DNA, 588 bp, Homo sapiens
  misc_feature: GYAE6OF01D0KRD.21.22.B11.1.454.CMB.1.raw
  modified_base (282)..(282): a, c, t, g, unknown or other
  misc_feature (282)..(282): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (578)..(579): a, c, t, g, unknown or other
  misc_feature (578)..(579): n is a, c, g, or t
  modified_base (583)..(588): a, c, t, g, unknown or other
  misc_feature (583)..(588): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcgagggtccctgaccgattctctggctccaagtctggccacctcacgccctcccngaccatcagtcgggcctccggtccgaggatggaggctgactattactgtgcagtcgacgggcncaacgngtagggatagaactaagtcgtaggacgtcgggtttagggtcggttacgggacgggtaagggacctaaacgtcggtaacccgtcgtaacggtcacgacccgaacggcctcgcccccgtcggtcctacctccgtccgttcccaccccgttccctcccttcgtccttccgtacgtcggacgccgggtccgtacgggaccgtaaggcccgtacgtacgtacgtnacgtncnncgcnnnnnn

SEQ ID NO: 24140 - DNA, 568 bp, Homo sapiens
  misc_feature: GYAE6OF01BZ4QU.21.22.B11.1.454.CMB.1.raw
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (463)..(463): a, c, t, g, unknown or other
  misc_feature (463)..(463): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagaggtcaccatctcttgtctggaggcaactccaacatcggaagtaattatgtattctggtatcagccaactccccaggaactcggacccccaaactcctcatccagagaataacncgagcggccctgacggggtccctgaccgtnttccncgtggcctaccgaagtctggccacctnacgtccctccngaccntcgaggtcggctccggtcgagntcgagctgactnttacgngtcgctatccgacgggtacncaaactggtggatgaactagtcgtaggcggttcgggtttggggtcgtaccggggacgggaacggtaccccaaacggttccgggacccgttaccgtagggtacccg

SEQ ID NO: 24141 - DNA, 304 bp, Homo sapiens
  misc_feature: GYAE6OF01CLQCE.21.22.B11.1.454.CMB.1.raw
  modified_base (299)..(304): a, c, t, g, unknown or other
  misc_feature (299)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgcccctcggtcactctgttccccgcctcctcctcgtctctactgagcggctggcaaggcgcatagnnnnnn

SEQ ID NO: 24142 - DNA, 717 bp, Homo sapiens
  misc_feature: GYAE6OF01C5V0E.21.22.B11.1.454.CMB.1.raw
  modified_base (223)..(223): a, c, t, g, unknown or other
  misc_feature (223)..(223): n is a, c, g, or t
  modified_base (342)..(342): a, c, t, g, unknown or other
  misc_feature (342)..(342): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgcgggaccccggcagagggtcaccatctnttgtctggagcaactcaacatcggaataattatgtattctggtatcagcaactccgaaggaactcggacccccaaatcctacatccaagagaataatcagcggccctgacggggtcccnggaccgtattctccgtggcctactaagttccgtcgggaccacccgttacgacgtccccttaccccgtaggaacccctagttccggaaggggttccggggtccctttaccccgggggtacccggaaaggggtaacgtcgggtaaacgggtcccgttagtaaaccctttaagtttaaccgttcggtagccctaagtccccggaaaacgggggtccaaccaaacgtacggttaggggaacttacggaaacctaaagttccgtaaggggtaacgggttcgggggttttacggggttgggtttacccgggggagggtaaaccggggtaaaccccaaaaccggttcggggttaacccccttacggttaacggggtaacccg

SEQ ID NO: 24143 - DNA, 659 bp, Homo sapiens
  misc_feature: GYAE6OF01EQA6N.21.22.B11.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnaggagggtcaccatcctcttgttctggaggcaactccaacatcggaagtaattatgtattctggtatcagcaactcccaggaatccggacccccaaactcctcactccagaagaataatcagccggccctcgacggggtccctgaccgattcctcgtggcctaccaagttcgtcggccaccctcgacgtccccttacccgtcgaaccctagtccgtagggttccggggcccgttcccggggtacccgaagggtactgggaacggtccttaggtaaccttaactttaccgtggttcgacaacgttccggaaccgggggaccacctaaacgagtacgggaatacggaacctaaagttcgtagggtacgggttcggggtttggggtcggttaccggggacgggaacggggaaccctaaacggttcggacccggttaccggtagggtacccg

SEQ ID NO: 24144 - DNA, 611 bp, Homo sapiens
  misc_feature: GYAE6OF01BPY5Z.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagaggtcaccatctcttgtctggagcaactcaacatacggaagtaattatgtattctggtatcagcaactccagactcggacccccaactcctcatccagaggaataatcgagccggccctacgacgggggtccctaggacccgtattcctcgtcggccttaccgaagttcctggccaccctcacgtcccttccctgacccagtcgacggtcgggtcctcccgggtacgaggagtggcggtctagaccttattactgtacgctacgtaccggaccggggacacgaaccgtggtacgggtactagaactaacgttcgtacggagggttcgggttaggggttcggttccggggacgggaacgggtaacccaacggttaccgacccggttccgtacggtacccgg

SEQ ID NO: 24145 - DNA, 515 bp, Homo sapiens
  misc_feature: GYAE6OF01B07R2.21.22.B11.1.454.CMB.1.raw
  modified_base (229)..(229): a, c, t, g, unknown or other
  misc_feature (229)..(229): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (503)..(509): a, c, t, g, unknown or other
  misc_feature (503)..(509): n is a, c, g, or t
  modified_base (511)..(515): a, c, t, g, unknown or other
  misc_feature (511)..(515): n is a, c, g, or t
tcagtcgtcgctcgcacgaccggtgctcgatttagacgacagctcaggggtcctgggcccagtctgtgctgactcgagccaccctcagcgtctgggacccccgggcagagggtcaccatctcttgttctggaggcaactccaacatcggaagtaattatgtattctggtatcagcaactcccaggaatggccccaaactcctcatccagaggaataatcagcggccctnaggggtccctgaccgattctctggctccaagtctggcacctcagccctccctgaccatcagtcgggcctccgggtccggaggactggacggctggactattactgtgctatcgacgggacncaacngtgggatgacaatctgagcggttggtcgtcggcggagggaccaacgtcgaccgtcgtaggtcacgtccaaggcctcgccccgtggtccacgtctcgttcccaccttcctcctcgtctctactcgacgcggctggcgaggcgcagtcgnnnnnnncnnnnn

SEQ ID NO: 24146 - DNA, 293 bp, Homo sapiens
  misc_feature: GYAE6OF01D1INM.21.22.B11.1.454.CMB.1.raw
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
  modified_base (290)..(293): a, c, t, g, unknown or other
  misc_feature (290)..(293): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggaccaaactgaccgtctaggtcagccagctcgcccctgtcactctcgtcccncctcctcctcgtctctactgngcggctggcaggcgcatagnnnn

SEQ ID NO: 24147 - DNA, 518 bp, Homo sapiens
  misc_feature: GYAE6OF01DJJ27.21.22.B11.1.454.CMB.1.raw
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
  modified_base (464)..(464): a, c, t, g, unknown or other
  misc_feature (464)..(464): n is a, c, g, or t
  modified_base (494)..(494): a, c, t, g, unknown or other
  misc_feature (494)..(494): n is a, c, g, or t
  modified_base (497)..(518): a, c, t, g, unknown or other
  misc_feature (497)..(518): n is a, c, g, or t
tcagtcgtcgctcgcacgaccggtgctcgatttagacgacagctcagggggtccctggacccgattctctggctccaagtctggccacctcagcctcccgtcgaccatcaggtgggcctccggtcccgaggatgaggcgtagactattaactgttggcagtcacggggtacgcaacatggggatgacaatctgaggacgggttcgggtgttcggcggagggttaccaaaacgtgaccgtcctacggttccaggtccccaaggcctcgtcccccctgggtccactcctggttccccacctcctcctcgtcctcctaccgtgacgcggggtctcgggcgaacggccactagtaacggntgtagttcncngcngtcncanatgcncgcgcgtcgtgtcgcgcgacgacgcgcgtcgtgngcgcgacgacgcgccgccgtacgtcncgtcgtccgtccgcctctcgcncgcgcgcgcgcgcgcgacgacgacgcgcgngannnnnnnnnnnnnnnnnnnnnn

SEQ ID NO: 24148 - DNA, 306 bp, Homo sapiens
  misc_feature: GYAE6OF01CHARV.21.22.B11.1.454.CMB.1.raw
  modified_base (301)..(306): a, c, t, g, unknown or other
  misc_feature (301)..(306): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagccaaggctcgcccctcggtcactctcgttcccaccctcctcctcgtctctactggagcgggctggcaaggcgcatagnnnnnn

SEQ ID NO: 24149 - DNA, 568 bp, Homo sapiens
  misc_feature: GYAE6OF01B6KOI.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactcccaggaactcggacccccaaactcctcactccagaaggaataactcaggccgcctcgacggggtccctgaccgtattctctcggctccgaagtcgtggccacctcacgtccctcctgaccatcgaggtcgggcctccgggtcgaggactggacggctagtacttagttacgtgtcgcagtcgacgggacactaaagtgggatggaactatcgaggtaggtcgggttgggtcggttccgggacggtaacgggacctaaacggtcgtacccgtcgtaggtccgtacgg

SEQ ID NO: 24150 - DNA, 768 bp, Homo sapiens
  misc_feature: GYAE6OF01CXMZ1.21.22.B11.1.454.CMB.1.raw
  modified_base (210)..(210): a, c, t, g, unknown or other
  misc_feature (210)..(210): n is a, c, g, or t
  modified_base (249)..(249): a, c, t, g, unknown or other
  misc_feature (249)..(249): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggaccccggnaggagggtcaccatctcttgtcgtggacgcaactccaanagtacggaaagttaattatgttattcgtaggtatcagacctaactccgaaggaactccggaccccctaaactcctacactaccgaaggtaagtaaataactcgaacggcccggtaccctacggaccggggtccctacggtaaccgtacttccgtcgtcggcctaccgtagttccgtcggacctacccgtcgaaccgtccccttcccgtacgacctacgtaccgtacgggtccgggtaccgttcccgggtaccggaaggtacgtacgggtacggtccttaaggtaaccttttaacttacgggttacgtacgtacccgtaaccgttacccgggaaaccggggtaacccgtaccaaacggtacggttaaggggaacttaccgggaaaccttacggttaccggtgggtaacggggttaccggggggtttacggggttcgggtttacccggggggaaccgggtaaacgggtaaccccggtaaaggttacccgggtacccgttaccgggtaacgggttaccccgg

SEQ ID NO: 24151 - DNA, 545 bp, Homo sapiens
  misc_feature: GYAE6OF01BFK9D.21.22.B11.1.454.CMB.1.raw
  modified_base (354)..(354): a, c, t, g, unknown or other
  misc_feature (354)..(354): n is a, c, g, or t
  modified_base (388)..(388): a, c, t, g, unknown or other
  misc_feature (388)..(388): n is a, c, g, or t
  modified_base (465)..(465): a, c, t, g, unknown or other
  misc_feature (465)..(465): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaattatgtattctggtatcagcaactcccaggaatcggacccccaaatcctcatccagagaatatcagccgccctcgacggggtccctgaccgattcnctggcctacaagtctggccacctcacgccctccngacccatcaggtcggcctccggtcgaggatggacggctagacttattacgtgtcgcacgtccgaacgggacacaagngtgggatgaactatcgtggaggtcgggttgggcgttcgggacgggacgggtaccaaacgtcggaccctcggtaggtaccc

SEQ ID NO: 24152 - DNA, 680 bp, Homo sapiens
  misc_feature: GYAE6OF01CJDMD.21.22.B11.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactcccaggaactcggacccccaaactcctacactccagaggaataatcagccgccctcgacggggtccctggaccgtattcctctcggcctaccgaagtctacggcctacccgtcacggtccccttcccgtacgaccctacgtcgaacgggttccgggccttcccgggtaccggaaggtacgtcgggaacgggtccttaggtaacctttagtttacgtggtacgacctaagttacccgggaaaccgggggtaccaacgtaaaccgtagggttacggggaacttacggaaacctaaagttccggtagggtaacgggttgggggtttacggggttcggttaccggggacgggtaacgggtaaccctaaacggtccggtaaccccgttcggtaacgggtacccg

SEQ ID NO: 24153 - DNA, 582 bp, Homo sapiens
  misc_feature: GYAE6OF01BW3CK.21.22.B11.1.454.CMB.1.raw
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggcagacgggtcaccatcctcttgttcgtggacgcaacctccaacagtacggaagttaatttatgttattcgtggtatcagccaacctacccgaggtaactccggaccccctaaactcctcactcgagagaatatcacgccgcctgacgggtccncgacgtattctcgtgctacagtcngccacctcacgcctcctgaccagtcgaggtcggtcctccggtaccgaggngtcgnggctcgaattacttacnggtcactagtccggacgggacacgaagtgtaggatacgattacgtcgtaggacgggttgggtaggggttcgtacggggacgggtaacggtaaccctaacggttcggaccccgttacgtcggtaccg

SEQ ID NO: 24154 - DNA, 565 bp, Homo sapiens
  misc_feature: GYAE6OF01AR57O.21.22.B11.1.454.CMB.1.raw
  modified_base (212)..(212): a, c, t, g, unknown or other
  misc_feature (212)..(212): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (422)..(422): a, c, t, g, unknown or other
  misc_feature (422)..(422): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggnagagggtcaccatctcttgttctggagcaactccaacatcggaatattatgtattctggtatcagcaactcccaggaactcggacccccaactcctcatccagagaataatcagccgccctcgcggggtcccngaccgtnttcnctcggctccaagtcnggccacctcacgtccctccctgacccatcgaggtcggcctccggtcgaggntggacggtctagtacttagttactgtcgctacgtccgaacggggtacaccaagtgtagggaactgaactaacgtcgtaggcggtcgggtttgggtcgttccggggacggtacggacctaacggtcgaccgttcgtcggtaccg

SEQ ID NO: 24155 - DNA, 543 bp, Homo sapiens
  misc_feature: GYAE6OF01BDRB2.21.22.B11.1.454.CMB.1.raw
  modified_base (440)..(440): a, c, t, g, unknown or other
  misc_feature (440)..(440): n is a, c, g, or t
  modified_base (524)..(524): a, c, t, g, unknown or other
  misc_feature (524)..(524): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatcggaccccaaactcctcatccagagaataatcagccggccctcgacggggtccctgaccgtattcctctggctccaagtctggcacctcacgccctccctgaccatcaggtggcctcccgggtcgaggatggaggctagacctattacngtgcatcgacgggacgacaacagtgggatgaactaatcgtggagtgggttggggtgttaccgggcgggacgggtaacccaaagngaacccggtcgtaggtccg

SEQ ID NO: 24156 - DNA, 567 bp, Homo sapiens
  misc_feature: GYAE6OF01EJL9N.21.22.B11.1.454.CMB.1.raw
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
  modified_base (279)..(279): a, c, t, g, unknown or other
  misc_feature (279)..(279): n is a, c, g, or t
  modified_base (381)..(381): a, c, t, g, unknown or other
  misc_feature (381)..(381): n is a, c, g, or t
  modified_base (469)..(469): a, c, t, g, unknown or other
  misc_feature (469)..(469): n is a, c, g, or t
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
  modified_base (533)..(533): a, c, t, g, unknown or other
  misc_feature (533)..(533): n is a, c, g, or t
  modified_base (561)..(561): a, c, t, g, unknown or other
  misc_feature (561)..(561): n is a, c, g, or t
tcagtcgtcgctcgcacgaccggtgctcgatttagacgacagctcagggggggaaggcgtcagcttcagctgtggtagagaagacaggactcaggacaatctccagcatggccggcttccctctcctcctccaccctcctcactcactgcgcacgggtccgtgggcccagtctgtgctgactcacgccaccctcagcgtcctacggggaccccccggnaggtacgggtccaccatctcttgttacnggaggcaacctccaacngtcggaagtaatttanagtatttctggtatcagccaatccccaaggaatcggcccccaaactcctcgatccacgagaataatcgagccggccctcgaggggtcccctgaccgattccntgcctacaagtctggcacctcagccctccctgaccagtcaggtcggctcccgggtaccgaggacttggaacggctagacttatttacngtgctaatccgaggggtaccaaacngaggganggacatcgtggactgggttggtggttaccggngtaccgggacctaaagtggacccttcgnggtacc

SEQ ID NO: 24157 - DNA, 561 bp, Homo sapiens
  misc_feature: GYAE6OF01BIZHZ.21.22.B11.1.454.CMB.1.raw
  modified_base (249)..(249): a, c, t, g, unknown or other
  misc_feature (249)..(249): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
  modified_base (551)..(561): a, c, t, g, unknown or other
  misc_feature (551)..(561): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctgacggggtccctgaccgattcnctggcctccaagtctggcaccctcacgcctccctgaccatcgagtgggcctccggtccgaggatcggaggtctagactatttactgtacgcatcgacgggacncaagngtgggatgacaatcnggagtcgggttggtcgttcggacgggacgtaacgaacgtcgaccgtcgtagtacgacgtccgaacggtccgtcgccccgtcgtaccgtacttccgtccgttccccgtccccgttccttcccgtccgttccttccgtacgtcggacgccggtcgtcggacgacggcgaccgngtcgncgnnnnnnnnnnn

SEQ ID NO: 24158 - DNA, 587 bp, Homo sapiens
  misc_feature: GYAE6OF01BN2Q8.21.22.B11.1.454.CMB.1.raw
  modified_base (305)..(305): a, c, t, g, unknown or other
  misc_feature (305)..(305): n is a, c, g, or t
  modified_base (472)..(472): a, c, t, g, unknown or other
  misc_feature (472)..(472): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgtctggagcaactccaacatcggaagtaattatgtattctggtatcagcaactcccaggaactggcccccaaactccncatccagagaataatcagccgcctcgacgggtccctgaccgtattctcgtcggctcaagtctggcacctcacgcctccgtgaccatcgagtcgggcctccgggtaccgaggtatggacggtctagacttatttaactgtcgctactcggaaccgggacgacaaacgngtacgggaatacggaacctaaagttccgtaggacggttcgggttggggttcgttaccggggacgggtaaccgggaacctaaacgtccgggtaacccgttccggtaaggtacccgg

SEQ ID NO: 24159 - DNA, 586 bp, Homo sapiens
  misc_feature: GYAE6OF01A04TR.21.22.B11.1.454.CMB.1.raw
  modified_base (490)..(490): a, c, t, g, unknown or other
  misc_feature (490)..(490): n is a, c, g, or t
  modified_base (497)..(497): a, c, t, g, unknown or other
  misc_feature (497)..(497): n is a, c, g, or t
tcagtcgtcgctcgcacgaccggtgctcgatttagacgacagctcagggggggaagctcagcttcagctgtggtagagaagacaggactcaggacaatctccagcatggccggcttccctctcctcctcaccctcctcactcactgcgcggggtcctgggcccagtctgtgctgactcagcccaccctcagcgtctgggaccccccgggcagagggtcaccatctcttgttctggaggcaactccaacatcggaagtaattatgtattctggtatcagcaactcccaggaatcggacccccaaactcctcatccagaggaatatcagccgccctcgacggggtccctggaccgtattcctcgtcggcctccaagtctcggcctacctcacgtccctccctcgaccctatcgaggtcgggcctcccggtccgaggtactggacggtctaggaacttatttacgtggtacgctaacgtccgaccgggtaacncaaacgngttagggatgaactatcgtaggaggtcgggttgggtcggttcgggacggaacgggacctaaacgtcggtacccgtcgtaggtccaccgg

SEQ ID NO: 24160 - DNA, 639 bp, Homo sapiens
  misc_feature: GYAE6OF01BITS7.21.22.B11.1.454.CMB.1.raw
  modified_base (410)..(410): a, c, t, g, unknown or other
  misc_feature (410)..(410): n is a, c, g, or t
tcagtcgtcgctcgcacgaccggtgctcgatttagacgacagctcagggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtctcggggacccccgggcaggacgggtcaccatctcttgttctggaggcaactccaacatcggaataattatgtattctgtatcagcaactccaggaactcggaccccaactcctcactccagagaataatcagccggcctcgacggggtccctgaccgtattctcgtcggcctccgaagtctcggactaccctcacgtccctccctgaaccctntcgaggtcgggtccttccgggtaccgaggtacgtcggaacggtcctagtacctttagttacgtcggtgacctacgtaccggaacggggtaccgacaaacgtagtacgggaactaggaacctaagtccggtggacgggtttcgggggttacggggttcggttaccgggggacgggaaacggggtaaccccaaacggttccggaaccccgggttcggttacggtaaccggg

SEQ ID NO: 24161 - DNA, 687 bp, Homo sapiens
  misc_feature: GYAE6OF01AJU6Z.21.22.B11.1.454.CMB.1.raw
  modified_base (213)..(213): a, c, t, g, unknown or other
  misc_feature (213)..(213): n is a, c, g, or t
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
tcagtcgtcgctcgcacgaccggtgctcgatttagacgacagctcagggggggaaggcgtcagcttcagctgtggtagagaagacaggactcaggacaatctccagcatggccggcttccctctcctcctcaccctcctcactcactgcgcaggtcctgggcccagtctgtgctgactcagccaccctcagccgtcgtcggggaccccccggnaggacgggtccaccgatcctcttgttcgtgggacgcaactccaacntcgaagtattatgtattctggtatcagcactccagatcggccccaatcctnactccagagaatacncagccgaccctcgacgggtccctagacccgtattcctcgtcgtacctacctaaggtcctaggacctacccgtcaccggtcccttccccgtacgacccaacttcaacggggttcgggtccctcccgggtacccggagtaggttcgaacgggtcccgttagtaaccttacgttacttcgggacgtactacggttcccggaaccggggtaaccgtccaaacgttaagggtacgggtacgtaacaccgtaaagtccccgtttaggaaccggggtttcggggtttcggggtggttccccggggacgggtaaacggggtaaaccccaaacgggtttcccggaaaccgggttcccggttaacgggacgg

SEQ ID NO: 24162 - DNA, 306 bp, Homo sapiens
  misc_feature: GYAE6OF01BUH68.21.22.B11.1.454.CMB.1.raw
  modified_base (301)..(306): a, c, t, g, unknown or other
  misc_feature (301)..(306): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtgaccgtctaggtcagcccaaggctcgccccctggtcactctcgttcccaccctcctcctcgtctctactgagcgggctggcaaggcgcatagnnnnnn

SEQ ID NO: 24163 - DNA, 572 bp, Homo sapiens
  misc_feature: GYAE6OF01D0OHR.21.22.B11.1.454.CMB.1.raw
  modified_base (452)..(452): a, c, t, g, unknown or other
  misc_feature (452)..(452): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggaccccaaactcctcatccagagaatatcagccggccctcgaggggtccctgaccgattctctgctcaagtctggcacctcagccctcctgaccatcaggtggcctccggtacgaggatggaggctgaccttattacctgtcgctatccgaacgggacncaacgagttgggattcggaactaagttcgtaggaggtcggggtttggggtcggttaccggggacggggaacgggaacccctaaaacgtcggtaaaccccggttgttaacccccgggtacg

SEQ ID NO: 24164 - DNA, 534 bp, Homo sapiens
  misc_feature: GYAE6OF01CAIS0.21.22.B11.1.454.CMB.1.raw
  modified_base (208)..(208): a, c, t, g, unknown or other
  misc_feature (208)..(208): n is a, c, g, or t
  modified_base (461)..(461): a, c, t, g, unknown or other
  misc_feature (461)..(461): n is a, c, g, or t
  modified_base (498)..(498): a, c, t, g, unknown or other
  misc_feature (498)..(498): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactccccaggaactcggacccccaaactcctacatccagagaataatcagccgccctcgacggggtccctgaccgtattcctctggcctaccaagtctggcacctcacgccctcctgacccatcagtcggcctccggtcgaggatggagctagacttattctgtgcatcgacgggacacaacngtggatgaacatcgtaggacgtggttgggtgtcgggnggaacgggaccaaagtccgaccgttcgtaggtaccg

SEQ ID NO: 24165 - DNA, 543 bp, Homo sapiens
  misc_feature: GYAE6OF01AUV2R.21.22.B11.1.454.CMB.1.raw
  modified_base (388)..(388): a, c, t, g, unknown or other
  misc_feature (388)..(388): n is a, c, g, or t
  modified_base (473)..(473): a, c, t, g, unknown or other
  misc_feature (473)..(473): n is a, c, g, or t
  modified_base (487)..(487): a, c, t, g, unknown or other
  misc_feature (487)..(487): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagacgggtcaccatctcttgttctggaggcaactccaacatcggaagtaattatgtattctggtatcagcaactcccaggaatcggacccccaaactcctacatcccagaggaataactcaagccggccctcgacgggggtccctgacccgattctctggcctccaagtctggcacctcncgccctccctgaccatcgagtcgggcctccgggtccgaggactggacgctagacctattacgtgtgccatcgacgggacacaacngtggatcgacactntggaggtcggttgggtgttcgggacggaggtaccaaagtgaaccgtcgtaggtccg

SEQ ID NO: 24166 - DNA, 505 bp, Homo sapiens
  misc_feature: GYAE6OF01AR5Z2.21.22.B11.1.454.CMB.1.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
  modified_base (464)..(464): a, c, t, g, unknown or other
  misc_feature (464)..(464): n is a, c, g, or t
  modified_base (491)..(492): a, c, t, g, unknown or other
  misc_feature (491)..(492): n is a, c, g, or t
  modified_base (494)..(496): a, c, t, g, unknown or other
  misc_feature (494)..(496): n is a, c, g, or t
  modified_base (499)..(505): a, c, t, g, unknown or other
  misc_feature (499)..(505): n is a, c, g, or t
tcagtcgtcgctcgcacgaccggtgctcgatttagacgacagctcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtggcctccggtccgaggatgagctgactattactgtgcatcacgggcncaacngtgggatgacaatctgagcgggtttggngttcgggcggagggaccaacgtcgaccgtccgtaggtcacgcccaaggcctcgcccctggtccactctcgtcccaccctctcctcgtcctctacncgacgcggctcggcaggccgacagtgnngnnncgnnnnnnn

SEQ ID NO: 24167 - DNA, 567 bp, Homo sapiens
  misc_feature: GYAE6OF01AJ0KD.21.22.B11.1.454.CMB.1.raw
  modified_base (284)..(284): a, c, t, g, unknown or other
  misc_feature (284)..(284): n is a, c, g, or t
  modified_base (484)..(484): a, c, t, g, unknown or other
  misc_feature (484)..(484): n is a, c, g, or t
tcagtcgtcgctcgcacgaccggtgctcgatttagacgacagctcaggggggggaaggctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccgggcaggaggggtccaccattccgtcttgttcctgggaggccaacctccaacatcggaaagtaattatgtattcnggtatcagcaactcccaggaactcggacccccaatcctcactccagagaataatcagcgccctcgacggggtccctagacctattctctcggcctccaagtctggcctacctccgacgccctccctgacctatcgtaggttcgggcctccgggtccgaggatcggaggctagacttatacgtgtgcagtccgacgggacncacgagttcgggatgactagtccgtggacggtgggttggtggtccgggaggacggtaaccacggtggacccgtgtaggtaccg

SEQ ID NO: 24168 - DNA, 650 bp, Homo sapiens
  misc_feature: GYAE6OF01DSB42.21.22.B11.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctccaccctcctcactcactgccgcagggtcctgggcccagtctgtgctgactcacgcccaccctcagccgtccgtcggggaccccccgggcaggacgggtccaccatctcttgttctggaggcaactccaacatacggaagtaattatgtattcgtaggtatcagcaacctcccgaggaactccggaccccaactcctacactccagagaataancacgccgcctcgacggggtccctagaccgtattccgtcgtcggcctaccgaacgtccgtcggccctaacctccgacgtccccttacccgtacgaaccctatcggtaacgggtcggggtcccttcccgggtacggaggtagtgacgggtctacgtactttagttctgtgacctagtaccggacgggacacaacgtaggtcgggaattacgactaacgttcgtaggacgggttgggtttcggggcggttaccggggaacggtaacgggtaaccctaaacggttccggaacccgttcgttaagggacccg

SEQ ID NO: 24169 - DNA, 669 bp, Homo sapiens
  misc_feature: GYAE6OF01BGWGL.21.22.B11.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgcccaccctcagccgtcgtcggggacccccgggnaggacgggtccaccatctcttgttctgggagcaactcaacagtcggaataattatgtattctggtatcagcaactcccgaaggaactccggacccccaaactcctcactccgaagaaggaataactcacggccggtcccgtacgacgggtcctggaccgtacttcgtcgtcggtcctacgaacgtcgacgacctaccctacaccgtcccttacccgtacgacctacgtccgtacgggtcgggaccttcccgggtaccgtaggactggacggtctacggtacttacgttacgtgtcgtactacgtaccggaacgggtaccgagtaacgaggtagggtactaggaacctagttacgggtcggtacggggttcggggttaggggtcgggttaccgggacgggtaaaccggtaccgttaaaccgtcgggtaaccccgttcgggaaccggtaaccccgg

SEQ ID NO: 24170 - DNA, 598 bp, Homo sapiens
  misc_feature: GYAE6OF01D6VQF.21.22.B11.1.454.CMB.1.raw
  modified_base (211)..(211): a, c, t, g, unknown or other
  misc_feature (211)..(211): n is a, c, g, or t
  modified_base (504)..(504): a, c, t, g, unknown or other
  misc_feature (504)..(504): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcacgcgtctcgggacccccggnagaggtcaccatctcttgttctggaggcaactccaaacatacggaagtaattatgtattctggtatcagcaactcccgaaggaactcggacccccaaactcctacactccagagaataatcagccgccctcgacggggtccctaggaccgtattcctcgtcggacctccaagtcctcggcctaacctcacgtccctcccgtagaacccatcgaggtcgggcctcccgggtcgaggatggaggtcctagtacttagttacgtgtcgactaagtccgaacggggtacacaaacgngtgggaatcggaactagtcgtggagggtcggtttgggcggttccgggacgggaaccggtaaccctaaacgtccggtaccgttccgtagggtacc

SEQ ID NO: 24171 - DNA, 607 bp, Homo sapiens
  misc_feature: GYAE6OF01BL0LH.21.22.B11.1.454.CMB.1.raw
  modified_base (211)..(211): a, c, t, g, unknown or other
  misc_feature (211)..(211): n is a, c, g, or t
  modified_base (481)..(481): a, c, t, g, unknown or other
  misc_feature (481)..(481): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnaggagggtcaccatctcttgttctggaggcaactccaacatcggaagtaattatgtattctggtatcagcaactccccaggaactcggacccccaaactcctcatccagagaataatcagccgccctcgacggggtccctgaccgattcctcgtcggcctccgaaacgtcctgggccaccctccacggtccccttccctacgacccatccgaaggtcgggcccgttccccgggtacggaggagtcgggacggtctagacctttattacgngtgccaagtccggacgggtaccgaccaacgtagtacgggataggaactatcgtagtcgggttgggttggggtcggttccgggacggtaacgggaccctaagtaccggacccggtcgtacggtaccg

SEQ ID NO: 24172 - DNA, 620 bp, Homo sapiens
  misc_feature: GYAE6OF01D9WC3.21.22.B11.1.454.CMB.1.raw
  modified_base (209)..(209): a, c, t, g, unknown or other
  misc_feature (209)..(209): n is a, c, g, or t
  modified_base (435)..(435): a, c, t, g, unknown or other
  misc_feature (435)..(435): n is a, c, g, or t
  modified_base (490)..(490): a, c, t, g, unknown or other
  misc_feature (490)..(490): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggatcggccccaaactcctcatccagaggaataatcagcggccctcgacgggggtcccctggaccgtattccgtctggcctcccgaagtcctcggcaccctcgacgccctccctcgaccatccgaggtcggccgtcccgggtcgaggtntggacgtctagtacttagttactgtcgactacgtaccgaacgggcgaccaaacgngtaggggactacggaacctaagttacgtagggtaggttccgggggtttggggttcggtttccgggggaccgggtaaaccggggtaaccctaaaacggttccgggtaaccccggttcgtaacgggtacccg

SEQ ID NO: 24173 - DNA, 813 bp, Homo sapiens
  misc_feature: GYAE6OF01D6T13.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtaccggggacccccggcaggtacggtcacccattccttcgtttgttcgtagggacggacctaacctaccaaactagttacggaaagttaaatttagtagttatttcgttaggttactcgtaacgacctaaacccttaccccggaaggtaccgtacccccggaaaacccccttaacccgtttacccaactccgaaccggaagggtaaaacttaaagtacccgtaacgaccggtcccccggttaccctaacgggggtacccccggtcgtaaccccggactttaccgtttcctcggggaccctttcccaaacggttacctttacggggccgtaacccctaccgtacgcccgttaccccctcgtaacccgaactccgacgtaggggccgtaccgggtcccgtacgggacgtacgtacggacgttacggtcaacgttaactttaacgtcggtgaccgaagttaccgaaccgggggacctaccaaacgtagtaggggaactcggaacctaaagttccgtagggtacgggtccggggttttaggggtcggtttaccggggacgggtaacggggtaaacccgtaaaacggttacggtaacccggttccgtaacggggttaaccc

SEQ ID NO: 24174 - DNA, 832 bp, Homo sapiens
  misc_feature: GYAE6OF01BZQQ8.21.22.B11.1.454.CMB.1.raw
tcagtcgtcgctcgcacgaccggtgctcgatttagacgacagctcagggtcctgggcccagtctgtgctgactcagccaccctcagcgtctcgggacccccgggcaggagggtcaccatctcttgttctggaggcaactccaacatcggaagtaattatgtattctggtatcagcaactcccaggaatcggaccccaaactcctacatccagagaataatcagccggcctcgacggggtccctgaccgtattctcgtcggcctaccgaagtctggccaccgtcacgccctccctcgaccatcgaggtcggccttccgggccgaggtatcggagtctaggtacttagttacgtgtcgactagtaccggaacggggaaccgaacgtaaaaagtcgggggtaacttaacggaaactaaacgttccggtaaggtaacggggttaccgggggtttaggggttcgggtttaccggggacggggtaaacggggtaaaccccgtaaacgttaccggtaacccggttaccggtaaccgggtaccgtaaccggaacccgtaacgggtcccgtacccggtccccccgttacgggtaccccgtaccgtttaccccggttcccggtttacccccccgtccccgttttccccccgttccccggtttccccgttaccccggttacccgtttaaaccccgggtcgggtaacccggggtcccgggggtacccggtttaccgggggaaacccgggaaaccggggtccccggtaaacccgtaaacgggttaccggtacggtaccgtaccgtaccgtacgtaccgacgtacgtacgacgtacgtcgtcgtcg

SEQ ID NO: 24175 - DNA, 661 bp, Homo sapiens
  misc_feature: GYAE6OF01A43IY.21.22.B11.1.454.CMB.1.raw
  modified_base (487)..(487): a, c, t, g, unknown or other
  misc_feature (487)..(487): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccggcagagggtcaccatctcttgttctggagcaactccaacatcggaagtaattatgtattcgtgtatcagcaactcccaggaactcggaccccaaatcctacataccagacggaataactcaggcggccctcgacggggtccctgaccgtattcctcgtggcctaccgaagtctcggccaccctcgaccgccccttcccgtagaccctatccgaagggttcggggtcccttcccgggtaccggaggacgttggaggtccttaggaccttaagtttacnggttcaccgtacgtaccggacggggtaaccacaaaccgtaggttacgggattacggaacctaaacgttcgtagggtcgggttcggggtttaggggttcgggttaccggggaacgggaaccgggtaaaccccgtaaacggttccgggaacccccggttcggtaacgggtacccgg

SEQ ID NO: 24176 - DNA, 755 bp, Homo sapiens
  misc_feature: GYAE6OF01AU4CE.21.22.B11.1.454.CMB.1.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (319)..(319): a, c, t, g, unknown or other
  misc_feature (319)..(319): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagagggtcaccatctcttgttctggagcaactccaanatcggaataattagtgtatctggtatcagcactccaggaatccgaccccaactcctacactccagagaatancagccgccgtcgacggggtccctagaccgtattccgtctcggtcctaccgaacgttcctcggccctaaccctccgaacggtccccttacccgtcggaacccctacgttccggtaacgggttccggggtcccgttaccccggggttaccggaacgggtacgttcgggaacgggttcccttaagggtaacccgttttaacgtttacgtcgggtttagcccgttaacgtaccccggggaaaccggggtaccgaaccctaaacggtaagggttcgggaaacttaccggaacttaaaccgttccggttaggggtaacggggtttcggggttttacgggggttccgggttaccgggggaacccgggggttaaaccgggaaaccccggtttaaaacggttacccccgggtaaccccggtttacgggttaacgggtaaccccgg

SEQ ID NO: 24177 - DNA, 304 bp, Homo sapiens
  misc_feature: GYAE6OF01EPBYD.21.22.B11.1.454.CMB.1.raw
  modified_base (300)..(304): a, c, t, g, unknown or other
  misc_feature (300)..(304): n is a, c, g, or t
tcagtcgtcgctcgcacgaccggtgctcgatttagacgacagctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaaggctcgccccctcggtcactctcgttcccgccctcctcctcgtctctactgagcggctggcaggcgcatagnnnnn

SEQ ID NO: 24178 - DNA, 685 bp, Homo sapiens
  misc_feature: GYAE6OF01E4YNK.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgaatcagccaccctcagcgtctgggacccccggcagagggtcaccatctcttgttctggaggcaactccaacatcggaagtaattatgtattctggtatcagcaactcccaggaatcggacccccaaactcctcactccagaggaataatcacgccggcccctcgacgggggtcccctggacccgtattcctcgtcggcctaccgaagtcctgggcccaccctcacgtccccttcccgtcgaacccatcgacgggttcgggccttcccgggtccggaagggatgggaacggtcgttacggtaacctttaagtttacctggtacgcctaagtcccggaacggggtaccaccgaaacgtaggttcggggaacttacggaaactaaacgttccgttacgggtacgggttccggggttttggggggttcgggtttacccgggggaccgggggtaaaccggggtaaacccctaaaacggtcccgggtaaaccccggttcccggtaacgggtacccg

SEQ ID NO: 24179 - DNA, 685 bp, Homo sapiens
  misc_feature: GYAE6OF01CIHZY.21.22.B11.1.454.CMB.1.raw
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggaccccccgggcagagggtcaccatctcttgttctggagcaactcaacatcggaagtaattatgtattctggtatcagcaactccaggaactcggaccccaactcctcatccaagaggaataatcgacgccggccctcgacggggtccctagaccgtacttctcgtcgcctacctaagtccgtacggacctaccctccaccggtccctacccgtcgaccctagtccgagggttcgggcccttacccggggtaccgtagggacgtcgggaggtccttacggacctttaagtttactcgtacgtctaacgtaccggaaccggggtaccaaccgaaacctaggtacggggtaactcggtaaacctaagttaccgtagggtcgggttacgggggtttacggggttcgggtttcccggggacggggtaacgggtaaacccggttaaaccgttccgggaaccccgttaccgggttacggtaaccccggg

SEQ ID NO: 24180 - DNA, 755 bp, Homo sapiens
  misc_feature: GYAE6OF01ATV6L.21.22.B11.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggacccccgggnaggagggtcaccatctcttgttcgtggaggcaactccaacatacggaagtaattatgtattcgtggtatcagccaactcccgaggaactccggaccccctaaactccctacactaccgaaggaaggtaataactcgacggccggccctcgaccggggtccctagaccgtattcctcgtcggtacctaccgaacgttccgtagggccctaccctcgaccgtccccttcccgtacggaaccctagtcccggacgggttcgggtcccgttacccgggtccggaagggtacgtagggaccgggtccttaggaacctttaacgtttaccggtggtacgaccgtacggtacccggaaccgggggtacctacgaaaccggttggtacgggtaacttaacgaaccgttaaacgtttccggtaggggtaacggggtttccgggggtttacgggggtcggtttacccggggggaaccggggttaaacccggggtaaacccttaaaccgggtttaccggggaacccccggttcggttaaacccgggtacccgg

SEQ ID NO: 24181 - DNA, 730 bp, Homo sapiens
  misc_feature: GYAE6OF01EFP0V.21.22.B11.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagaggtcaccatctcttgtctggagcaactccaacatacgaagtaattatgtattctgtatcagcactccgaggaatccggaccccaaactcctcactccagaggaatatcacgccggccctcgacggggtccctagaccgtattctcgtcggtacctaccgtaacgtccgtacgggccctaaccctccgaaccgtccccttaccccgtacggaacccctaacgttccggaacgggttccggggtccccgttaccccggggttacgggaagggtacgtcggggaacggtccgttacggtaacctttaacgtttaccgtgggttacgaccgtaacgttacccgggaaccggggtaccgtaccgaaacgtacggtaggggaactaacgggaacctaaacggttccgttagggaaccgggtttcgggggtttacggggttcggtacccgggggtacggggaaacccgggtaaacccgtaaacggttacccggtaaccccggtttccggtaacgggtaccccgg
